United States Patent 7,745,391 (HUMAN THROMBOSPONDIN POLYPEPTIDE) - sequence listing, part 251

SEQ ID NO: 712385 - DNA, 175 bp, Homo sapiens
attacttatacttcctcaacgctccatacttcttaccgggaaatgaaatgagaagtataaagcgttgaggagtataaattgtagaggaagtataaagcgttgagaagtatacaatgttgacgaagtataaagcgttgaggaagtataaagcgttgaggacgtataaagcgttgag

SEQ ID NO: 712386 - DNA, 161 bp, Homo sapiens
gcactaaaggccaattcagatgagaggcggcggttcagggcaagaggcctttggtaggtaagaaaggaaagaggcttctgtttggttttagaaggcagaagaggctcttggtggaaaaaaggcaagcagctaccaggaaaccagccctcaaaggaggctca

SEQ ID NO: 712387 - DNA, 416 bp, Homo sapiens
cgcacgggcagataaagaccattcattcattcattcaccaggaagtgctcagccagcctgctgtgtgataggcgctgtcccagcagtaaaggaagcaggcaagaatccctgccctcatggagcaactgatgctggtgctatgttcccctaacacttggggggagggcgcgggcacacagcctgagttctgagggcttgaaagaactaacagttatctttcagtaattatttaagcaacaacaaaaccctccacattagacaaggagaagagagcaatcatccagaatttcatcatttagaaacaacatttctaactgtttgcgggcagcatgcatccaaggccagagctcaggccgcaagtgtttgtgtattcaagctccattgtgattaaactgtatgtaaaattttaaaaaaaa

SEQ ID NO: 712388 - DNA, 120 bp, Homo sapiens
cgagtacagactttgtcagcatggcggagacattagggggtttacaatgagggagtaataggatgagatttacatatgagaaaacattcctctggtaatcactgtaatggatggcttcag

SEQ ID NO: 712389 - DNA, 1676 bp, Homo sapiens
  misc_feature (1180)..(1180): n is a, c, g, or t
tccattttatgccttagggaaaacccagctatggaatatgtcatggggaaagctatgcacaggcccctgccctagggagtgggtggatgtgtgtgtttgggggaggtggcttgttcccagggtccatcccacactgttgcccagttggttcctatggcagcgctggcttgtggctttctctctcctgggttctcttcctctccctccaaataaagggctcgtgcagagattcttctcgtgcttataccaaaggtgtgggtggccaagagacgtgggtgagagtgggtgtggctgtgagaaacacaggcgcacaaatgtgcctccaccaggtgtggcaacctgtgttctgtgctcctccaagcggactcttcagtgatattgtgtgctcccaggatgtggacaaaaactctctcagtgtgttcacaaaaatctctgtgatataactctccgtgatctcgcggctgcggccaaatcttatctttcacagggggggccacaatttcttaaaagagtggcaatttctaaaactcccttctcgcgcgtgtcgcgtggcacacttctgtgacacacttatgtagaagccgagggtgtgtgtatcaacccagaaaaagtttccgaaacaccagggggtctccaaagaggcggaaacaccctttgatgtggggccccccaaagagggaggggacaccacaatgtggcatgttgtagcacagcgacaaaaaccccgatggaccccccgaggtgtctacaaaagggacccaatcttagcccccgaaaaaaaaacccagctgtggattcatccaaggggagttgtgtaaaacactcccctagagttgaggggactctcccccccacaacgaggggggcaatagtcgcccgacggtatacaacacacgcgaaaacagtggtgggagaatgatggaggaggggccctacccacaaacaagaccgcggtgtgtggtggaaacaatctttccccacacaaaaaatccttcatattcggaagcgttgtgacccattaaaacggcccccatttatgggtcgtcgggcgcaccgcatagtaggggcacccccccgataccacaaaaaaggtggggggggttcccactcgcaaagatgatataaagtccctccccacaaaaacgtagccgagcagcccacccaagggcatagatacccncctctgctgaaaacacattttgttgactcgagggggcccacacaagtacaacaaaaagacgcggcgacccctatgtgtagcacgaaagaaaaagggagtacatcacccccttcggtgcacaaaacacataggggagggaacaactacggtgctagcaaagaggggggtcgccccccacacgacgtggtggcggttaaataaagaacagagggaaccgcacatgcgatgtgtgatgacaagcaggcgcaggcacaaaatagtagtgggtctatcaccgaacaggatgtaataataacccggacagcaacccaaagagggaggagaaccccccccaccactttagtatagagttatgaatcacaccactcctgacagaacaaggaattaattgtatgatagcggctgacgatagttgaggcgcaaaaaatccagcacacccttcctctctgcttagaaagcaagaagagtcactaataagaagaagaaacacacaata

SEQ ID NO: 712390 - DNA, 686 bp, Homo sapiens
  misc_feature (575)..(575): n is a, c, g, or t
caactggcgagaagctcatacctgcctgacgtgccgccatcgccaccaggctgtggctggtcatacccggtgaggtattggcttccagtcacataacacatctgtgccatcgctgtccaggcataacgtcaatacgtccccatcctttgtcatacctaacgtcgtccatgcttctcagcactaactgcctgtcgaaattggcctcttgtagacagcttccagacctgcggggtcaaaaaatactgtgtctcatcagagagatacttcgcctcataatcatagaaggttccggacggttgaatacgtattgacggttcaatttcttcaccgagtatcgcaaccgtgaactccggcccatttagccatttttcaatcaatacttcttcatcgtgctgaaatgccaatcttaatgcatcttgtagagcattttctgctactacttttgacattcccacactgtaaccttcgcggctcgggttagcgataaccggcaaacccagagcagaaatttctgctaactgcttatcgctcaggccttgttcaaactctgtcgcgggttaacgctacccacgagnagcgaccggtaaaccggcaccttgccatagaagttagctgcgtatgtttaatccatttgaaagcgcagatgccatcactccgcttccggtatacagggcaagccccatcag

SEQ ID NO: 712391 - DNA, 338 bp, Homo sapiens
  misc_feature (101)..(101): n is a, c, g, or t
  misc_feature (134)..(135): n is a, c, g, or t
gaaacatcctgtctcttcctccatctgcagagcctgtagagccgcagagttctctccgcccagccctaatgattatgctctctacccctcccacaatcttnctccaactccttctctctgcatgcacctcaganncagtaccaagaactagcagtagccctggattcaagctccgcaataatcagtcaactcactgaaaacatcaattcactggtaagagtccagtgaggtcccctgattacagctggtcaatcctggactccagtttcctcttggggccctgaagaaaggggctaggggcccctgatgccaagggcaaatggggagctgggcaccca

SEQ ID NO: 712392 - DNA, 845 bp, Homo sapiens
ggagcgcgcgctgcgcgcctttgagccccgagcaacggcccctcgccttgcccacccaaccactggcagaccttcgctacccgctgctccccgcttccttagctgcctcgacatgctcccaaacctgcacagcctgcaacgaacgccccgccccctgcctctgcaccactgcccgcccgccccccccgccccctgctcgtactggccctccctggctagcgcacggcgctgccccacaccctctcccctccacctcacccgcgcacccaaacctaaacctcccaactgaactgcctacactccgcccgcacaccccccccaaacccccgccccgccccccccaccgcccccccgacccgccccccctggcccccccccccacccccgcgccccacgcaccgcccccaccccccgcccccccccccccgcccgcacccccccgcccccacacccacctactcacccgccacccgcgcaccctcgccccctcccccgccctcccccctacctcccccccccccccgcccccgccccccccacccgcccccccccccaccacctcccctcgccacccccagcactcccaccccctcgacccccccacccaccctacctccccccaccccccccccccccaccctcacccaccccccccccctccccttcccctgtctcaccctccgcgcccaccccccgcccccccggccgccccccccccacccccgcccccccccccccccccccccgcggcccaccccccgcccccccccccccccgccccccccccccccccacccccgccccccgcccccccccccccccccccccgcccccccccccccccg

SEQ ID NO: 712393 - DNA, 188 bp, Homo sapiens
tgttcttagaggatccccagctctgaccgagtccctgggacgatccgagtgcgagatcgagcgtctgagcgcctgaccgcagccctggatcgcctgcggcagctgcggcctggaacagaggtgtctgcggttgtcagcccgctgaggcctcggcaagaggagcttgggcctgtgtgcacatgagtacc

SEQ ID NO: 712394 - DNA, 163 bp, Homo sapiens
  misc_feature (110)..(110): n is a, c, g, or t
  misc_feature (124)..(124): n is a, c, g, or t
  misc_feature (154)..(154): n is a, c, g, or t
aattacagactcaggaaatgcagtgaaagaaaaatacaggttggccaggtgaggtggctgatgcctgtaatcccagcactttgggaggccaagatgggaagattgctttnagaccagaagtttnagaccagcctgggccacatagtaagatccngtttctacc

SEQ ID NO: 712395 - DNA, 926 bp, Homo sapiens
  misc_feature (291)..(291): n is a, c, g, or t
cgccgttggccgcctggccctgtcagaaatgcttcgtgttacccacagatctttcgccagtatgagaccggtgttccagtgctactggctccttcatctcactcgggcttatgccataagatgtaacatatttggtgcaggatgccgctgacgccttaatgcgttcatacggttgatagaccgtttatacgacctgatgcctgtgagctcgttaacaattggtggccgagagaggcggtaagacatcaggatgcattagttgatggcatgagattgggcgaatgctcccanaagtttgaaacgagaaaagggataggtcgtgactcgctctagccaaacgtctacttgacttactaagactaagagtacaagaacattggagcttataacttagttctaggatggtgttgccgaatgaaccacaaatcggaagaacgctggggatggcgtactacccactagctgactgtgactggcactgctctcataagcccaacggtaaggctattcggaagaagattaagctaagacgtgtgctgaatcccagttgtgcatacatccacgcgagcaggtgttgattgtttagctgttggatgctgtaattgctgaactttcaaagcagtctaaacctgtgaccaccccgtgaagaaattgcacaggttgctacgatttcctgccaaacggagaccgaagaaaattgggccaatatcatcctctgatgccactcgacacacaggttcggacgacaggggtggcacccaccagtaaaggatggaaaacactggaatgatgcattttacaccttttgagcgttgtcatatgagcaagggtaattttcccctaacttttatactctcacaggcggaatgtgattccgggcctctttgtggggcgaacaatttcttcacctcttgcgcctaagaagc

SEQ ID NO: 712396 - DNA, 504 bp, Homo sapiens
tggtccccccgctcctgctcctgactcccccctgttcgctctccccgagggaccatcggtcacggaagcccgcgcgcagcagccactggcttttaaggataccgggaaaacaccccgcctggagccgcgaggtggccaattcacccgaattcgaatcaccccttaccagccgccacgttaaatcccttggaaaaggtgtgtgctgacttgataagaggccccaaagagaaaggtatctcacaagtgaaaggacccgttcgaatgcctacccagactttgagaatcacctacccagagaaaactcccttgtggtgaaggttttaagaacgtgggagtcgtttccacgatgagaattcacccagcgactcacttgacttgccccagtccttctgagattgttaagccattacttccctccagtattgagcccggagttgaggtggaagtcacccttgccagatgcttaagtccaactattttaataaattgatgacccggttggtt

SEQ ID NO: 712397 - DNA, 1135 bp, Homo sapiens
cgttttcgtgtgtcgaggatgtggcctttctgcggcattgtggcgtaactgtttgccattgtgtagtgcgtagaacgtatgggcgtggtttgccctggcggttgtactatggtgggcctctgtcctgtcggtgaatactgttaaggtcatcaattgcaacgccctcttgatagagggcgtaactgttggggtctgctggctatgtagctaggtccaaaattctgatgccaagccaacgccctgcaaaaggactcgagggcaccgggagggaaaggacccgcccctgacccccgcagccacggcgtcaagctctcggcacagaacggcctctaagggtgactcagccaactccccttggggctgcgcagcaggaggcggggctctggcatcaggccccaggagcactgtgcagctgtgcccatggccctaggcagcgaggggacagcctgggggaattcctgcctagccaaggtcattggccgggcctggcctgtggatagtggggccaggggccggcccaggccaaatgagtgccctcctagttatgacaccaagtgactacaagggaggcaagacccctccaggcctctcagctcgagcactgggtcccaccacacacagtgactgtgccgtgcagtgcaggttctggccttatgtccttgaagagcatcgtggtagacccgaagcgcacagctcatcggtgccgcacatgacaacgcacgcgagcagacagtctgaccctgaggctagctatgtaacaacgcatacacctttcccctcgtctccagctgtaacctggagagtcagccatgaccttgtcgttttgttctcataaatagtcatctggggccgggcgcagtgactcacgcatgtaagtcccagcaactttgggacggcctaggtgggcggactcaccttgaggtcagggacgttcgagaccagcctggccaaacatggatgaaaccctgtctctactaaaaaaatacagaaaattagcatgggcgtggtggcgcgctgcctgtagccaccagctacttgggaggctgaggcgggagaatggcaatggcgtgaacccgggaagcagagcgttcagtgagcttgagatggcagcataatccacgtgagcctggaacca

SEQ ID NO: 712398 - DNA, 160 bp, Homo sapiens
  misc_feature (40)..(40): n is a, c, g, or t
  misc_feature (62)..(63): n is a, c, g, or t
  misc_feature (138)..(138): n is a, c, g, or t
  misc_feature (146)..(146): n is a, c, g, or t
ataatactgacttaaaaaatcaaatcccccgacatacganatttttaatctgtgccatgtgnnttcagaggtcttattttcatattcagactttgtattgcccactcatttgtataagtgcgcttcggccagcacggntcctgctnccgcgatgtggggt

SEQ ID NO: 712399 - DNA, 675 bp, Homo sapiens
cccgcgttctttttgctcggcgcaccttgcttagttggccaaagaactcgtgtgttgtcgtatttaacggcgtcgcgcctgcgttgtgtttcactaccccgccgcccccgctcgttgtggtggtgtcgccgcccctggcgtcatctgggtggtttggaggggtgacaggctacctgccttcttgcctaccttctggtgggcgttcgcatgtgttccgtatctgcgctccccctcctcatcggttggtttctcggccctctttaagggcctcatcgccccacacaatgccaggcggtgttgtcgcgcgccatgctcccgcggtgttcctctcccacccatgtagagtgtggtgttctcgcgcccgcccgccggctttttatttcgtgctcgcggcgcgtttggccactatagatgtggtgttccccctccgccgtcgcgacaccccgcctttgggtggggcggcttctgctacgctactctcacgcgcctctccccgcgggttctcgcccacacgcatgtgcccctcgtcgtttctcccccgggggcaccccctctcgctaggttagaagccccgcttgcgcccgcatgttgtccccgcgcagtacgtcgctcgctgccccgcggcgactctctttatcccgggtggttccccccaacatggtcagaacagcacaa

SEQ ID NO: 712400 - DNA, 798 bp, Homo sapiens
tctggaacgcattacttccagaatacccagggtctcatttgtgtggatagcatagtcaacgactcgtgcaactgaattcaggaaggtagcagatgatctgcagaacaatgcttctgttaaatgaatcgacagatgccgtgctgttacttgtagctaacaaaccaggattcgccaaattgtcgattgcggcatcagttgaatatgatgcagcataaacatctagggactctcagatcatctctcgctacacagtacacatggctatgttcccacaagtccatctttgatgcaaacatcacaggcaaactggatctgttcatgaagggcacttgatctggctgtgttcaatactgaggctctatccaccaacgctctcaatattgaagaatatgcggatatcataatcacaacgagacattgattctagatacaatatgtggctcttaaggctttgttttacaagctaaacaattgtagtattgtaatcttgagttacttattatacctactctgggacctgggtctctgggttaagaattagtgtaagaacctattgttgattgctcaatttagttggttaccgagtcataacagttgcatagtttagccaactgtgcttgggtggttcacatgaacatttctgccttggtggggaaaaaaagtgatacctgctatttcagatctttcatcgttcccataaagcgtagaaatgcctgggacatagcttctctgtgcaatccttccatataaattgtcatgagtagtggattcgagccccaagtacaaataatgtctaaa

SEQ ID NO: 712401 - DNA, 843 bp, Homo sapiens
  misc_feature (31)..(31): n is a, c, g, or t
  misc_feature (72)..(72): n is a, c, g, or t
  misc_feature (201)..(201): n is a, c, g, or t
  misc_feature (205)..(205): n is a, c, g, or t
  misc_feature (229)..(229): n is a, c, g, or t
  misc_feature (237)..(237): n is a, c, g, or t
  misc_feature (242)..(242): n is a, c, g, or t
  misc_feature (264)..(264): n is a, c, g, or t
  misc_feature (267)..(267): n is a, c, g, or t
  misc_feature (281)..(281): n is a, c, g, or t
  misc_feature (304)..(304): n is a, c, g, or t
  misc_feature (306)..(306): n is a, c, g, or t
  misc_feature (310)..(310): n is a, c, g, or t
  misc_feature (337)..(337): n is a, c, g, or t
  misc_feature (365)..(365): n is a, c, g, or t
  misc_feature (370)..(370): n is a, c, g, or t
  misc_feature (373)..(373): n is a, c, g, or t
  misc_feature (389)..(389): n is a, c, g, or t
  misc_feature (392)..(393): n is a, c, g, or t
  misc_feature (401)..(401): n is a, c, g, or t
  misc_feature (420)..(420): n is a, c, g, or t
  misc_feature (503)..(503): n is a, c, g, or t
  misc_feature (514)..(514): n is a, c, g, or t
  misc_feature (523)..(524): n is a, c, g, or t
  misc_feature (532)..(532): n is a, c, g, or t
  misc_feature (534)..(534): n is a, c, g, or t
  misc_feature (539)..(539): n is a, c, g, or t
  misc_feature (543)..(543): n is a, c, g, or t
  misc_feature (552)..(552): n is a, c, g, or t
  misc_feature (598)..(598): n is a, c, g, or t
  misc_feature (606)..(606): n is a, c, g, or t
  misc_feature (828)..(828): n is a, c, g, or t
  misc_feature (833)..(833): n is a, c, g, or t
cagtgggtggatatcatgaccatggactatntgatctttaatgttctggatcttaatatgtaaaccgccccntttatacttaccaggttcatgactacctccgcagcaagctgtgtcccctctatgaaaatgactgcatatttgataaatttgagtgtgtgtggaatgggtcagacagtgtcatcatgacaggctcctacnacancttcttcaggatgttcgacagaancaccaagngtgangtgacccttgaggcttcgaggnaanacagcaagccccgngccacccccaaaccccgaaaagngnggcnggggggcaagcggagaaaagacgagancagtgtcgacagtctggactttagcaanaaganctngcatacagcctggcanccnncagaaaanagtatgagcagtggcggcnacaaataacctatatatattccaggacaaggttaactaggtggacaagttattacttaataatctcacatactgaatactagncaaacaagttnttaaatgtnnctttgggncnccatntgangcattgacnttaatttccctatacaggaaatgattggaatagaattaaaaggagnccaacatncccagcccccaagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataanttttntttaattacc

SEQ ID NO: 712402 - DNA, 910 bp, Homo sapiens
gggacccttgattggctcatgaagttcctggtaccctagatatcctaccttggctccagcccgactcactgtggaccatcaccagagcccagccagaggccccctgagcatctgtgagcgctggagggacaacctgctggagcactacggtggcaccccccgaggatgaccagtacgtgccctattgcgtatgacctgtgcctacttcgatccccctgtcagtgtccacggcaatacgagtcgacttcttgctggtgtgtggtacaaagtatggcagagaggtgctagggccatccgcttcccagcccaggcataccatccctgcgtgttataccgcactcagtcgctccaatccaatggtcctggatccacgctcccggctcagatgtgaaccctccatcttgtgcggcaccttctctgcatctatactccagggccagtcagattggctactttaccctctccaatggctaccaggtcttcagaatggcatgcatgctatagactcctgtcatgctctctgccatcggcttcctataatcagtagggaacttcgcattacgagactgcccgtggacgaaggattgagtcgctacgggccctgacttgtgagcttggactggcaacaactcaagcccgatgcctcgagtcctggagaaacctcggcgttacgcacgcatgtcccttggagcagcggagacggttcgagatttctaagggttcttcgaataccttgtcccctttgaatctggggaactttcggcccagtaaaggaagcccaccattcccggccgtaaatctacctttgtaatcattgggcagccgggtaccaagtatggttcccttgtgccttactgcattaggcacgcagcgctccattgcctgtaattggtgcttctctagcgccacg

SEQ ID NO: 712403 - DNA, 1451 bp, Homo sapiens
  misc_feature (85)..(85): n is a, c, g, or t
  misc_feature (231)..(231): n is a, c, g, or t
gtattggtccgagtgaatcgagaaaggaggctgccggactgtggcggacggcgcggagctgctcggaatgctacaccctcgcaanggggctccccgaccaaaatccacgcaaccaaaagcacaacggggaggaactggacagacaacacgaaacaaaaccaacaagcacacacacaccgacacatacagaaagcagaagacaaaagcacgcacccctttttttcgacaaanagagaacacaagaaagcaacaaaaacagacgacaagagggagcacaagcaaaacacaaagaaaccaccaccccaagaaacgacaacagaccatagcaaaacaacacacacaaagaagagaccagagaaaaaaacaagcgacggaacaacaacagacagtgagagaacagacacgagcagcacaaaccaaaataaagaaatgagcaaacacacgcaaaaaaagcaaaagaagaaacaaagagaaaacgagccaaaggacaagacaagagagaccgacgtcgcagacaccaaccgcgaacaaacaagcagagccgacgaagagagcagagagacaaccaacaaggacgcaccgcaacgaaggaagacaaaaggagagcgagagcgatacaaaacacgagcagcgaacacgggagctacacaaacaacgagggcggaacaagagacagcgcccccagccacaacaaaaaaggtcaggcaaggaccccgagcagacaacagaaagccaaacgcagccgacgaggagcaaacaggcagtcacgcccccacaaaaaaagagcagaaaccaaccacacattgtgccgacacaaaaacaaaaacacacagagaacgcaacgaagacaaaccgctcacgggaggagcacaccacaagcaggagcagagcgacaacaagaacaaccgacgaagatacgacaaagcagaatggagagagaaggcgacacgaaagccgaaaaagaccgagaagaaatcaacagacacggacagaaacggaggagcaaaccggaagaacaaccagcaggaagacagccaacgaataaacaaaaaaaggaacacaaacacgacaagaagagagcggagagaacacacaacacacaaggacaacgaaagacgaacaagcagagaaagaaacaacgaaacgggcgaagagaagagagacacacaacacaggaagaaaaaagacacgcgagcgaacagtgacaacacacacaacaaagcgatgaagcgaaccggaaaagcaacacgatagcagacgacgagggacgggagaaacagcagcaccacaccagaccgcacaggccaccagcagacaggaagaccgacgcagagggcacacagcagcggaccggcaaaaaacgcaagagcaagagcacacgacagaacgagaacaacgaaacacacgagtgagcacaaacacaacatcagaaaacagaaggaacacaaaga

SEQ ID NO: 712404 - DNA, 347 bp, Homo sapiens
ccaccttatgcgtggggcgatctcagcccgctgcagcccctgtttcccgggctcaggtgattctcataccccggtctcccgagcatctggaaccacaggcatgcagcgccatacccggctaatttttgcacttacattaagtgacggggtttcgccatgccggccaggatggcctcgaactcctgacctcaagtgatccaccagcctcggtctcccaaagtgctgggatcacaggcctgcgcgaccgcacccagcctatatgtagtcaaaaagttgatttagagttgatttagagactcccatgtgacgcactcaccatcgttcccagcccacggcataatggtggg

SEQ ID NO: 712405 - DNA, 246 bp, Homo sapiens
cagattctccccagacgccgaggatggcctgtcatggcgccccgaaccctcgttcctgctactctcgggggccctggcctgacccagacctgggcaggctcccactccatgaggtatttctccacatccgtgtcccggcccggacgcggggagccccgcttcatctgccgtgggctacgtggactgacacgcatgttcgtgcgtgttcgacatgcgactgacctgtgagccagaggatggagccgc

SEQ ID NO: 712406 - DNA, 107 bp, Homo sapiens
  misc_feature (3)..(3): n is a, c, g, or t
aantggaagatagattgtagcgtggcccacgtgctggcctcccgcatctgctcaccccgatccaaacactcgacccaccacttcattttcacctgtgctggctgctc

SEQ ID NO: 712407 - DNA, 288 bp, Homo sapiens
tgagacggaatcatgctctgtcacccaggctggagtgcaatggtgcggtctcagctgactgtaacctccgcctcctgggattcgagattctcctgcctcagcctcccaagtagctgggactacaggcacccaccaccacacctggctaatttttttgtatttttagtaaagacggggtttcactatgttggccaggctggtctcgaactcctgacctcgtgatccacccaccttggcctcccaatctgatttgctttacaagtcctgcttcagggttaccttccctga

SEQ ID NO: 712408 - DNA, 304 bp, Homo sapiens
cgcgtcgactgtatgtgtgcctgtgtgtgcgcgtgtgtgggtgtgcacatgtatgtgtgtatgtgtgcctgtgtgtgcatatgtgtgtgagtatgcacatgtgtgtgtatgtgcgtgcgggtgtgtgtgtgtgtgtgtgtgtgtgtatgtatgtactttaagtaatgcatccttaactgcttttagaatttgaggatgaatcaaattaccatgctaaatatgaagaagacaatcttttcttcaaatttgcgtgtgtgtgtgtgtgtggtctacccgcccgcgaatttagtagtagtagtcgacc

SEQ ID NO: 712409 - DNA, 407 bp, Homo sapiens
ccttgacgggcaacttgttgctggtgttgctggcggtgcgcgacccgcgcctggacacgcccatgtactacttcctctggcggctggccttggtagacgcgggcttcactactagcgtggtgccgccgctgctggccaacctgcgcggaccagcgctctggctggcgcgcagccactgcacgggccagctgtgcgcatcgctggctctgggttcggccgaaagcgtcctcctggcggggatggctctggaccgcgcgggcgcagtgtgcccgccgctgcgctatgccgggctcgtctccccgcgcctatgtcgcacgctggccagcgcctcctggctaagcgggctcaccaactcggttgcgcaaaccgcgctcctggctgagcggccgttgggcgcgccccgcctg

SEQ ID NO: 712410 - DNA, 94 bp, Homo sapiens
tttggttgttcctcagcagctcgctgccattggttttgctcatttctcaaccagctcccattcgcatctttttccattcaagcgcacacagggg

SEQ ID NO: 712411 - DNA, 648 bp, Homo sapiens
tttttttcccaaggttttcccattcggccatttgggtaaaaactagtgttttaacaaaatttaccgcatttttaacaaatataacgccctcatttaccactccccaatcacaagcgcaactgtaggatggcaatcggtgcggcctcttcaatattaacccgctgccaaatgtggaatatacgcaaggcgattccactgggaacacccaggatttcacaagccacaacgtcgtcaacagcggtccagtcacgtgtaatacgactcctatgagcctaatttgggtaccggccccccccacaagatccccccaaccaaacagcttgaaccagacttccccactataagataaatagttgcaagtccctctgtagtattcccctacgaggcttagaaacaaacgcctgttaggcagccgacccgtggtaccgcttcaagggcagggccgaaaaggggtggcattagatgttcaaccgtcatgtttccttacggttgttaaaatgccaagcagcgtcataaagttgaaatagctcagcagtagatacaccaacggtttaagaagcttacgcgggctcataatcgtagggattataaccccctcgaactttgaaattctcacaatggggcccaataaccctcgccccgggccga

SEQ ID NO: 712412 - DNA, 496 bp, Homo sapiens
  misc_feature (404)..(404): n is a, c, g, or t
  misc_feature (409)..(409): n is a, c, g, or t
  misc_feature (446)..(446): n is a, c, g, or t
aattctcttgcctacacacatacacatgcatagctatatttttagaacacatgctccaagctaagccctttaacactctttgaaatgatagcatactaacggttgagactttatagtcacactgtaaatgaaagagtctcacagagagctggcatgaagatgtgggcatctggagagaggggaaggtctgcaaggagtttgagagatagaagcctgagacttgacccactcattgctctgaaattctcttgtgtgaacctgaaccagactcagcatgctgaacctttgacctactcagctccacccagacccctaactctggaggaaagccaaaagagctataggcaaggtcatcagtcctgggctgtagtgtgcctcctcctgtctcatggtgactcaaagcnagctncttgacctgtcttcacctgtgaaatggggcagggganggtgttgcaagtgtgatgggaattcaggaagatgcccatgagatgataaa

SEQ ID NO: 712413 - DNA, 681 bp, Homo sapiens
cgggccagggcctggtggatggcaagatctcgtaccgtgacgggctggggcaacacgcagtacgtagtggccaacaggccaggggtactccaggaggctcgagtcccgcataatcagcaagtgatgtctgcaatggcgactgacattcttactggaaactcagatcaagtcccaagactgtttctgtagctaggctacgcccgagggtggcaattgatgcctgccagggcgacatgcggtggtcccatttgtgtgtgaaggacagcatctctcggacgccacgttaggcaggcatagtgtaggcattgtgagatggggcactggctgtgccctggcccagaagccaggcgtctacaccaaagtcagtgacttccgggagtggatcttccaggccataaagagtgcactgcagaagccagcggcatggtgacccagctgcagaaccggtaggcttcgtgcatgcagcagcctcgcagggcccgaggtgatcccggtggatagggatccacgaatgggcctaggatgggacgtttttcttcttgggcacggtccacaggtccaagacaccctccctccagagtcctctcttccacagtggcgggccaactcagccccgagaccacccaacctcaccgtcctgaccccatgtaaatattgttatactgtctggactcctgtact

SEQ ID NO: 712414 - DNA, 941 bp, Homo sapiens
agcggagggctggacatgggccccggtccgctggcctgtgtcctgtctgcgtggtggacccttgcggcctcacagtatgttcgtcccgttcgtggcgtcatcccgtggctggcaagttgggagacctactgctgacatgcgagcgcttggcgctcgagcctgcgaggccctcatcgcctccctccttgtggtgcttggcgggcatcagttgccagctgcttctgtgccctcgttcatcgtggcgatgggtgtcgttgcggtgccatacgggatgaaacatgcccgagacaaagtggacaagcaggttggtggagaataagggggtccaggaaagatctcatggacctgtcaccctggtgttactgtggagtcccaagctaatgggatcgctagacctggaggtctccactggtgccaccacatagacggatcatgagacctctggtgagccgatccgccgagtggagaggctttcttcagacgggaagggccgtcgtagcaaccccacgccccttagctttcgtagacctaagaagggcttgaaggtcagcatggtgcgagaagggcgaataaatagcggtatccaagaggcttgaggtacattgtaactcccataggcaccgtgcgttcattggaacgcgccaggtaggcgcgcggaggtggtaattcaccccgtgtagtccaggcgtgttgaatcttggagagctcctcagcatcacttgacagtcccgcaatacaccgactcgatgactgcggacaagcacacaatgtcccaaggaaggtgggcccgcgtcaacaaggttcctaaggattcccagtgaaagggggcggggagaatgctacgaggaagcgcccggaacgacacaaggagtccacaaaacgagataactctcgcgggtaaaagaagttgcaccccccgtggcaactaccttcactcagtg

SEQ ID NO: 712415 - DNA, 153 bp, Homo sapiens
  misc_feature (7)..(7): n is a, c, g, or t
  misc_feature (15)..(15): n is a, c, g, or t
gcccccnagggcctnaaggggctaatgttttgggtaccagtaaattttgtcctttagccttttctatgtgattgtgcccgtcattctgttttaagctcatggatcaatggatttgtttacaatgtgatattttctattaaatccagtattttc

SEQ ID NO: 712416 - DNA, 675 bp, Homo sapiens
gggaaaagcgcgcgagcaagatggccaccaccaagcgcgtcttgtacgtgggtggactgcagaggaagtggacgacaaagttcttcatgctgcgtacatcctttgtgagacatcacagatattcagattcctcgtgattatgaaacagaaaagcaccgagaattggcttggtggaatttgagtgggcagaggatgctgcagcaagtaatcgacaacatgaatgaatctgagctttttgacgtacaattcgtgtcaattgggccaaaccaatgagaattaaggaaggctcttccaggcccagttgtcagatgatgactgtgttgaagaagttttctggaaagacgcttgaagagaataaacgaggacacgaagggtcagagcctcccaaagcagagacccaggagggagagcccatgtgtaaaaaggccgctcaaatcctcaggttgtcacatggaccttcaagattggaacacagccggtgccgattccagatgctccgtggtctgattgtcgtgccaatgacagcagagaattccgctgcctgtgccatcaatgaaaaggctgtggtttaagggaagcagcttcaccgaatattccccagtcatgtgcaggggtgattccaaaccaaatggctggggacagccatctatgaaagtcggatgaaacttatctcac

SEQ ID NO: 712417 - DNA, 752 bp, Homo sapiens
  misc_feature (15)..(15): n is a, c, g, or t
ctgaggagttacaanattccagaatgcgctattagtttcgtttcacctaagcaagtgcccccaatgttccaccctcctaactcgtgtaaaagttctcaagatacccctaggaataagtggcaactcaattgttgtatgcatcctcaagcaaaaagaattcggtgtccaggaccctatctattcgtggtcgtaaaccagttatgtgtctggcataacaatactccagtaagtcacaaagtcacaacctgctgcacataaactttggtgaacaagcgaccatgctttgtacttgtggaagtccataaacttgcgttcccaaagagtttatgattaacacattcaccttccattcagatataggccactttgtctggtgcatgttcaactcactgttcattatgcccttgttatgcgtgtaaacgcaatcgcaagccacctaaagtctaagtcaaagatgttatgtgatgattttgcagcgtttgtagacaaatgcctcaagcctcaagataatgaactctggtccccgattatggtcaacctcatgaccttctagtcaagtcacctcaggcttatatctttcaggttttatagatatatcagcaggccttgataataacagaagctagtgccattcactggttcactcgtactgctattcttcattgctggtgcagacccagcagcctgtttctgaaacatccctttatcctaacacgcttcttcacaatggcgtgctacaaagagcaagtgat

SEQ ID NO: 712418 - DNA, 486 bp, Homo sapiens
gcgcgccatttggcccgccctctcctaccgcgtcccaagccccagccctctcagccctggccaagcccccctggataccagagcccattggccctccctctgtggcccatctttcccaccagtactccccccgaggaagggtgcacacaagaccaccaccctgaacgcccagaaaggagactgtaagaagaacgtggatcccagaaaggagctccacccattggctctgaaactccccaggattgctgaaattgccaggctgatggaagacattggacccggcaccaggacccgggaggtgaacattcccaggagtatgtccacccttcctgggggcccttggctttgatcttcaccaatgaagcccctcaagggctgaaaataaatagaggaaaaatggagaccaccctcctgggggtcctcttctgagatccaatcccctggtgggtaattgtcaccaaaaaattttttttggtccaaatttta

SEQ ID NO: 712419 - DNA, 744 bp, Homo sapiens
ggccattgtgtggctggactcggccgcccctgtggtgtgcaggcgcgtgttcgggctcttgcctgtcccctgcaccctgcaccgcggttactggcttgcggtcctgcgttctgacaaccagcccttgggtccccgcccgccacggacatgcctgcgcgtctacataggacgcctgagctacaacgtcctgggagaaggacatccagcgctttttcatgtggctatggccgcctcctcgaagtagacctcaaaaatgggtacggcttcgtggagttcgaggactcccgcgacgccggacgacgccgtttacgagctgaacggcaaggatgctctgcggcgagcgcgtgatcgtagaagcacgcccggggcccgcgtcgcgatcggcgacgggctacagctacggaagccgcagtggtggagcgtggataccacgcacgtcgggagaacatctggcagagacccaactacggaccacctgttacgtacacgaattacgggctcattgtacgaacaactctttctagtcggcgcacgtgcgcaagattcacaggatctcatgcgacaacgcaagcgtgcaagtaacctatgcggactgcccacaacggaacggacaccaacttgagtggctgtaattgcagtacacgctcctacctcctgaccctgacacgcgtgcttttggaccaactctgggagtggcaccgcacatacaactggccgacatattagcgcctatggaacgatacg

SEQ ID NO: 712420 - DNA, 221 bp, Homo sapiens
atccccgcaggttgactgaggtcattcctgagttgaagtatgttaagagggtaatatttattgattctctaacataccatactccattgtatttcactctacacttaggagacttttagtgagttatgtccttgatgatattgcctatttttttttatagaacttgagtgagcgaaaagacaatgtgcctattcagacaatttttatgcttttataagggc

SEQ ID NO: 712421 - DNA, 233 bp, Homo sapiens
agtatttagaggctctaccaaggcctgtctacagggacagccttcatcaaacgggacattttttttaaaccctgttattttacaatgccacattatactgttgtaatggcttgaagcatacagggtacgaatttctgggattcgtaaacttactagtgtgacttctggacggtttacaggttcagacaaatggtttctcaaagggtttatcagttatgtattgatgatttggg

SEQ ID NO: 712422 - DNA, 191 bp, Homo sapiens
tatcgattggcggtacttagtgagtcccatctctaccaaaaagaaaatcaggtgtggtggccactttgagtcccagctactcaggaggctgaggtgggaggattgcttgggaacagaagatcaaagctgcagtgagctaggatcacagcactgtactccagcctgggtgacagagtgagaccctgtctcag

SEQ ID NO: 712423 - DNA, 369 bp, Homo sapiens
  misc_feature (89)..(89): n is a, c, g, or t
gcacgcggggtggcacacgagcccacaggagcacagcctgtggccccacaccctcttctcaacacacacttacggggccgctgtgtccnataggcaggacgcggatgtggtctcccctttccccctttccaagtcaagggagttggacaagttgcacagtgtttggttttaaagcgcacacctttgggaaagccacacattattgagacttacatggaattccccgggagtgaaactggctttgtgctcttcctctctggagggccatgggccatcaggagcttcacatagagccccaagccacaacccccttcctttacacgagagggaaccttattgcgcattgggtgccttttctcttgtgtgttg

SEQ ID NO: 712424 - DNA, 143 bp, Homo sapiens
ctatgttccactcgttacttttgatgatgtttggcaaggggtccggtcttggtagcacatttgaatttggcacagggggtacatctggttgaatggccactatccccaacttggattctcattcttcactagtcaacaactcc

SEQ ID NO: 712425 - DNA, 128 bp, Homo sapiens
ctgccttctctagctctaccaccttttgccactcagcaggtggtcccccctcgagtcactgagccccaccaacgggcagtcccatgggactgtgcgggccgttgtcagtggacagcggctgtgtactc

SEQ ID NO: 712426 - DNA, 251 bp, Homo sapiens
cgtactatacacctaactacttcaaaaacaatttgatgggcagggctggtggtcacacatgtaatccccgcactttggaggcgaagtgggcagatcacctgaggtcaggagtgcgagaccagccctggcagcattagaaagccccgtctctactaaaaatacaaaaattagctggggatggtggtgcacccgtgtaatcccagctaccttggaggctgagtgcaggagaatctggctgaaccaggaaggcc

SEQ ID NO: 712427 - DNA, 434 bp, Homo sapiens
  misc_feature (317)..(317): n is a, c, g, or t
  misc_feature (336)..(336): n is a, c, g, or t
  misc_feature (409)..(409): n is a, c, g, or t
tcagacgcaattcacagtttactggagagatgaactgctcatgtagagatgttgagaggcacatggagttttcaggagatactccaacacttgagctcaccattatagcagcaggaagtgactacaaaattattacaatagtacaatatgtgctacagttaagtttatgccattatgatttaatcttgcatctttacatttgtttacatttctttccatgcaagtcgcaccatgtattgtctgcaattggatgcaagaattttgatagatgttaatattttataaaatatttttgtacattttctggtaataaatgntaaaaatacactatcagtntttacatatatttgatgcattcaagacatatccaactttaagaaaatatatttccaggctacaagatatgtcngggagttttcctcaatttgttgaaa

SEQ ID NO: 712428 - DNA, 994 bp, Homo sapiens
acttttggtgttgtacgacgacgtcgggcgcgttggtataatattcgtgcaggggcttcggtagtatttttcaaaaatgtgccgtgtcaaaagcttggtgtgccgcccttttctttggggtttccacccttgggccttaatcacttttggggggcaagaacatcgccccgattgtcgggtttgtcggttccgccgtgtaccccgccgggggctggtcccccctagtgaggggcgctggcatcccttgacgggccgctcgctcctcttctttcgcttgtctgcagaaattcttgcccctggtccgctataaggacccctaagcacccgcctcctgtggtggggcgttgtacacgaagtccgcaaaatccaggtggctgttcccacacagggaaggaagtaaaacaatagaggcaccatggttagcgcgtaccgttgctccaaaccagacggggcttttccaaccaacatctggtaacaatactcctgtacttttttggctgaaaatcagggataccaactttttaaaaggtcttgtgaaaaaccaccatttgcaggttaactaaaaggacgacaggtgcctcttttttccgctcattttgcggggtgcggtaatacagtaaaatgggcgatccaccctcaccacgaaggatgccggcttcaaaggccagcgtttcttcatgacaaatactcccgttgcaccgtttcggaaccgttgaccccactatgagtagctcttgcaaacatcagtgtaaaataatatcggcggggtagaaaatgaatggaggtgaagaacaaatgtaccaactttgttacatattgcacagcaggcacacgcaagataaaatgttgccacacgtgcaggcgacggttcactctgtgggagaaagaggatggagtcacgacttagtttggattccgatgaataattattttcaccttccttttctgaaaaaaaggagaataaaaaataatctttcaaaacccccacataaca

SEQ ID NO: 712429 - DNA, 169 bp, Homo sapiens
tggcttagctgttccagtggcatagctgtttcccagaacgacgttatagcagaatttagactgtagctgttcgctatgcttgaaggaacgaagcaaaacaactgtcagtcttcctgaaatgaagaaactacaccagggctgctatatcagagcaaccccaaccagcact

SEQ ID NO: 712430 - DNA, 627 bp, Homo sapiens
  misc_feature (9)..(9): n is a, c, g, or t
  misc_feature (109)..(110): n is a, c, g, or t
  misc_feature (117)..(117): n is a, c, g, or t
  misc_feature (165)..(165): n is a, c, g, or t
  misc_feature (176)..(176): n is a, c, g, or t
  misc_feature (185)..(185): n is a, c, g, or t
  misc_feature (187)..(188): n is a, c, g, or t
  misc_feature (190)..(191): n is a, c, g, or t
  misc_feature (201)..(203): n is a, c, g, or t
  misc_feature (210)..(210): n is a, c, g, or t
  misc_feature (227)..(227): n is a, c, g, or t
  misc_feature (240)..(240): n is a, c, g, or t
  misc_feature (242)..(242): n is a, c, g, or t
  misc_feature (274)..(274): n is a, c, g, or t
  misc_feature (304)..(304): n is a, c, g, or t
  misc_feature (308)..(308): n is a, c, g, or t
  misc_feature (317)..(317): n is a, c, g, or t
  misc_feature (324)..(324): n is a, c, g, or t
  misc_feature (329)..(329): n is a, c, g, or t
  misc_feature (369)..(369): n is a, c, g, or t
  misc_feature (386)..(386): n is a, c, g, or t
  misc_feature (394)..(394): n is a, c, g, or t
  misc_feature (463)..(463): n is a, c, g, or t
  misc_feature (497)..(497): n is a, c, g, or t
  misc_feature (500)..(500): n is a, c, g, or t
  misc_feature (504)..(504): n is a, c, g, or t
  misc_feature (598)..(598): n is a, c, g, or t
atataactnacagaatagtgcaacactagacatgaagggatcaccactcataatcgggcctttacaaccgaccgccccccctcatcaagagagagagagaacccatgcnnaacagcnaactatccagaaataaaagaatcaccagaatatatcgcatcggaagtnacaaatccacnaaaaaaaancnnannaaggtcaaannnaaacacntcccacccgcccctgcncgaaactcagtantngcgcggtagggcagaccgaaggcaaagggagnccacgtccccgcgagccggcgacaacgggnggcncgcgcgcanggggagnggcgncgtgtgcggggcacgcgggggggggggcgggcacgaaccngaatgggactggaaganaaaactgncgctgcgttttcctctcttttttctttttaactcactcaccaatacacctttccctcttcgcatttcangacaaacactataaactcttcaaacaaaaatctnttngaangtcggttttctcttcacgtatgtctaagaatcacatacaacgccatattacattggtgtcttatacccctagaatatcgctaacaccttataanaaaatcgcgcaaatttttctttaaatttg

SEQ ID NO: 712431 - DNA, 219 bp, Homo sapiens
  misc_feature (42)..(42): n is a, c, g, or t
  misc_feature (109)..(109): n is a, c, g, or t
  misc_feature (199)..(199): n is a, c, g, or t
  misc_feature (215)..(215): n is a, c, g, or t
ccggttgatgtggaattgggattacaggcatgagctacgtgnccagccgcctagccaattttttaagtttttgtagagatggggtcacaccttgtttgccccaacgtgntctcaaactcctgagctcaagccatcctcccgccttggcctcccaaagtgctgggattataggcataggccactgcgccctgccaatatnatggctaatactgtgntaag

SEQ ID NO: 712432 - DNA, 904 bp, Homo sapiens
  misc_feature (188)..(188): n is a, c, g, or t
ggagaagccgcgatagccgagtacctcgcggggccagtctggtctgtgcgtggtgaatcttggactgttgattgaaccgcagaggcattcctgtggaggttgatgagtcatatgcataaccgactgagtcggtgaaaccgatcgcagaatattcgccggtaagaggaatcagagccatgctgctccanaatatggatggaacagtggtgagcccgatcagtcttgatattgcaaccacaccaagtgcttcagaatgttccatccgagagagcattattcctcaaagacgtcatctcaatccgtgaaatctttggctaatcaccagtcggtctggtagtccctggacaaaggtcacctttggtgctgtggtcatctcagatgttctggaggacacgtgaagtacagtttctgcgaaggagacacctatgcctgggacaaagctttcccttctgggtgctctgcagtcagcggagcgctgcgtctgagtctgtggttggagctcccgtccctggagagcatcaggtttgactttatggaaaaacgtcatcacatggctggtatctcaggtttcagacgggttctcctgacactggctgtgactcacgacaaatcagaccaaagtttagctaatgctcagcagacttccttggggcggtaagccaggagatgtgtgcaacggccccagtctctacaggaatccgaagcaggcctggatcttgcaaatcatagacacgggattttgattcccagggccccaggatgttccttgggcacccaatgccagctgttgaaaggcccctggcccttcaacttccgggttgttatccccaaggaatctcccagaaactttaagggccagggaaatccctaatttgaacgctcaggtttcccgctttgcccattg

SEQ ID NO: 712433 - DNA, 195 bp, Homo sapiens
caaagtcaagatggacgtgaatttccgcggggcagcttgttgtgtgttgtagtcttgtaaaaggaaagtcaagtctggattccgcaaagactcctctctgtacaagggcaccgtggacacgtgtgctcgtatatggccgtcggccgacaaagtgaagcgaaatggtcagctgaacctcagtcgagcccgcctgtt

SEQ ID NO: 712434 - DNA, 252 bp, Homo sapiens
tgtgtgcatgtgcactggagtacctcaggcttacctgtgactatgcccaccagtcaaagaaagctgggaacacatgtctagtcgaacaaggtttggtttattacttgctacagcaaaagaaatctcacaccttgaggaactctgggcatctcaaggggatgtaaagtggatttcgaatttaggattctgttagatggtttgggggaggctttaagaatgcaaggattttctctggatcagttatggtcagga

SEQ ID NO: 712435 - DNA, 1162 bp, Homo sapiens
gggagcaggtcaacagcgtgagctgatcaactgaccggactgaagaaggccagccatgcgagatcagactcgagatctatctccgactctgagaacctggatgtcgtcatggcatgcaccagtacagaacgataatgtctcggcatgctagctggaatggccatgcaacaagggagcttacatgcgtcaggctgcgaggaagatggagggtcgactgtcaagtgtccaacgctacaagggctccatcacctgccctcgatggccaatgattgcgacatgcctggaagagagggcaagacgtggtacctagacgatgacccaagtgcagcgtcgcgaggcctaggtcatgttgaactagtggtgcgcttggagcgatgcacacgaacgcgtgaacggatgtgcttgctgctacggtggaatgacggagcggaggtaatccgccgatgcagtaggaaggtaccatggccgatccaggcatcctaaccgtgctgtaagcaagctccacaggcggctgctgggcatgggaggcctgaatgagggacggtccagtcggggccatacgcacttccccgccggtgaatatactggcgaggcagttgatgctgggatgcgtacagcctcgtgatgactgggcggatgccatgaacttgcgaagtcagctcgccttgagaacaagctcaggctgcggggtaccttgctcgttatgtcgtgccccgccgaatggcccggaaaggcgccggggatggctccgaccgaagaggtagatggcaaagcggatgggggctgagtgctaaaacttgccgaataagcctcttctcgctgaaactgagatggctggacaggcagacccaaaagctccctttccagacccgcagaagcttccaacacgtttggggactgtggaaattcgccttcggggcgccggccaggcccaatccgagcttcacaagggtgtgagaagagtaatgatccctagatgatatccttcacacccccctggtgcaaattgtgcaaaaaatgcgcggtccggaaaagtgagaggataacacctctcgaaccgccatattagcgcgagacccgaaggacaacatagtattaacagggaagaagtccgatcatctataaagcacctatagagagagccagtcacctaagagaggag

SEQ ID NO: 712436 - DNA, 680 bp, Homo sapiens
ctaggcttgggtgggaaggcctgttctcgagtccgcgcattgttcgtcaccgccagtgtcgggagggtggtgtgagttcgtggccccgcgggggaacaacgatgccgcatctacgtgggtaacttacctccagacatccgaaccaaggacatttgaggacgtgttctacaatatacggggctatcctgggacatcgacctcaagaatcgcgcgcggggaccgccttcggcttcgttgagttcgaggacccgcgagacgcgggaagacgcggtgtatggtcgcgaccggctatgattacgatgggtaccgtcgtgcgggtggacgtttcctcgaagcgggcgtggaaccaggccgaggcggcggcggcggtggaggtggcggagttccccgaggtcgctatggcccccatccaggggtctgaagaccagagtggttgtctctggattgcctccaagtggatgtgggcaggatttacaggatcacatgcgtgaagcgaggtgatgtgtgtatgctgattgttaaccgagatggcactggtgtcggtgaacgttgacgggaaagaagatatgacctatgcagttcgaaaagtggttacagtaagttagatctcatgagggaaaaattgctcatcgggtaaagtgatgggccagaagtccagtatggaaattcgatttaaagcg

SEQ ID NO: 712437 - DNA, 366 bp, Homo sapiens
tcagatcccctgagagcactctttattttccttctaaattctatggttttctttgcatttcttgaagtgtatatcaagggaaacggtgatcaccaatacatgcattcagtgttgttttttttaaggtggctatcacttaaatcaggatcaaggcttttgagcaaagcctctctgcattttttccccagtggaacagactctgctgtacattgatgaggcagagaattgaaatattactttgcatcagtatcggctagaaaagaaaataacctaagaccctgctagtttactcgtaacaacttacagagagtctttctgttggaagaatatgcaacaaatcagaatcacgtttttagttgtgcgtgt

SEQ ID NO: 712438 - DNA, 226 bp, Homo sapiens
tatgcgcgctggagtacaaggagaaagccatcaggcggcagggctaatggacagacagctccaggctggggatggagaggcactgtggttcctttactcatccacagcctctggattggggtggggactgcaatccatacaggtccgactgtgtccctaatggaacccataacagcccagtcgcttcctgagggcagctgcttcccacgtgctgtgggcctaagaa

SEQ ID NO: 712439 - DNA, 188 bp, Homo sapiens
agaccctatctgggaaacaaaaaagaaagaaagaaattgctacagccaccctaccgttcagcagtcaccaccctgatcagtcagcagccatccactcaaggtaagaccctctaccagcaaagggattacaactggctgaaggctcagatgattgttagcatttttcagcaataaagaaggaaaattag

SEQ ID NO: 712440 - DNA, 292 bp, Homo sapiens
aatccaagcagtcgctccgaagcttccctcaggttgctggcgctctcgcagacccgacgcacgggggcctttcagttttatccggtaaacccaatgattagaggtcttggggccgaaacgatctcaacctattctcaaactttaaatgggtaagaagcccggctcgctggcgtggagccgggcgtggaatgcgagtgcctagtgggccacttttggtaagcagaactggcgctgcgggatgaaccgaacgccgggttaaggcgcccgatgccgactgcttggattacaagga

SEQ ID NO: 712441 - DNA, 358 bp, Homo sapiens
gccggcaaactatagccataacacgaacccaggagacacctacggcccagatggaaaaggcttcctcaatcggaaacacgagtgggaggcccacaataagaaagcctcaagccggtcctggcacaatgtatatagtgatcataaataaccaaagaaatgggttactacgaaagatgcaaagactgctgctaactggaataccctaccacagcgaggtccctgtgagtttgaacgacgctgtctgcgaagtaacccttaacttacaaaaagaagaaacacgtatacaagataagactaaatgatggccatgagtacctcttccaaaccaaagacgataaggcaatgacacatggatcca

SEQ ID NO: 712442 - DNA, 174 bp, Homo sapiens
gagagataaaagaaaaaaatgctcatctggagagagaatactgggatagttattttctcagttgataaggccctctgttaaggatggttaatttccctaatcattttattgaataccatatctaaatagagattatccttttcaactttaagcacactgtactgatttggttgg

SEQ ID NO: 712443 - DNA, 392 bp, Homo sapiens
cctcaggcgtcggaggacgcgtgggttagcatttaatgtgatgatctaagaaattagaagtagaactgggtttaatggtatagacatctttgatattattatcaataatttgtccagagcacgaacaagcgaccacacgctcaataagactaaacaaaacaaaatataatatgtacatcattcaagtgtcccatgtggcttctattctacctgtacgaaaatgatacaaagagccaccctaagatatttgaagcctgacaaatcagcttcatggagagcaggtaccaaatgcatttggcaaccgaaagggcagatccaatagaagacccgctccttaaattaaacataacaatgtaagaatacgttgaacaacataacatacaatacaacgg

SEQ ID NO: 712444 - DNA, 410 bp, Homo sapiens
cgaggatccccggtgagcaactgcaacagtcagggagctatgggctgtagatagatgttggagaaggcactaaaggttgagcagaagggaggtaggacaccgggacatggccggtcagcagctgacaagccccgctgagatcgtggcggtgctcggccaccatctgaagatttaggccagtcctcgttgggcttacaggcaggcccgtatggtggccggcaagttggggaccctcccatttggatacattagttccccctcagctactggagatctcagccacaactgggctccagctgtgacccagactccgccaggatcccctagatcctcagctgtcagataatcccctgtccccctcctcctccccactcaacccccagtgcttgacatgttgcagtgtgcttccg

SEQ ID NO: 712445 - DNA, 1885 bp, Homo sapiens
gttgccggtggtgcggctttgctgctgtgtgtctctagtaggatagcaggacaagcaagagaaggactacgagtcagcagaccagctgtgaaattctctacgtgatcgctcggtacgttcggcatacgctcgcatctcctctcgatgtggagggtagagcagtgacgtactacgcctcgtactgctacgtagttgctctatgcacccgatatctatccattgcccatccctcttgctggtgtggttgttgagcgacaacatgatgcttgggtgttgttgcgcttccacgtgtgtgtgtctgcatgcttcgcgctggtgctgccacgcgagggtcgtttttcttttttgtgtgagaagctcattctccttctgtgtggctggcggccagttttgtgtgagctcctagtgttattgtcgccctctcgtgggcgtgtcgcctcctccgtttgctcctcccttgtgtgagatctgtgtcttgtggcggaaacgatggtggggacaaatagtatggcggcggctaccagtagcacgacgagaggtgtatgctacgcaccagcagattgtctgtgcttggaccacataatccgtccagggggtgggtcgctccccccgtctacttgtactggttgctgcccctcgccatatgtgtggcttccttcgagctgctgttttttgcgcacatctacataaatattgccgtcagattttttggtagggaggtcgtacatcttaggggccgcactaagggaagcagaagtattgacggcgcatgcgtcagatggactgatcagaatttggtggttctcaccaccaccacccaggggtgttgttgtctgagcagcgcaacatttgagccgccttggggtggtgaaccaaccacagagtgttgcgtccaccacaaagatattgtccgctgctgcgttgctgaatagatcggttgggtgcggacgacaaagagtggcgtttggttgtggcgacaagaagatgataattttattgtgggggcgccgaccacaatacatctcgtcggtgacgaaatactgagacccagacacctttttgcacagagggagatgggtaataggttctataggcgcccccgattctcttttagtgaggggacgagccgttgttgacacccccaggggggcccccaagggagaatttgtggtgtgacagcgcacagagataaacaggatgtgccccccacagaggaagagcctttctttgtacaggtaggttcctttggtctctgtctctgcccagtgggatagactctgtgggataagaggagcgcacaacacacactcgggcgctctctctggtggttccacacactcgcgcctacaccccccaccagagtgcccctctctgtttgggagtgaaaacacactactggggagggccctctatttggcgtgagtatgcacagtcccctcgtgcgcgcaaggtgtgtaggagacacccaaggacacacttttgcccaccacgcaacaggttgctcatcacattgtgccccccaagcactctgggagaaatattgttcaacatgtcgcaacacattcacacaccgggcttaagagggaacaccacgagggtttggaccaagggacacaatggagccctgtggaaggaaagggcgcttctctcagcaccacgtctaaggagaaaagaattttgaggcaatctcccgggtcaccatggagatctcctgctgtcctgtataatggggaccccctctcccccctttatcttttgccacactctccgtctctccccaatcaattggtttttttttgtgtgtcaactgggccccctctattttattccctttatttttcccccctttcaacagagaaataaaggttcttgaagttaaacccaa

SEQ ID NO: 712446 - DNA, 313 bp, Homo sapiens
  misc_feature (86)..(86): n is a, c, g, or t
  misc_feature (191)..(191): n is a, c, g, or t
  misc_feature (214)..(214): n is a, c, g, or t
  misc_feature (245)..(245): n is a, c, g, or t
  misc_feature (304)..(304): n is a, c, g, or t
taagcaacctgtgtggaagaagccatttttaattgtttatttttttgaggtagagtcttgccctgtcatccagtctatagtgtagnggtgcaatttcggctcactgcagcctcccacctcctgggctgaagtgatcctccctcctcagcctcccaagtagtgtgccaccatgcctggcgttttttttttgnattttttgtagagacagggtttnatcatgttgcccatgctggttttgaactctnggactcaggtgatctgcctgccttggccttcggtgctggattacaggcgtgagccctgngcctggccc

SEQ ID NO: 712447 - DNA, 341 bp, Homo sapiens
agttcaaggtcagcctaggcagcatagggatataccacctcataaaaagcaaaagacaaaacaagcctatggccagggctacgttgtctgtggggccttgcatatgctgtataagtctcagatttcctccagcagcctgaggaaactcaaaggcacagttcccagatactgcgagagaaccaccatctctggcaacagtttccataacaacaggaatcagggatgtggagggagatgtagtaggagccccccgccctcctccccttctctccttcctcctcattctaacgcaagctgctggccatgcacctccagactgccccttgggggtgagtttcttg

SEQ ID NO: 712448 - DNA, 440 bp, Homo sapiens
  misc_feature (21)..(21): n is a, c, g, or t
  misc_feature (37)..(37): n is a, c, g, or t
  misc_feature (51)..(51): n is a, c, g, or t
  misc_feature (67)..(67): n is a, c, g, or t
  misc_feature (115)..(115): n is a, c, g, or t
  misc_feature (137)..(137): n is a, c, g, or t
  misc_feature (153)..(153): n is a, c, g, or t
  misc_feature (157)..(157): n is a, c, g, or t
  misc_feature (222)..(222): n is a, c, g, or t
  misc_feature (237)..(237): n is a, c, g, or t
  misc_feature (245)..(245): n is a, c, g, or t
  misc_feature (417)..(417): n is a, c, g, or t
ccgcattccggtacggaaaantcaagatgcaggaagncccggcctgccgcntatttatagtgcagcnagtccgcttaaaaatacacttggccccttgcacttgccgccgggacantggcaaccctggacgtggggcntggggcttgtggcgcntgcntggcggggttgactcttccagtgagggcagaaccaggcttggcaggaggggaggacggtgtaccntgcatgcatcagagncctcaagntctcctcatgagagccaccaagcaggacagagcagctcttgtcccaggtcccatcggcatgagcgccgtgtcaccaggagaatagtgctcacagcccaggcagggtgtgtggcaccatggatgggctcgtggggcgggatgggacagggcacgggttctcagaaaataaacntgctttattggaattaaaaaaaa

SEQ ID NO: 712449 - DNA, 473 bp, Homo sapiens
  misc_feature (95)..(95): n is a, c, g, or t
  misc_feature (102)..(102): n is a, c, g, or t
  misc_feature (222)..(222): n is a, c, g, or t
  misc_feature (224)..(224): n is a, c, g, or t
  misc_feature (232)..(232): n is a, c, g, or t
  misc_feature (262)..(262): n is a, c, g, or t
  misc_feature (276)..(276): n is a, c, g, or t
  misc_feature (289)..(289): n is a, c, g, or t
  misc_feature (293)..(293): n is a, c, g, or t
  misc_feature (298)..(299): n is a, c, g, or t
  misc_feature (306)..(306): n is a, c, g, or t
  misc_feature (335)..(335): n is a, c, g, or t
  misc_feature (369)..(369): n is a, c, g, or t
  misc_feature (381)..(381): n is a, c, g, or t
  misc_feature (386)..(386): n is a, c, g, or t
  misc_feature (389)..(389): n is a, c, g, or t
  misc_feature (393)..(394): n is a, c, g, or t
  misc_feature (399)..(399): n is a, c, g, or t
  misc_feature (404)..(405): n is a, c, g, or t
  misc_feature (408)..(408): n is a, c, g, or t
  misc_feature (420)..(421): n is a, c, g, or t
  misc_feature (425)..(425): n is a, c, g, or t
  misc_feature (430)..(430): n is a, c, g, or t
  misc_feature (437)..(437): n is a, c, g, or t
  misc_feature (446)..(448): n is a, c, g, or t
  misc_feature (453)..(454): n is a, c, g, or t
  misc_feature (457)..(457): n is a, c, g, or t
  misc_feature (462)..(463): n is a, c, g, or t
  misc_feature (468)..(469): n is a, c, g, or t
gacattttatttccagtatcatgctaaaaatctccttgttgtgtgattcttttatttcttgacatgcacacatatatggatcaaaaagtatgtanaactagnaaaatggactccaagcaaaaatggaaaacatgtttccatgagcttagatttccgggtatattactaccataaacctaaggtagaagtaatgcattgttcacttaaatgtccacttttctnanccaagtcnaagggtctgtgaaaaatgaaagatcagaanagtcccaagataantctgggaaatccntatncagtnnttaaacnaaagattacacagaaattagttttaagtngtgaagtctcttattctacctatgacagtgcttncctgagggtatntttgntanatannaaacntttcnnatncattttattaanntctnggctntacacangtatacccnnngtatnngtntgaannttacnnatca

SEQ ID NO: 712450 - DNA, 156 bp, Homo sapiens
atcagatgtaaaatcattccttctgtttactcttttaattttcatccgttgcaggtagtgcaaattcaacttcaaatatggtgtaggtgttgctagattccatattttccggccttgggagttttgctaatattttaggcaaaaaattttgctcag

SEQ ID NO: 712451 - DNA, 1246 bp, Homo sapiens
  misc_feature (542)..(543): n is a, c, g, or t
  misc_feature (551)..(551): n is a, c, g, or t
  misc_feature (556)..(556): n is a, c, g, or t
  misc_feature (571)..(571): n is a, c, g, or t
  misc_feature (610)..(610): n is a, c, g, or t
  misc_feature (657)..(657): n is a, c, g, or t
  misc_feature (1032)..(1032): n is a, c, g, or t
gtccactcacagtagtgaaagtgatctctttgcagaactatagatagaacagcctgggaaactaaagggagaaatacaagtgttttcggggcaaacactttttttctgggtgatgcatctgttgaaatgctcaagacttaattatttgcctgttgaaatccaccgtagaatgcccccatccggttcctcttcttccccaggtgtgcccaggaattaatcttggtttcactaccacttaaaattcactcctttcccatcatgtccattcgaaagtgcccttcacgaaagaaatggtcactgaatgggaattctcttaagacaaccctgagattaaaaataagactatttggataacttataggaaagcctagaacctccccaatagagtggggatttattattctttctgtccccttctctctttggaccaataagttaaattgagccagtcattgagttatgagtttggttgccagtagttcttatcttgtgggcttgatttcccaaaaccacatggctgctgaacttacccgggatcctcnnacctcacnatgcnaaccacttactaccnggcctttttctgtgtccactggagagcttgagctcacantcaaagatcagaggacctacagagagggctctttggtttgaggaccntggcttacctttcctgcctttgacccatcacaccccatttcctcctctttccctctccccgctgccaaaaaaaaaaaaaaggaaacgtttatcatgaattcaacagggttttcagtcccttatcaaagagagatgtggaaagagctaaagaaaccacccttttgttcccaacttccacttttacccattatttttatgcaacacaaacactgtcctttggggtcccttttcttacagattggaccctcttggaaaagaatttatcgtattcccacgtttttttagccctcaggtttaccaagatacattatattgtattattttaacccttatatttatggctatatcttggtggataatacatttcaggttggntgctgggtgactttattataatctgaacctaggatatatccttgggtcttccacagtcatgtttgaggtgggcccccgtggtatggtaaaaagccaggtataatgtaacttcaccccagccttgtactaagctctgatagtggatatactctttacgtttagccccaatatagggtaattgcacatttcctgccctctgggtccccattttact

SEQ ID NO: 712452 - DNA, 1273 bp, Homo sapiens
  misc_feature (777)..(777): n is a, c, g, or t
cgcgggggtaagcgcgttcttgaaggtgtgtacccccggctggatcttgggctttcctctcactgctccctaatcgaatgtggtgatgttgggcaccaggagttgtcgtttttctttatgcttagtggggccgccccacgtggtcggttgtcgctcggccgcttctgccccccttgtgctattgcctaatgttgctcgtttctgttggtgccgttggctgtgtgtcagcacgcgtcccagcgggtatgtggtttcctgtggtggattgtggcctgataactgtggggagccccgccccttgtgggggacctatcgttcacttttatgtgttaacccctctccccttatggtgcgccccacagggtgatccctccacaggtgtttatggagtgatagtttccttgacagtttcacgggcgagtttgggggtttcccaccaagcctctcccgtctctttcttggggcgggaatcttttctccccaggggggcccctcgttgtgtgcaactctctaggaagatgtatggtatgtcttggagatgttcgtggggtttttgcccctcgccactacacaacggagtgtggttgtcccctccccggttgtttctgtcggtggagcacggtctcccccgcgtccatctgtagccccactatagggggaactcttgggttgtctatagaccacttgctagatgatcgggagaagacaacattgtccccacgcgcgcggatataggaacaaggctgaatttgtgcgaataggagcccacagacaatnattcttgtggagacaagcggagaatgcggttatgagacaccaagagcttgaagagaaatccacacacacggtgtcacgaaagtttacagaagggtttcacgcggagatttggttttcggataagtaaggcttcttccactcgcgtgccctcttcttctacacacggaatgtcttctcggagaaaactatcacgaaagaccacaaagtgttggaacacccctggatagcccacctctcttctgtgaaatagcctaccccctttgtggcacacaggtgccatacactgtgtttttcctcgtggagctgtagagacagttttagacctcttgtggatgagcgacttaaatgccctcctggacttctagtttcctgcctgcctcagcttctgcaagttagtttagtaggagatgaagtggaagtcccaggcttggattgcccaatcaccctgcttaaaattatttggaaccccttaataattaaactttggattttttta

SEQ ID NO: 712453 - DNA, 195 bp, Homo sapiens
  misc_feature (74)..(74): n is a, c, g, or t
ggactggtcagtgatctatgttctaagataggggttgggatggttgctgaaagtggctttgtttgggttaaggncaaggtgagtaaaagttgcattgggaagtatgaaggggcctgagaatggagtgatagaggagttgctagtataaattctggctaagatgcaggatttaaaactttgtctcttgtgttgaag

SEQ ID NO: 712454 - DNA, 692 bp, Homo sapiens
cgtctttaaaccctgcgtggcaatacctaacgcaccgccgtgatgcccaggaagacaggtcgatctggaagtccaactacttacctataaagatacataccaactcatatggatagattataccgaaatgtttcattagtagggagcagacaatgtgggctaccaagcagatagcagcagataccgcattgtacccttacgcggtgaaggctagtagtgtagctagatgggcaagaacaccatagatgcgcaaggccatccgatggcacctaggaaaacaacccagctctggagaaactagctagcctacataataccgggggaatagtggggctataagtagtatacaccaaggaggacctacactagagatcatgggacattgtatagctaggccaataaagtgtagccagctagctagcccgtagctaggtagccatatgccccatagttgaagtcactgtagccatgccccagaacactaggtactacgggccccgagaaagacctcctttatattcccaggctatataggagtaatcaccaacttaaaaattctccaggggggcaccatttgaaaatcctagagtgaatgtgcaggctggatccaagactggcagaccacagtgggagccaggcactccacgctgcctgaaccattgtccacatactccccttatacttgggctggc

SEQ ID NO: 712455 - DNA, 723 bp, Homo sapiens
cggcccccaggtgggatcggctccgcggcccccgggacttctggactccccggcctccctgtgtcccccagtgacctcccgtgaccccctgtgacacccagtgagtcctccctgaaggcgctactgaccttcagtgcccaatgtatctgccctgccaggtcccccagtggccccctggaatgccagggttcaaggtgacccactggctacaaaggcgatgcagggggaagtcggcaatggacggcgagaagggtgaccctggcccccctgggcccgcctggactcccgggcagctgtggggctagcatgggccccctggggattactgaggacttgccatgggccactctgggccccctggggacctgggggtcccattggggttcctgagggcctgctgggatcccagtgagctgcctgggcaaatgccgggtgacctgatggcgagaatgggcccaggaaggggttccgcgggcccaagggttgacctcggaagacctggtcccaagggaacccccgggagtggccgggcatgcggagagccgggcaatgcgggcaaggacgggcagaatggctgtgccagggactcgatggccagaatgggagaggctggtcgcaaggtgctccggagaagaagggcccaagggctgcgggctccctggaacaacggggacaaagcgagaagggcgacagtgcaaagtgcgaactggtgaatgcgcctaa

SEQ ID NO: 712456 - DNA, 178 bp, Homo sapiens
ctgcatctcaggtcgctcacaagacagctgtctcaagcttttcaagctgtgagagacacatcagagccctgtggccctgtcgctggagtgcatcctgagagtagctccctccttttccacctgagctcttcctcctacacatcacagtagcgaccacagctccgatgaccacaactgc

SEQ ID NO: 712457 - DNA, 776 bp, Homo sapiens
  misc_feature (22)..(22): n is a, c, g, or t
  misc_feature (27)..(28): n is a, c, g, or t
  misc_feature (58)..(58): n is a, c, g, or t
  misc_feature (90)..(90): n is a, c, g, or t
  misc_feature (202)..(202): n is a, c, g, or t
  misc_feature (231)..(231): n is a, c, g, or t
  misc_feature (238)..(238): n is a, c, g, or t
  misc_feature (259)..(259): n is a, c, g, or t
  misc_feature (273)..(273): n is a, c, g, or t
  misc_feature (310)..(311): n is a, c, g, or t
  misc_feature (317)..(317): n is a, c, g, or t
  misc_feature (322)..(324): n is a, c, g, or t
  misc_feature (336)..(336): n is a, c, g, or t
  misc_feature (339)..(339): n is a, c, g, or t
  misc_feature (343)..(343): n is a, c, g, or t
  misc_feature (364)..(364): n is a, c, g, or t
  misc_feature (385)..(385): n is a, c, g, or t
  misc_feature (428)..(428): n is a, c, g, or t
  misc_feature (529)..(529): n is a, c, g, or t
  misc_feature (555)..(555): n is a, c, g, or t
  misc_feature (562)..(562): n is a, c, g, or t
  misc_feature (566)..(566): n is a, c, g, or t
  misc_feature (626)..(626): n is a, c, g, or t
  misc_feature (643)..(643): n is a, c, g, or t
  misc_feature (661)..(661): n is a, c, g, or t
  misc_feature (677)..(677): n is a, c, g, or t
  misc_feature (731)..(731): n is a, c, g, or t
gaagctgggtcttcttgctgtnaggtnncgttccccaagtgttatcggagggtccttnaggcaggagtgaaaattgggtctgggggttantcctggggtggaggtctgggcacgccgggtcggaccccctccatcttcggttttgctacaccccgctttccagcgcggattcgcggcgggtagggcggcgtgcgcgtgcgtnacgtcatctcatgcgagcagcctcgcgangctccantggccattgacctcccgcggngtgggaggctgcgnggcgatgctgctagttcgtccggtgcgcagggtgcgnnggtctnttttnnncctacaggcaancanggcntaaattcccgtgtgtcggaanaggcagcgcgtgcgacgcganataccgcggagcagtgtgagcagaggcgaaggtctcccggtancccgctgctgtcgcaaagtcgacgctcccgggtaccacacctcatgcgacgtcccatgtgcagggccctgtggctcgagatccattgcgggggctttcgangcagcgatgcgcgctggggccctgtnccgaccntganacccccgattgatttttcgcccacccgcgccccagggcgtgggacaatacctgcacccanggattgctaatggtggncagaaagaaacgttcaangaggaaattaggctantgccaaagacccaaagaccgaggagccggaggggtgcggggggcgggggggccnggaaagccctttggccggcagaaaaaggcacctgggggcggggcc

SEQ ID NO: 712458 - DNA, 819 bp, Homo sapiens
agcggagtcgcggagggtgcgggtttggctgcggtggtttctgtggcggttgctgtggcaggagtttggaggttggagagaaatccaggtactcactagactggttaccttctgccaccatgggggggcttttccggagtgaagaagatgacactggcccagctttttctacagtcagaggctgcttattgtctgtgtcagtgaattaggagaacttggaaaggttcacgttctcgtgacttagtatccagatgtgaatgttgttccaagcggaaagtttggtgagatgaagttacgaagatgtgaaggaaactggatcgatagagcttcgactttgttgagaaagagataagaaaatgctaagcattccgattatggacagccggtgatagaaccctgcaggttcccttcgccccgggacatgcattgacttagaggccgaattttgagcaagattgataaagtgaactgcaaggaagatcgaacgacaagaccaggaaggctctgaagagaagacttcctggaactgagcgaatttagaatttatacttcgcagaactcagcaatcttggatgagatggcggatccgagacttgctggaagagtcctcgatccctcttggagccaacgtgagatgggaagaggctagctcctttaagacttggcttcgtggctggtgtcattaaccgggagcgcatcctacttttgagcgcatgctttggcgggtatgccggggaacatgtgttcctgcgacaggctgaaatcggagaaacccgtggaggatcctgtggaattgggactacggtgcccaagtctggg

SEQ ID NO: 712459 - DNA, 1423 bp, Homo sapiens
acaaaacaccaaatggcggatgacgccgtgtgcagcggggatggccctggtgtgtgccctggtggccctggtgatgggtgaacctgcggtgtgcttcctgctggagtgtttctggcatgtgtgcatcctgtgggcctgggtgtcgcgtgcctgtggactgtggtgcctgtgtggcccgatgtgcctgctgtgcagctctgctgtgagtgcacatgtgccgaggactagaggagtaggattgccctagtcgaccaatgctaatgtggccagcttgaggtccaagtgacgatgaacgatcaaggtcccgtggcaggactgatcatgatctacttactaccctagcccaatctacctggaactcatgtacgaatcactaggaatttctcgtatcgcttgagtgtgggccctacgtcttcagagcgcagttgaggcgcttttagacaatcgaatctagttgcccagcgtagccacgacatggcaggaaaccgcgatgaccagagcgcagacagccacccaggcggttacaacagagcccactctatagcgttatgccgtaccttcaggcggcgagcctactcaaacttgatgtctcaaccagttacgcgtacattgggagctagctctacaccgcctaggcattcacaagatgcggaagagcttgcgcccaatccatggccagttccctgatagagagtggccacttcactccccttgtgccccaaatgcatatctttcccaattcgagatccccccgagatagccgagcaagcgcaaaggcctaaccctagagcgcgaggagaccaacagagcacttctgggccacagtgcccacccacaaccaatccaagaataccactattgcgaaaccgggatagaccacgggcccagcaatagcagaggctcgattgctacgccttgaggtaaaacaggcccatccaagttatccacctttggcagagccgcaaagaggaatgacaaccaatgaggcagattccgattacctccagagctaagcccagaggcttccccccttacatacgaaaaaaggactcgactatccatttggactttggacgactatggtcaaactatccgggacatttaaacctaggctaaacaacacatttcagagcaccagcaatagtcgtttgccacactcatgatccgaacacccagtgcgaggctcagatactcttttagcggtccacagatggtaccaaaccctttttgttcactgtgcccaaatataccaaagagaaaccgatatcatgggttcacccaggaaagaccctacggagaccgatgtgagcaaaagctgggcaacgttgactcatattaccaaccaagaggaatcactacccctaaatcacgagaaagattatcagctgacccagacactaatgactttcatgaacaccgaaac

SEQ ID NO: 712460 - DNA, 632 bp, Homo sapiens
ctctagaggatctgtaatatgctgtctcagagaaactcgtaaaggggtctaggttaataaaatcttaaggactttccagaacaaagtacaccggctcagggtatcttttcggaactccagcgtctcttggaatagcagaagacactggcagaaaatggtggcattttccagaagcttaatctttcagggaactaccattaaaggtacagcagccctaaatcttaagtatcccttatgggaatcctttcttctggtataatctggggtttaaacattaaggtggggggtcactcatggtgtgtgggaaaaggacatgtggcctccttcttaaaacaacaacaccatagtccgggacttggaaccccattctaacaacagaagcggtccagccacttctatggcccaccccgtctggccagggttgcattctgtatggccaggggatgggctgaggtgggggtgtggagaagatgagcaacccaagcatcttaagtacctggagaaatcagggtcctacggcagacggagaataatctagctcgttttacaggcattggaaggaggatgatcctagtttctaagcaaagcagtaaaaaggggcaaagtgtctttttcccttgtaagcatctcct

SEQ ID NO: 712461 - DNA, 179 bp, Homo sapiens
acaggacacgtgtagtacgggtaggcgtataggtcaggtcttcggcggcatttgttgaacacattgaccaccgacagcgacaggcgcgagtggtcgtcgaagcggtgctgagcgaagcgttgtagcggtacgtcgccttgatgtacgggctgtcaccgctgtcccacgtgaatacctgg

SEQ ID NO: 712462 - DNA, 4251 bp, Homo sapiens
gggcgacacccgggccgtgccgccagcgtccgtcgggagagtgaaggctcgcaacgccttgcccgggggaaggtaacgcgccgcgcccggggctgcgcggtttgcaccgccaggccgagggctgggggccagaagacaagagagacggcgaggcgcgctccctgcccggcagcgactcggaggtaggtgatgctctgatgctgctgcctcttatgaattgacgacaggtgcagagagagaataaactgtgtctaagactggaccagagagtgagtgtgctggaagccaccataggaacaagcgacctgtttggcaaggaatacagcatccttctgagagcctcttctcgacactatcccacagaccaggacttcctcatgggaaagagcacttaggatcttgctatcagctgccctaaacttttgctgagccaaaataagactttgatgcagaactgaacaagatatttcatttttgtgtgttttaatcttcctggttgcagtcttagttgttcagccctgagaattttgagccacatttgttgctattatttttgcatgcacttttcaaaatgattgacttaagcttcctgactgaagaggaacaagaggccatcatgaaggttttgcagcgggatgctgcgaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaggatgcagcaccagcaagcccgagttccagtgtggtaaatccagcttccagtgtgattgatatgtcccaggaaaacacaaggaaaccaaatgtgtctccagagaagaggaagaatccgtttaatagctccaagttgccagaaggtcactcgtcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctgatgaactgtctcattgtgttgagcctgagccatctcaggtgccaggtggcagttctagagaccgtcagcaaggttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgaggtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagtctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgt

SEQ ID NO: 712463 - DNA, 683 bp, Homo sapiens
  misc_feature (111)..(111): n is a, c, g, or t
  misc_feature (129)..(129): n is a, c, g, or t
  misc_feature (180)..(180): n is a, c, g, or t
  misc_feature (186)..(186): n is a, c, g, or t
  misc_feature (209)..(210): n is a, c, g, or t
  misc_feature (230)..(230): n is a, c, g, or t
  misc_feature (242)..(242): n is a, c, g, or t
  misc_feature (257)..(258): n is a, c, g, or t
  misc_feature (269)..(269): n is a, c, g, or t
  misc_feature (277)..(277): n is a, c, g, or t
  misc_feature (332)..(332): n is a, c, g, or t
  misc_feature (335)..(335): n is a, c, g, or t
  misc_feature (360)..(360): n is a, c, g, or t
  misc_feature (371)..(371): n is a, c, g, or t
  misc_feature (373)..(375): n is a, c, g, or t
  misc_feature (444)..(444): n is a, c, g, or t
  misc_feature (449)..(449): n is a, c, g, or t
  misc_feature (452)..(452): n is a, c, g, or t
gggccccaggctcgggagacatggcgggcgtaaagctctcgtggcattatccttcagtggggctatggactgacttttcttatgctgggatgtgccttagaggattatggngtttacctggcccttatncgtcctgattttccacgccactctcccccatcccccatttcattgccaaangagtcncctatgactcagatgcaaccagnnagtgcctgtcgggaactggnatatttcttcanttactggaattgtgnnttcttgccttntggatttnctgttattcttgctcgtgtggctgtgatcaaatggggagcctgcggccttgtgtnggnaggcaatgcagtcattttccttacnattcaagggtntnnnccttatatttggaagaggagatgattttagctgggagcagtggtagcactttattctgattacagtgcnttganttncttagaactcatactatctgtatcatgtgcacatgcggcattgttactatgaaattgaatatgctgggtcgttgaatacctttatcatactcatgtcgcactttcagaaagacttgcataagtaggagatgagttccattctcagcaagatagacctgtgcaaatttagatgatgttcactcaagttatgtaactggtcctggctgtagcatgtagtcacggtgctctcag

SEQ ID NO: 712464 - DNA, 214 bp, Homo sapiens
tggaactggggacctcataaaatactataagcttattattcttgatttaaaaacgtttatgctcacatctttatatatgtacggttatttctggagacctcattttattgtcatctataatagtggatttatatatttttacctctttttaaaccaatttatgcggtgttaagatctcgactacacagtccttcttagcttttaaatttcagat

SEQ ID NO: 712465 - DNA, 241 bp, Homo sapiens
gcacgagatttaaatgccatgaccaggaggattttagactgatgaaaagccaggcccaaccattcccaatgggaaccttgccaacattaaggttccttaaaaagcaggtgaccttcttccttccaaggcatatcttgtccaacctttatcatttcaacctacacacctggtatttgaggttcttaattcggatccactggaactagttagatgggccagactagcgttgctgatgcttgac

SEQ ID NO: 712466 - DNA, 200 bp, Homo sapiens
tatttttgtgaaagaaagtgggcctgtcaaaggcctcctctaaaaaaaaaattagggttaaagtcttaaaatttgttttctaaaggtgaaacggggggttatttttgggaacagcccgatgtttgggcccttttttccccaaaaaaaacaagtcctttttaaacccggaatttggagaaaaaaaaaaccctggtttttta

SEQ ID NO: 712467 - DNA, 105 bp, Homo sapiens
ggccacagcagaatctgtacaccaggagccctgactaggcacgcagcctctctgccaccgggaccttggcatggcagtggtggtgaccaaccacataactcgaga

SEQ ID NO: 712468 - DNA, 937 bp, Homo sapiens
  misc_feature (527)..(527): n is a, c, g, or t
  misc_feature (531)..(531): n is a, c, g, or t
  misc_feature (919)..(919): n is a, c, g, or t
  misc_feature (932)..(932): n is a, c, g, or t
cagcctgggcaacaaagtgagacccccgtctctacaaaaaatacaaaaattagccatgcatggtggcacacacctgtagtcccagctgcttgggaggctgaggcaggaggattgcttgagcccaagaatttgaggttgcagtgaactatgattacaccactgcagtctaccctgggcagcagagtgagaccctatctattttaaaaaaaaacaaacattattaacatacttaaaacctgacatccttcatgttagctaacctttataatctctttggatgtagtaaatttttagtattttttagattgaatttgtatcatatttgctagcaaattgagtataaagagtagcatatttttactacagatgtattattttaactaacaaaggcatattatacatttttttcatatataaactttggaataggattttacattaacttaagttttttatttctacccatgtgtcaaagttttatgctaaattctgaatagaatagttgtaactcccactctgggtatttnattnattttaaacagttctagtattgtttcctgtgaattttttccagggattgctactttctgcactattcattagaccaagagcatttcaccaaatacttaaaacttaaaaatttttaaacttttccaaatttgattaaaaggataacatattctaaaggtattcaatatttttacttatctttgaaaaacttaatcacataaaagcatacattttacacatacagctctctccatcttccacaatagattaagacataaaacataaccagtatttttgaaaagcccccttaactggcatgcttcttactgaaattatcataaaaggttcgtatgagaaaggattccagaatatcccttaattgtgttgtagcttatgcatttctatttantttatacattatntaatt

SEQ ID NO: 712469 - DNA, 124 bp, Homo sapiens
aggctgctcagctgggcgcggtagctcacgcctgtaatcccagcactttggaaaatggtttgacaagtatccactaaagctaaacatatgtcttccctatgctctgggccattcaacgcctgcg

SEQ ID NO: 712470 - DNA, 401 bp, Homo sapiens
cctctcccatgcacgtaaacactcctaacaagactgttggttagctggacatgctttggcaatttttttatactaacaagtgaacataaaggcatggcatttgttgtgactggcaaccaatgtttgattttttttttaaaactatcccattaaaattaagggctgggaatgttctggttcccaattaatttaaataatcaacttctcccaaaatttctaaacctgttggcacctcagggcagaggatggttctggaccctccccctcttgggtcctaataaaaaactctcaacagatcttggggcccagtcattgggttttatcaggtggcttaatggggaactaaggttttttacttccacagaataaaagccactaccttctgacctccccacccccgc

SEQ ID NO: 712471 - DNA, 804 bp, Homo sapiens
  misc_feature (804)..(804): n is a, c, g, or t
tccccttcccagccattctattgtaaggaatgtccattagaactacttcccaaacctctgtatgtcaacaataagtcacatagatcctgtacatacttacaaacaggattattaaaatctccagtatgtcacaacatacttataccacagtctccaaacaccatgtgggagaaaccagggccatacttattgcccagggtgctaagttggatacgccagagacagggaagttaagatacattgatgagtctggccccatgtgtatatgctcatgactctcatgtgttgtgtgagaaattctacattaacaggtcctttggtttaggcgcctaactgtgatctccatagaacataaatctcgtggaaaaaacacctgtggttgtgtatcatctgtggtggaatgccatgtggccgtgtgtattttctaccaagaacatttttggcgcgcagccccggtcaaatttaccccgcaaagaaaaagccccacaaaaaccaaattgtctccgaatacaccaatgtaaactctcccttcgtacgatatttaacgtccttaatatataccacaagaataataaatatcctcctactagtggttctctgtcgcaagtataatcttcggcgtgtgtcttcctttgtggaccatcttttccccacaatatttgctcttcttcgaagagcagaagtcttaaacactccctcctagaagaggggggaatctttttacacctatttttctcctcctcttattcacctttgggggaatattttcccacaggggggtacacagcggggtatactcaatan

SEQ ID NO: 712472 - DNA, 162 bp, Homo sapiens
  misc_feature (5)..(5): n is a, c, g, or t
  misc_feature (129)..(129): n is a, c, g, or t
ctgtngcggggggattgaatgagctctcaggagggaggatgcgtgcaggcaggggtgaggagcgcagcgggcggtgagcgggaggcactggcctccagagcccgttggccaaggctgggcctcgcgggncggcgaacggagccgtggaatcggtgcctcagc

SEQ ID NO: 712473 - DNA, 436 bp, Homo sapiens
aactttcatctatcccagagaaaccccactttaaaaacagctaaagggactttagcagcccagagttttaatttttttaaggagaaatcagtttacctgtttttaaaaaatttaaatctagttaactttgcttcacctgcgttaacggggacagctcaggctcttggtgactttgccagcggaatttccggcccttcaacacccggggcccagaccctcggggccatgccttgtggggccctgtgtcggccttggggcctgccaggtggccgccccgaccacgacttggcttccttgtgccttaaaaaacttgccttcctgcagccacacaccacccggggtgtcctggggacccaaggggtgggggggtcacaccagagagaggcaggggcctggccggctcctgcaggatcatgcagctggggcgcggcggacc

SEQ ID NO: 712474 - DNA, 387 bp, Homo sapiens
  misc_feature (91)..(91): n is a, c, g, or t
  misc_feature (94)..(94): n is a, c, g, or t
gtgtccctttccgcttccgccgccttcgaagttcccggcttcgagctcgtgtacacttcgcccgtggaagcgaaactcgacgcgcccgacntgngcaatcccaccgacgtttgggtggaaatgatcgacggcgcgaagaagacgctcgatttcggcgaaatgtacgccgtgggcaaagcgggcgaaccgctcgaccgcgtgatcgaagccttgagcaaagcgggggaccgcggcgtgaagacgcgcttcatgctcgagaagaaaatgctccgtgcctccgacgacgccaccatcgagcgcctgaaaaaaatcaaaggcctcgagctgcgtatctacgaattcgccaagctgggcaccaacggcatcgtgcacgccaagtacttcgtg

SEQ ID NO: 712475 - DNA, 176 bp, Homo sapiens
  misc_feature (36)..(36): n is a, c, g, or t
ggccaagaccagagcagcttcctgagacacaacagngttttctccagccactggttcatgactgacatcgccattgggagtgccatcggggattataactaagccatgtttctcaataagctcatctctttgccgcaggccttctttaagttcttccatcttatgctgcaacaggt

SEQ ID NO: 712476 - DNA, 406 bp, Homo sapiens
  misc_feature (400)..(400): n is a, c, g, or t
tgagacagagtctcgctctgttgcccaggctggagtgcagtggcgtgatcttggctcactacaacctccatctctcaggttcaagcgattctcctgcctcagcctccggagtagctaggaataaaggttcccaccatcacacccggctaatttttgtatttttagtagagatggggttccaccatattggccaggctggtcttgaactcctgacctcaggcgatccacccatcttggcctcccaaagtgctaggattacaggtgggagccactgcatctggctaatttttatcataactttatattctgctgcaagctgcttttgaattattcaagttgaagagggaaggtaaaaaaaataattttccagttcttgacctggaggttgaaaaaaaagganaaagga

SEQ ID NO: 712477 - DNA, 211 bp, Homo sapiens
  misc_feature (6)..(6): n is a, c, g, or t
ctgtantcacttctttactgggttgatccttgagagcagcttaatctgggttaatcattactggtttccaaatttggtttttaagttagcagatgattggaagattaaaccccttctaggctctaatctcatctggaagttagaatggttcttgcctgaactgcaaactatccagagcatgcagtcaaaacaagaatgcgggatctctaga

SEQ ID NO: 712478 - DNA, 133 bp, Homo sapiens
cttttggatacctgtgacttgaggatgcttctttctcatgcaggacctcagcccattgatttgcatttatttggttgccttgttttgttttgtttttgagacagtctcgctctgttggccaggctgaagcgca

SEQ ID NO: 712479 - DNA, 807 bp, Homo sapiens
aactgagggctccgcctcattgggcgcgcgctgggaacaggaagcgcaggagcctcgtccgggcgtgcggcccgcgtcggcgggaggcaagcgcgcgtgagaggatggccggcgtttcacaaagggcaagagcgcacgagacctgcgctgaacgggaacagagacagcacaaccaatcgagcaaatgaagcggcgaccagcagagacaccagaaggcaccacgtacctagacacgttccacttccctgggacatgaaggtcctgcagacccaatcccacgaaaacctacacatacaaacatcgatcactgaacactgtgacgtgggacatccgcaaagacgcatggtaaccgaccaaacacacgaagctagatcatgggcagagcaacacaaaccaaatggaacacccatgggcaaatgggccaagaccaggcgatgcaacgaacagagaggcattcaacatggcccacgaggacaacaccaagccacaaacagacacgaactacacacgaataccaatagggagtcacctaccatggaatgacgccaagaggtaacacacaccagcgcggcctgagcactacagggagacgggaatacccaatcacactgggcaccagacggcactagtcacaaacactatccacaaggcaacgtactggtaggactgccaagacaaagcaagaggaaagtactaggacggcaaggtccagggaaccacatagcaatgggcagaacacggaagaatggtacatcaaagacgggaaacaaaaaataaaaatagcagaaaaggcacttacatggaaac

SEQ ID NO: 712480 - DNA, 138 bp, Homo sapiens
gctcctgttcaggacgtcttaggcaagagccgagctcgtgctcagcggcgacgacgtcgatgcggcgagcaggacctgcagaccgcgctcctccagctgcgccgctggacccgcaccgactccagggccgtgtctgat

SEQ ID NO: 712481 - DNA, 183 bp, Homo sapiens
  misc_feature (21)..(21): n is a, c, g, or t
  misc_feature (42)..(42): n is a, c, g, or t
  misc_feature (66)..(66): n is a, c, g, or t
acctagccacccaccaacagnaataatggctgaaaaagcggngtctatattttcacaccttctggntcctattcttctcgtgattggctggattgtgggctgcatcataatgatttatgttggcttctcttagaaaggcaagaagatatcagattgacatcatttagaagaattaagaaaact

SEQ ID NO: 712482 - DNA, 879 bp, Homo sapiens
  misc_feature (16)..(16): n is a, c, g, or t
  misc_feature (73)..(73): n is a, c, g, or t
  misc_feature (75)..(75): n is a, c, g, or t
  misc_feature (87)..(87): n is a, c, g, or t
  misc_feature (121)..(121): n is a, c, g, or t
  misc_feature (228)..(231): n is a, c, g, or t
  misc_feature (233)..(233): n is a, c, g, or t
  misc_feature (236)..(236): n is a, c, g, or t
  misc_feature (281)..(281): n is a, c, g, or t
  misc_feature (285)..(285): n is a, c, g, or t
  misc_feature (287)..(287): n is a, c, g, or t
  misc_feature (325)..(325): n is a, c, g, or t
  misc_feature (332)..(332): n is a, c, g, or t
  misc_feature (365)..(365): n is a, c, g, or t
  misc_feature (370)..(370): n is a, c, g, or t
  misc_feature (387)..(387): n is a, c, g, or t
  misc_feature (437)..(437): n is a, c, g, or t
  misc_feature (542)..(542): n is a, c, g, or t
  misc_feature (573)..(573): n is a, c, g, or t
  misc_feature (577)..(577): n is a, c, g, or t
  misc_feature (607)..(607): n is a, c, g, or t
  misc_feature (642)..(642): n is a, c, g, or t
  misc_feature (686)..(686): n is a, c, g, or t
  misc_feature (691)..(691): n is a, c, g, or t
  misc_feature (750)..(750): n is a, c, g, or t
  misc_feature (765)..(765): n is a, c, g, or t
  misc_feature (804)..(804): n is a, c, g, or t
  misc_feature (865)..(865): n is a, c, g, or t
actatactaatgaaanaaattatatgtagaccaccttcaatatttttccatcatctttatataactgtaacantnctttcaaaaganattttgtgaaggacattaatttcacatttaaaangtgtttcaaaaataagggaacattaaagaacatcaaattagtctgaaatatatctcacaatgctgagaggcatactcttctttatcaaattaagtgtatgtgtagtnnnntnaanatggcttttaactaatgacatttcttgtccatttcagtaatttcntggntngaaaacaaaatctgtgtatttatttctttgaaaacatnatttgtngagggtggttttactgccatggaatgatttggnttctnaatggagtggattttanggggaggttggattttgtgtgggagtttttggaagaagttttttttaaanattttatttggtgagggtgatagaaagagtatagggtgttttaaaggaaagaggttttgatgtgtgagtttatggtggtggtttggatggtggagtgggtaaganatagaaatgagagggcgaagaaaatgatgancatnatgtgggtgaatgtgagagattagagaagnaggtgctcttgagcggattgaacgaggtcgaaganaaagaggtgcaagtatgtattctcctgatgtcttcaggtaattnaaaantgatttatacgccttaattctatgtacaatattaaggactttacaggtaaatatcaggnagaaaaaaccatganatgcaagaagggatgccagtaaaatcaaatgaggaagantcatatctactgatgctccatgtgtaagaattattacatatgtgaagctcttgtgaggtancaaagaaacagcat

SEQ ID NO: 712483 - DNA, 101 bp, Homo sapiens
cctagtgtaatgacaaggatttatcctcttcatctttctccgatcccagttagcaggaatactttagcctgggaggagatctttccagagaacagcgtgag

SEQ ID NO: 712484 - DNA, 328 bp, Homo sapiens
  misc_feature (9)..(9): n is a, c, g, or t
  misc_feature (88)..(88): n is a, c, g, or t
  misc_feature (98)..(98): n is a, c, g, or t
  misc_feature (132)..(132): n is a, c, g, or t
  misc_feature (136)..(136): n is a, c, g, or t
  misc_feature (141)..(141): n is a, c, g, or t
  misc_feature (151)..(151): n is a, c, g, or t
  misc_feature (186)..(186): n is a, c, g, or t
  misc_feature (231)..(232): n is a, c, g, or t
  misc_feature (235)..(235): n is a, c, g, or t
  misc_feature (237)..(237): n is a, c, g, or t
  misc_feature (239)..(239): n is a, c, g, or t
  misc_feature (250)..(250): n is a, c, g, or t
  misc_feature (257)..(257): n is a, c, g, or t
  misc_feature (266)..(266): n is a, c, g, or t
  misc_feature (271)..(271): n is a, c, g, or t
  misc_feature (281)..(281): n is a, c, g, or t
  misc_feature (288)..(290): n is a, c, g, or t
  misc_feature (315)..(315): n is a, c, g, or t
  misc_feature (318)..(318): n is a, c, g, or t
aaaattctnttaaaatttttcgcaatttttttccattaaaaagtactgattttaaaaactaataacttaaaactgccacacgcaaaanacacaaccanagtcgtccacaaaacactctcctttccttctganggcnttacnatgcattgtnatcattaaccagtcttttactactaaacttaaatngccaattgaaacaaacagttctgaaaacgttcttaaaacaatgannaanantngggtggaaggnattaggnataatattnatttnggattctganctttttnnntagatttggtgattttgttagtttnagntgcttttttg

SEQ ID NO: 712485 - DNA, 705 bp, Homo sapiens
acaatatttctgccaggttgttaggaggccacatgatacttattcagaaaaacgtcctagagattcttagctcttgggatgcaggcgtcaggccgctggagcgatgagcttctgtgtgtacctgagaacttggggtgatgttttagttttcacagtatgggctaaacaggagttgtacaagcatagagtaaatatgtgtcatcaagtactgaagcctctggctagaggacatgattcacatgtgaactatatatgtgaacatatatgaaagggttctggtgacttgacaatcaagagtgttcgggacatggtgccctctggaggcaagtctccgcattattagattgttttaaaggacacctactagtgtggcattcctttcgtttaaactataggtaattaaggcagctgacaagagtaagattgccttctagacactgaaggcgaatcgtccttggtccagttgtacctggaacaccagaatgatttgtactatacaggagaggtgggaggtgtgaaagagcatcatcatagaggatgagtgtaatttacggaaatggtcaaggtgtcacagaaaagaagtgttggatacttgatttctgtctcatagttgtaaaagaccagaattaggtcagttcatagttttctggaatgggtttggatcaaggaatagggggacaatttaaaaatatctagtggggatgc

SEQ ID NO: 712486 - DNA, 862 bp, Homo sapiens
tccgtgtgacgtgtggtctttgagagtcaactctcctgtaccagcgtaggccgcagtgagtggggggcgggctcccggcgggtccgtgctcggtgggagtggtgagtgaccggacccgcccggccacttccggtcctcgaagacctctgtaacgacgtacctcgggcaatcgcactcacatagtccgctaagccattggcttaggctcgcgcgctgtgacggttggcgctacatcatggccttccatggttctttttggtattgtcgtggaatgcctggggacgcgttggctaggcctgatgtgcctcctctcggcgtccttattctggttagctaaagccccagtacggttacttggcttgcacctgagtaggccactacttgcgtagatgcgcgcttcacgaagcgcctagacacacttcagccgcaggacacgtcgtggatctccggtcgtctggcctctacgttctctcgggtggtcgtggtcgtctgactagacattagtgtactggaccccgaacgtaggagaaggttcgccgaggagcagtcgccggggcctcgtggctggcagcaaagcgccatagcgaaggctgcagtccatagcctcatctccgtcaaggattacatcccagcgtaatagaagtcggacacaggggacagatcgggacggcaagaatcggttgaggctgcctcgcattgcatgaatttgggaccttaaaagctgcctttcggtctcatgcctaatgactcgattacggggcgcgcgtgtgtcatccctttacgagggtgggcctgaggtattgcggttgccggcgggaacgaggggaacttgccggtgcttgcgcgcggttgccccggtaca

SEQ ID NO: 712487 - DNA, 528 bp, Homo sapiens
  misc_feature (27)..(27): n is a, c, g, or t
  misc_feature (44)..(44): n is a, c, g, or t
  misc_feature (59)..(59): n is a, c, g, or t
  misc_feature (70)..(70): n is a, c, g, or t
  misc_feature (255)..(255): n is a, c, g, or t
gggaaattattaaacctgtatttaatnaagctgcctatgaaaanaatcaaaatctgaanaattccttaanaagtctagaatgatatcaaccccacttactgtcccctttcctagcaggcaagaacttaataactatcctcagggaactgattccctcccatcctgaaacacccttaacaaccgggaaaatagccaagacccagacaagtctgctgtggggacaattagataaaaggaggctgcacagtggctcanacctgtaaacccagtgctctgggaggccaaggtggaaggactgcttgagccccaggagtttgagaccagcctgggtaacacagcaagaccccatctctacaaaacatttttaaaaattagttgggcatggtggtatgtgcctatagtcctggctactcaagaatctgaggcaggaggatcactggagcccaggagtttgaagttgcagtgaactataatcatgccactgtactttagcctggacgacaaagggagactctgtctctttttaga

SEQ ID NO: 712488 - DNA, 205 bp, Homo sapiens
acacagggtctgctcctgtgccaggctgaagtgtaagtggcatgatctggctcactgcatcctcaacctcctgggttcaagcaatgctctgcctcaacctcttgagtaactgggactacatgcgtgtgccactatgcctagctaatttttaaattttttgcagagacaaggtctcaatacattgtccaggctggtcttcaactcc

SEQ ID NO: 712489 - DNA, 504 bp, Homo sapiens
ctggactctacctgcttggttcagtgtcctgaagagttatttaaatgaaccactacttagtaattagttcttttttaaagtatctacttctaaaattacctagttgaaaatatgaaggatatgcttagttttagaaatatcatgaagcaaggatctagtcagtgttacagggtaaaggtggagttttttaaagtctgtatttaaatggtgcactgatggattcattttttaattttgcattccacaaaatgttgctcaggtaatcagtattttattcaatgtagtgtgcatattgagatgttatatcatagaaaaatcataatgctttaattagtatgtatccaatatctatggttattgggtatcatgtcctttataccaatgttcctgtaaaccattgttagcatgcgtatctgtaaacccactttttacaattttataccccttattattatatcttttgaaaaatctccttcatctaatataatattagtccttcgttct

SEQ ID NO: 712490 - DNA, 1195 bp, Homo sapiens
gagcataacaagagcggggacgggatgaggctggcggttgatcccagtgtggcgagtggcggcgacctgaggcggtgagctggtggccctggctgcctgaccctgatgtgcatgcctgaccctgccctctgctgctgctgctgcccttccgcctgtagcctgtgtgtcctcacttctgcactggcgtgctgaccacgagcgcatttgtagaccgtgtgcgatgcgcagaagctggtggatgtgcctggtcgcctggcagctgctcttcgccaacttcaaccaggacaacactgtccctagctgttggtagtaagtccgggttataaagtttttctccctttcttactgtggataagctggaacagatctatgaagtgcaccgattacggaagatgtgttgcattgtagagagattgttctccagacagcctagtggccatcgtagaagccttaaagcaccaaggaagctaaagggtatgccactttaagacgggaactgagaattcttgcaactacagctactccaacacgattcctggcctgtgaagctcaacaggcagaggcttgatagtatgccttggaggaggtcccttgtacattcaacaacaattcggggacattgacgggatgctggcattacaatcaagggaagacggcctcaaaaacccttgcagggcattgtgtagaacaatgtaaagtcaacaaacgaaaacttggtatactatgggcgttaaccccagaggaagcgtccgagaccaatcagggaggagattgcgggatataccgaataaccacaataaaattgaaagagactgtcaaacatctaatatcagggatctaagtaaatgtgcctttaaggggcgcacatgtgcaattttggacgaccaagtatggaaatttaagattattgccacaggggtatcgggagaaaagagggaacagagagataagagggagaattaacccaaattccaagaagtgtgtgcgaacacaagccttatgggggatactgaagaaaaaagagaaaaaaaaacaggcaggtataacaatttgaagccgagtagtctaataagcaatgtaggaaatagttacaaactgtcgacaagaagaacaaattgagaacagtggcagaattaataaacgcagagagactggtaaaagaaaaccagcagatagatgcaagccagtgttagtt

SEQ ID NO: 712491 - DNA, 294 bp, Homo sapiens
gaaatggccagcaggaaggcggggaccggggcaaggtggcagcaccaagcaggcccacgtggttctttcaacgtcttttcatgtttgaacaagctcagatacaggagttcaaagaagcttcagtgtatcgaccagatcgtgtggcatcatctgcaggcagacctgaggcagactactccagctgggaaggtgagtgtccagagaggagctggacgcatgctgcagagggcaaggcccatcactcacgtcttctacgctctttgggagagctaatgcaaactgagacgatcttag

SEQ ID NO: 712492 - DNA, 330 bp, Homo sapiens
  misc_feature (42)..(42): n is a, c, g, or t
  misc_feature (275)..(275): n is a, c, g, or t
aaaggtccggtaaatttttttaataccgtcacccttcagganttggtggaattgaattcctctctcctctacttgagtgtgggctgggtttagtgactacttcgaatgtgtagaatatgacggaagtgttgatgcgtgacctctgaaactaggggataaaaggcattgctgcttcctccttgttctctactaaatcactcactccgggggaagccagccaccgtgtcgtgagggacatttaaggcagccctaggaggaggagggtccgcaaggtngaggaaacttgagggccgccttgcttgacagccatgttgagggggagccaccttg

SEQ ID NO: 712493 - DNA, 1186 bp, Homo sapiens
tattcatatatacaaaaagagagaggagggagagagggggaggggggcggagagagagagagagagagagaaaaaaaaagggggggggggggggcgcgcgcttcttcttgtgtgggggggggaacaaagaaagaaggaaggggggaaagacagagagagggggggggggggaggggagaagagcggagggggggggggaggaggcgcgggggcgggagagggaggcggcggcgcgaggagagggaaaaaaggtgggtgtgtgtgtgagagagaggaagaagaggagggagagaggagagagggacggcgagaggagggagaagagcacggcgcgcgaggggagggcgcggggaggcggaggagagagagagagggagagaggaggagagagaaggagagagggagagcacacacacacagaagagagagagagagagagagagggagtgaggaggagagggtgagcgcgacaaacagagaggcggaggcaacagaacacagaagaggtgcgcagggagaacacaagaaaaaggaagagaggagagagagagagagacaacacgagcgcgcgcgagcgaggagcgcggtgcgccgacagagagagagagagagagaagagggagagagaaaaagaaaacgaaagagagagagaagagagaagcacaccacacaagaacaacacacacccacagcagaaagcagagaaagagaacgtcaaacaagaacgaggagagggcagaacgacgacacaaaacaaacaaacagagcgacagagaggggaagagagacgaaaaaaaaaacaccagaaagcaacaagcgaacacgaaccgacaaggaaaagaagaagaacacaacacgcaaacgaagaaaggagaagagaaagcaaacagaaagcacgcggaagaggaggaaacaaagaagaacagaacgcaagaagacagcaaaaaaaagcatacagaagtaaagacacatgagccgaagccaagggccagagcacgcaacgcgaagtagaagaggcgagtaaagagagagcacggagtgacggaacaccgacgacaacacgacacgcgacgacgagggaagagcacgccgcaaaccacaccctaagcaacagatagaaacgaaacgcgacgacgaagaggagagagagaaagaagaccacaacaaaacaagaacggagcagggg

SEQ ID NO: 712494 - DNA, 419 bp, Homo sapiens
ccccaaaataaaaacccccccccggggggggggtggttttttaaacccagtgggaacccggtttggttttcccccccccctcttgggggggccccccggggggggggggaaaaaccccccttttttttttttttgccatctctcaaaagaaggggggcccctcaccacgtggggccattgttgagccctgggctttcgtgtgtgaccatcccggcgtgttacatatctgtattttttcccatggactgggggcttcttacgccgcgcactcagccagtgggcccgggccgcgggcagcccgcgcgcaagagcagagcagggataaaaagaaaaataaattataaaattatttttaataaccaaagcgattctttatgactataaaatatggaaaataaaatattaacaaaaacccttgt

SEQ ID NO: 712495 - DNA, 263 bp, Homo sapiens
  misc_feature (192)..(192): n is a, c, g, or t
gcacggatccccgcgtatgacataccactgcactccagacctggtgtggcacgaactgagaccaagaaaagacttttttccccccttaccatcaagaaatattattttcctcaaagatacctttatgttttaatagatagaagattacaaatagctaacaagagcgtttcaatgaggtcagacctgtctttnctagtttggggtgtgctattcactagcggtaccatgagcctcgaattctgtcacatccatggctcttagcg

SEQ ID NO: 712496 - DNA, 406 bp, Homo sapiens
ttgtgactcgagcaatctttcaacccgagcctcccaaagtgctgggataacaggtatccagcacaatgcccccgatatggactctttactgcatccttcccatcagtattaattcctcagcaatttagtacattcctccaccatttcaaaatgctcccagaactcacactagttggtacttcactacaaccttcaacctcaccatttaattttgatgtatgtctttggatttaccaacagtactttctttcatgactactttgatttagttcagaatgctcactgtacactgaatgttaattactcagctaattcacactgatttcctgtttacaaatatgatctcctccaggccattcatgtgaagtcagggtacagctgatgccagctacagaatcactatgta

SEQ ID NO: 712497 - DNA, 463 bp, Homo sapiens
gtctccaaaaaccaagctctccgagtgagcaattcctgtccctcttaagggcttacaactctaagggggtccgcgtgagagggtcttgatggattgaggaagcagagggtacgtgactgggggctgcatgcacaggtaattagatcagaacaaaacaggacagggattttcacagtgcttttctatacgtaatgtctgtaatctatagataacataaccgagtaggtcaggggtcgatctttaactaccaggcccagggtgtggcgcggggctgtctgcctgtggatttcatttctgccttttagattttacttcttctttctttggaggcagaaattgggcataagacaatatgaggggagatctcccttcaagctatctgtgtctgtgtctttgtgtgtccgtgtgtgtgtgcccgggtgtggtgtgtgtgtgtgtctgcgcgcatgcacccgtgtgtatc

SEQ ID NO: 712498 - DNA, 212 bp, Homo sapiens
tctgagcacttccagatggccgaacatgtggaggctggcaggaacaggaacgagaactcacccatgtgcggatgcaggtggcgcaccccaactccatggggagggaagctcctgccctgagacccttccagacctcgccctacgtatctcttcatcagcctggttatttgtatcctgttaaatatcctttgtaataaattagtaatctgaaa

SEQ ID NO: 712499 - DNA, 212 bp, Homo sapiens
atccgagaatacccgcagaacttttacacagcagcaccctcgctgtcagtgtgtgctgctccaagcaccctgagccacccgcagcagatagcactcctggaccagagtaaaacattggcagagtctgccctgcagtagctatacactgccaaggaggctggtggtaacccaaagcaagcagctcacacccaaggaagccctggaaggaggct

SEQ ID NO: 712500 - DNA, 188 bp, Homo sapiens
aggctccacgcttaacgatatttggaggtcagcactggtgctcactgtgtcgagcggaacttgtacatgggaggcatgcacctgagatgtgggtgaatacactgtctgaccatggctccagtgttaactgatattttggaggtcagcgactggtgctcactgtgtctgacggatacttgtcctaggga

SEQ ID NO: 712501 - DNA, 530 bp, Homo sapiens
  misc_feature (8)..(8): n is a, c, g, or t
  misc_feature (19)..(19): n is a, c, g, or t
  misc_feature (113)..(113): n is a, c, g, or t
  misc_feature (174)..(174): n is a, c, g, or t
  misc_feature (295)..(295): n is a, c, g, or t
cctccgtncgctcagtccntgaacgtctaacaaactgactgttccccgctccccgtggtggtacatcggtgcctgttgtctacacgctgtaaggtcactggaaatgtgaacancactattgtcgtgccgcggaggatgggagaggcctggcaagcacaatggaccccgaggctntctcccgacaagtaaagtgacatgatgatgatgactgccaatgtgacttagatagcgttatgaaatggattacgcctttcctagccgagcgtacagagtaagtatcacattcacggatgantagattgccaggtgttcatggatatggaaactgcagcatctcctgtcccccagccatgtcattctagctgtgaactggcacgaatgtcagcagcttttcattcagctgaatgctctttgagagattagggcagagaatggagtgttttaatgagttggaaattcatgctttgatgagatataagacctatgtgcatcttttctaatacctcctgcacccttctcctgaactctgc

SEQ ID NO: 712502 - DNA, 275 bp, Homo sapiens
cgtcagcaacatacccccatcccgtgcctatgtccgcatggacagaagcacagaagaggccacttcatcagcttgcctgagaagccaggtgacagtgaggacacagcatcagcagcctcacttctagaggagcaacagtacagcccagcttccccaggctcctccgcaaacttctgactcagttaaacaagaacctgtccttgcccagcctgcagtcagcaactctggcactgcagcatctagtactactgaggtgtaagcggggatcctctaaa

SEQ ID NO: 712503 - DNA, 361 bp, Homo sapiens
  misc_feature (100)..(100): n is a, c, g, or t
gccctgccctgtccgccgtccgccctccggtagggttcgggccttccggatgcggcttgggcgctcttcggggacctccgtggcgcggaagacccgagcntgccggggggaggccgcggcgccgcacctgcccgcctcggcgttcgtgactcagccgccccatcccgagtcgctaagggctgcggggaggccgcagcaccttctggaagacttggccttccgctctgacgcagggccgaggtgggcagtccaggccgagagcggcggccctgaaggtgagtgaggccctcggcagctgcagccggggtgtctggtacccccccggcgtggtgcttagcccaggactttcagacgcggccgc

SEQ ID NO: 712504 - DNA, 312 bp, Homo sapiens
aggatccccaaccaatatggcctcgaacaaatggacaggtaacggcaggttgatgcttgcctagccacagctggtactgtgaacaatggctcgaatacgatttacccttaaccatcacatgtccatatattcatagatgattacttatattaagtatatgttgacacctgcaagacgatattaagttcaagcacatgccaactgctaactgttcaggtattaggtagcaaggccagccaaaagttcttctggcaatccgagactacagaaatgaaccaaacgtcgaggccaaatgtatggtgggtaaccgag

SEQ ID NO: 712505 - DNA, 353 bp, Homo sapiens
  misc_feature (100)..(100): n is a, c, g, or t
gccctgccctgtccgccgtccgccctccggtagggttcgggccttccggatgcggcttgggcgctcttcggggacctccgtggcgcggaagacccgagcntgccggggggaggccgcggcgccgcacctgcccgcctcggcgttcgtgactcagccgccccatcccgagtcgctaagggctgcggggaggccgcagcaccttctggaagacttggccttccgctctgacgcagggccgaggtgggcagtccaggccgagagcggcggccctgaaggtctgcgctggggccgggacgaagcacttggtaacaggcacatcttcctcccgagtgactgcctcctaggaggacatt

SEQ ID NO: 712506 - DNA, 227 bp, Homo sapiens
tgataatacgtcaatgaaaagcgaatgccaatgacaatcgcacattatcctttaaaggctgtcgaacaagagactgattgcagtctagttaaatcagacagtgctaaatggtatcaggataaagaactgaaggacagaaagaactaattttcacttcatgtaacacacccagatctacagtggcttgtatgcagaagaacgcagccgcagccaaagagtaggccagg

SEQ ID NO: 712507 - DNA, 472 bp, Homo sapiens
  misc_feature (424)..(424): n is a, c, g, or t
ttagtatttcctattttgtcacatattaggtttgatgtacttgacgatatggtttcgatgctgagtatgcagcaaaagttggtcaggagccctcaagcttaatcacaaatttgagagtcaatcattcagtcgacaaatacttacccatcatttactatgtcccaggtctgttctaagcaccatggatgcaatggtgaacataataaagtacttgtctcctcacaaaacttacgattccagtgcagacaagaaatatataccgtaatatcagtcgtgacgagggctatgatagcgaaggcaataatgccaggcacagtggctcatacctacaatcccagcacttttggggggccaagacagatggatcgcttgagcccacgattcaagacaagcctgggcaacgtggcagaaccctgtctctacnaaaaataccaaaaaattagccaggcttggtggcgtgtgcctgtactcc

SEQ ID NO: 712508 - DNA, 1194 bp, Homo sapiens
  misc_feature (509)..(509): n is a, c, g, or t
agagacgcagcggaggttttcctggtttctggaccctcagcgggccggatggtgaaatccatccgctgcagcggatcctcaatagccacgtgcgttcgccgagagagaaggcacaggggataaatccctagcgcctacatccacggccagcctgtagccatgccgcttccttagagcctgcactagccgctggcgcgcgagctagcgagtgcacgagttccagagggtcttcccttctcatcttgcttgtgagttaacccgggggtcccgggggccttcgggtgggtgctcccttgaattgcccccttcgacacactaactccctgagagtattccccagggtgggcgccgcagggcgcaactaagctcgaagaggggaattcagccaaatcctgttcagcgtaaacgtttattttcttacgtcacgtattgacatcgagcttgatctgtgttataccaacgaccggaaaccttaagcggttcacaaacgatcatagacgcgacgggantttcctcacagcggtcccaggttccgagggccttcagcacgaatcgtccaaaagcgggcattttaacctgtgtgcggaacaagggtgcatgacagtggcgcagagcaggctcttcttaccaattcagaagattcccgggagacgggccggcagcttggccccgacggggccagccaacgtgacccaggcttgtatggcagagtacctccctgtgggcaggtttccggcttgacgagaagcaatgcttggcaggaagctgggaacccagtggttgcttaccaatatttggcgtatcgcaacagaaggaataccagtctgacgggcacccaggagtcacgacacttgtgtgctccacggcaagcacatatacaggcgctataactgtggaggccttcttgggcacggacattggtcgcacgcaccccgggggggacattcccccctttgtgttcccgcagaagagaagcaccctcaggaacgactgatagggcttcccagagggggccgtaagcacacggttatccgaacagaaggcacgaacggtcattaccggggcgaagcatggcgcgagcacgccgagatataggagcccgggcgcatcgggagagcactgggcggcattccgcgcgccacccatgggaggggcaacaccccctttgggtcgacccccggagacgcgcgccaa

SEQ ID NO: 712509 - DNA, 196 bp, Homo sapiens
tcaggctcggtacccagcctcgctggcgctgccacacccgtgcttcagttagctcaagtctcactataagaattcagttaccttgccagacgcggtgactcacacctgtaatcccagcattgtgggaggccaaggaggatggatcacgaggtcaggagttcaagatcagcctgggcaatatggtgaaaccccatct

SEQ ID NO: 712510 - DNA, 120 bp, Homo sapiens
tctagagatcccccacggtattatggcgcccagcgaatcggccaggatcaggacgccgccgggtttgaggacgcgcgccagcttcacgcagcacacgttcgggtttgtgcgtgtggtgga

SEQ ID NO: 712511 - DNA, 228 bp, Homo sapiens
tctcctggaacgtgacacaggtgaaaagagagagggagagggagagagagagaaagacacagagagagattggcccccctttttttatttggcttttaaatttgatgtataattttagcaaaaaaagttaaaatttcgctcctcccacctcataatgaggtgagtacatcaggcttaatcactggttgtcacctgtgtcattcaattcacaaaggagaatatgtttca

SEQ ID NO: 712512 - DNA, 216 bp, Homo sapiens
gagagtacaaccttaattgcttgtatagtctataaggcctacataatcttggcttctgccttcttctatgcttggataattattaaccccaatgagatgccttttatgctggaacatcccaaatatacttctgtcttgggccgggtctgagcgattttcgtctgtctggaatacttttgcctgacatcttcacttgactgatctataggagtggtg

SEQ ID NO: 712513 - DNA, 403 bp, Homo sapiens
  misc_feature (44)..(44): n is a, c, g, or t
  misc_feature (192)..(192): n is a, c, g, or t
  misc_feature (204)..(204): n is a, c, g, or t
  misc_feature (274)..(274): n is a, c, g, or t
  misc_feature (295)..(295): n is a, c, g, or t
  misc_feature (337)..(337): n is a, c, g, or t
  misc_feature (356)..(356): n is a, c, g, or t
actcctgcatacctcagatacacaggaatgtggttataaatttncctcctattgccttgtaattataagttagataacctgagacagagtttggaactagtgctttcttgcttctaagcagggacttagacagaagccatgggaatgtgagtctggcttactgttgctatgatttcctgctcttggtcattnacttgggccagnggcatgagagaagccatgaaagcccagcttttcttcccccctcgatctgctgccaggcagttgaacaaanagaaaaaaagagctatggagncaacgttccagttatggccttcctgggtttctcccccccaanaattttatggaattgaagngggccccttgggcttagttgggaaaagattggttgggctaggtttgg

SEQ ID NO: 712514 - DNA, 111 bp, Homo sapiens
atgacaaccttcactattagaatgtaaaatgtttgtccatggaccttctaaagtcatcgttatcccaccataagtacattatctctctttgggaaccctcaaacggggtaa

SEQ ID NO: 712515 - DNA, 869 bp, Homo sapiens
  misc_feature (41)..(41): n is a, c, g, or t
  misc_feature (126)..(126): n is a, c, g, or t
  misc_feature (129)..(129): n is a, c, g, or t
  misc_feature (248)..(248): n is a, c, g, or t
  misc_feature (268)..(268): n is a, c, g, or t
tttttaaagttggaagtagcaggatattctgatggagtttnactttggtttgggcccactgagtttgagatgcctttgagaaatgaaagaagtagagagagaattaaaaactggccaggagtggtngtnacgcctgtggtcccagcactttggggggctgaggtgggtggatcacctgagaccagcttgggcaacatggtggagccctgtctctacagaagatacaaaaattggctgggcattgtggnacacgcctgtagtctcgtcnactcacggggctgagatggaggattcaattgagcccatgagttcaaggctgcagtgagtcgtgattttgccactgcactcctgcctgggtgacagaagagaccctgtctcaaaaaagaatctgaaaacaacggaaccatgccttcagaattctataaagttattttcaactgataaatctatattcaggcaaagaatcaagggtgaaggtaaaataatacatttttagacaagcaaagactcaggggttacatgtaccctttcttgggaagctatcggagaaaatactccagcaaaatgaaggcgtacacaaaccagagaatgacgtggatccagcaaatagtatccaacacaggcaatattccagctatggagctagctttaaaaagaaacagtaaaaatactaatagattagctgggtgggatggcccatgcttgtagtcccagctactcaggaggctaagcaaaaggatggcttgagcccaagagttcagagcagcctggccaccatagtgagatcccttctcttaaaaataataggttattgccagatttggggcatttggaaagaagtgcattgaagataaagcaaaagtaaaaaa

SEQ ID NO: 712516 - DNA, 278 bp, Homo sapiens
acgttgacacttcagattctttttttgagacagggtctcttctgtcacccaggcaggagtgcagtggcgcgatctcggctcactgcaaactccgcctcccgggttcacacaattctgtcccagctactcaggaggctaagcaaaaggatggcttgagcccaagagttcagagcagcctggccaccatagtgagatcccttctcttaaaaataataggttattgccagatttggggcatttggaaagaagtgcattgaagataaagcaaaagtaaaaaa

SEQ ID NO: 712517 - DNA, 135 bp, Homo sapiens
gactatatgggtggcaagccagtgcagaatagagaacttcaaggatataagtctagtgactttagttagctatatcaaaggcggtctgaaatacaaggctgtaggcgtggcatctaggattaaatcatgttctta

SEQ ID NO: 712518 - DNA, 400 bp, Homo sapiens
ttaatctgatttttaaaggtctttttgtatgttacgtgttaaggggttgtttggtatccccctgaaatgttctgtgttgcagaccagagtctgtttatgtcagggggatggggcccttgcatcctttgcccttgtccccaaatttgtggagtagtaacttaatatgtaaagttgttacctcccccccttttaaatggaaatgcagaaaactgttgaatgtcctgtgttttatgttttttgtatttaagcaactgatttgtctgtctgtaacttaagtgtgggtccaagggctccttatttctttgcttttgttatccccttagtttttgggcaaatgccacctcagttttttttttgtattatcatagtttggtttaaataaactatatagtaacaatta

SEQ ID NO: 712519 - DNA, 900 bp, Homo sapiens
tgctccggttgtcgtgccgtctgtgtggcgccgggtttgtagactcttcggccgctgtgtccctgcccttgaccccgtcggggcaatacttcccgatttttaacttgcgtttgtttgttccgcccccctttgtgtacgcgcgtgtcaaagcgtggcgcccgctccctgggtattccctgggggcgtcattttaccgcgcgtgctgtgcgttggcccaccgcagcctggtttgcggtccgttgcgaagtgctgtccagtcaggcgccgcacagccctcgggtggtgtgagcaccccctttgcttttatccaaaacccgcccgagtgtgtttcttccgcgggcaccgataattttttaaaattcgtcccccggggttaaagtccctccacttgtgtattttgtgcgctactgccaactctacaatattgtaacgcacttctacccacttcgccattccaatgaatccctcttcttaaaggagattttccaaattatttaactcccccctcgaataaccttgttgagaagaactgttctatagccaaccttcgtgcttaaccttcgcccctctatcccccccccgttttactcctctgcggacaacttctcttgttggctataggaaaacaacgtgtttgccctagtccaatattcatctctcctagcttatcacggagctccacactattatcgttcccacacccctcataactccccttatcaaaattgatcacccaccacacacattgggctcaactcacccccccaccacattaaccacaacttaaaactctcctttcaccaccgagagaaacacccctcatatgttcaaacccccttccccccatttccccccttccccccacccccccccccttcccgggtttcctcttaaaaaaaa

SEQ ID NO: 712520 - DNA, 188 bp, Homo sapiens
gtgctagtgctataggtttggtcatagcctttctattagctcttagataagattacacatgcaatgcatccccgttccagcaaaaaagatcacctgcgtgagtaaataatggctccagcccagaatggttcctgcccagaaagccacaggccagaaagcagcgcctgctccaaaatgctcagaactgg

SEQ ID NO: 712521 - DNA, 102 bp, Homo sapiens
ggtctggccgtcgcgattgactactcccggcgaaagctttccggatgatgagtgggtcgatggacttgttggtgtcctgtaaagatccagtatgaagtgcct

SEQ ID NO: 712522 - DNA, 157 bp, Homo sapiens
gtgagcagaggccctgagcggacgcgaggcgactgctggagagtggcggcctgtgtgccgaagatgaggctgacgcagagggcgtgctgagagtcttgagggcctgtgagcaggaagctggagggcagaatcgcgtgggcatgtgtgcgagggactc

SEQ ID NO: 712523 - DNA, 799 bp, Homo sapiens
ggcgcgacctcgggggcccggccgcgacgcaccttgtccgggggggggcccccccgcttcatgccgccgccccccccacgcgccgtgtgcccggccggcccagcagcagggtttccaggcctgaggtgcccgcctggcccaggagaatgaaccagccgcagaggatggcgcctgctgggcacagacaaggagctcagacgacctcctggacttcagcatgatgttcccgcatgcctgtcaccaacggcaagggccggcccgcctccctggccgcggcgcacgcctcggaggttcacgggtctctgaggaccggcccagctcaggctcctgggcgcagcggcgaccagagcagctcctccttcgaccccagccggaccttcagcgagggcacccacttcactggagctcgcacagcagcctctcttcatccacattcctgggaccgggactcggaggcaagcagcggcgagcggggcgcctatgcctccttcgcgagagcaccgcacgcgtgcccggctgccctcaggcggctcctgctcaggccgagctggccctcacagcccccgggcccctgttccccttcgggcatgacggggaccctcccgagtactacccctccctactccggcagctcccggccggaacagcggccgaccggcagcctaagacaacgcaggcccaacaaggtccggaaggtccccgcgggctctcacgcatccgcgtacccagccaggccagcgtgagcacctacggccggactgcaccgaccacccgttcgcaacgaccccaacacccctac

SEQ ID NO: 712524 - DNA, 1208 bp, Homo sapiens
gcgaggcatcgaggggagtctgaccacagactgttgtgctgggaagggagacagaggcggcggtggctcaggtgatccgaggctgcagtggtggtagtaggaagatgtcgggcgaggacgagtcaacattggagcaacactatcagcttgagagacctggatctgtgaccgagtataatgcatggcggggcagaggatcgccacaacctagggatagcgttgcgggtactcgtgtgtgttgtggaaggtcgatctgagcatcagagtgtgtcggctacatgagtcgctgatgtgaggaaaggtgtagtggcgcagtgattattggcaaggagagacaggggaacacatgcgtttgcaagaagaggagagatagggactatggaacggaatggctcatatgacttgttgccccaccccagcattttacgcgtggagattgatactcgctcgatacttgtgcgagcttttctactgccatctctagcaaagcagccagagcgagcgatgtatgatttcgtccaaagggaaggggtaggatcgtatgggtgaaaatatattgggacgctttggtagggttactcgattgtaggtattggagcgtatcaaatgcgacttaattgagtaggcttgcgagcagcatattgtaggttgggattaggatggttagcatcatgggggggaaactacgaaaagttgaaacacagcgggatgggaaagaggctacggaatgatatgattttgcgatgtggcttatgggacttgccaaactcttatttggttagcagttcgcaaagggcgtcgtcactccttaacagtctcattggcgatccacacgcaattcgtgggtggtaccactatttcaaagaatgagccactatcaaaacggcttggaaaccacggcaaagggtctcctcgggggagacactagaagaggtgtttgtgacgcgcgaacacatcgtagtgttataaaccctgtggggcgatgcagggccaaagatatgggcacacgcggatattgcggtggtgcacaacaacccaacgggtttggaagaggcacaggccagtggttcacattcgtaactggggagggggaacaaaaaacccaactgtgatacacaggaaatgcgccgacaaagagccaagacagagcaaagacaaggggaaacattgaacagaacaggcgatggaaaataatagagggggtaaca

SEQ ID NO: 712525 - DNA, 121 bp, Homo sapiens
acagaggcctgtcttgcctaggtcttgtacatagcctccccctgacagcaggtcagagtggtggtggcagcggtggtggcagcagcagtggcagctggtagttaggtcggcattcctctct

SEQ ID NO: 712526 - DNA, 147 bp, Homo sapiens
caggagacagagtccctgggccaggtgtcgtcaggcctattttggacgtgggaaaaataagcagtctcttgatgcacgaacgccctgcctatctgtattcattggaggtgcagctgactgcacagacgtcactggggcctgtgtctg

SEQ ID NO: 712527 - DNA, 670 bp, Homo sapiens
  misc_feature (193)..(193): n is a, c, g, or t
  misc_feature (510)..(510): n is a, c, g, or t
tggagacatggagtctcactctattgcccaggctggattgcagggtgtgcaatttagactcactgcaaccgccgccccccaggtccaagcaattctccgtgctctcccatctcccaaagctgctgggattacaaggcttgcgccaccagtgctcggtgtaattttttcggatgatttccagctagaagacggngtttccaccatgttttggccaggcgtggtctcgaaactccgtgacctcaggttgatccacccaccttaagcctccacaaaagtgctctcagattgcgaggctttagcccacttgtgtgcctgtgttccagagaaacacacagatttctctgtagatggaacacttaggtgacgaccagacattcgcccgttaggaactctgaacgaggacgctcgttgggcgtgcctcacaggggaaagcccatttgtggccgagcacaattagcctcgtgatacagtgtgaaatacggggatttccccttgaagcactttcacagncagaatctcggggatatgtctcgtggtaaagaccctcatttgagcttctagaagggccgcgaaatttcaggaattggctgtgctgcaaaacgagacccatgattaccaggtcaaaagagcaaacgacaatataggccacagaggaactagtgtaaggata

SEQ ID NO: 712528 - DNA, 553 bp, Homo sapiens
ctcgagtatacactgaaaatggtagttggccttcaaactagccttcacatctgttcaactctttttttgttttgttttgttttgttgaggcaggatctcactctgtcactcaagtgggagtgcaatggcaccatcacgcctcaccgcagccttgacctcctgagatcaagcaatcctcctgccttattttttgactttttgtagagacaagttgtcactgtgttaaactcttgatgcagctgaaccgcggcattagctgtactagtttgaattctgagtcctcgaaccatgaggaaattcagtgtaggaaggacgagaaagagctttttaagcataggaatcttcaggccccagccctggagagtctaattcaagaggtcaggagtgggatctgggagaatacaggtgattcctacctgcagccaggtttgtgaaccactgctctaggaactggtagtgtttgtttgtttgtttgtttgtatgtttgtttgtttgagacggagtcttgctctgttgcccaggctgaagtgcaggaaacaagaccggggatcct

SEQ ID NO: 712529 - DNA, 140 bp, Homo sapiens
agccgtgtgtacactagatgaacttgataatgggaatcctccgaagctctcccacactcatgcatttgtatggcttctctccagtgtggactctctgatgggcttgaagatttgaactcagagataaagaccttttccat

SEQ ID NO: 712530 - DNA, 205 bp, Homo sapiens
ctctacaggctcagcgcttagttctttgagcctcggctggccgtcggcctctggcaagctcgaacttccggcccttggcgcggacgtagggtttgcgtgtggctgtgcggggttcctgggcgccttgccctgaaatgcctggtacacctactcggccccttgcgacggaccggacgacgcaggacagatgccacatgcccgttag

SEQ ID NO: 712531 - DNA, 1622 bp, Homo sapiens
  misc_feature (1358)..(1358): n is a, c, g, or t
cctcgcgtgctcgcttcagttgactcgttcgtgtttgtttgtccctagtgggtggtccgggttgttatcttcgtgcgctcgtctcgtgtgtggtggttgccgccaccttcgtcctccgcatcgtcctgttgcgtccgctccccgcaataagtaggtgtgggtcgccagcagagcttcccgcgcggggcgcacagtggttgcgtgcgcacaccgccagaggtggtcgcagcctcttttggggggtcgtccacccgggagcatatatgtcctcgccctttgtcgtcccggcatgtcagtccagggggtctcccctgtgtggtgttgcggcggagtaccgacactggcgtccttggctctcctcgcccctcgcttggtggaagtggtgtggtcgccctcttttattgcgggccctctacagtggagtggtcggccctgtggggagccctaccccagaagtggcgcgcgttgaaaattgtgggcggaagagagggacgcctgtcttttgtcgcccgctgtttgaagacctgtgttctttattacttctgtcgcgcagagcgccgcctttttgtgtggtgccccgcctcctcttccccctgggggatgtttgtagaattctctctcgaggagttatatgtgaaaatagggagggaggaaattagggtgctttctgtgccaacacctttgtcggtggggatagccccccaaaggagccctcggcgttccgccaaaatgtgttgaaaggaagtggggcccccctcctcggacgcacctctgtgagaggagtgttgcggccccccaccctctatgcacagggagaagtcttctgttcttttgtgagagaggcctcgagagtgagagaggcaacagggaagttttttctctctcgcccctctctttgtccacaaagaactcttgtgtccctcgcccctcgagacaccctccgagagggggaaaatactataatttctcgggagtgtccacactccgcgctctctcgggtggttgagatatacccccacctcgctcacagacaagggagacacactttgtctctgaggtgtatgagacaccgcggtttgtgaatacatttagagagagatggccacccagaggtgttatctcacaccggaaacatttcttctcagacgcatctcccggatggtgacccctgtgtgaaataaaagaaatgtgcgcacgcacccacctccagatgccacgcccgcataatatatgtcacccccctccaagataattaaaaaaaagagaaatcccaatattctctgtatagaagaacaccacgcgcttgtctcaagcgccccttttctctcgcccacgtttttctcaaggaggcgcgcacnaagaatatagagatttggtgagaatataggagaatataagctcttatagttctttacaccaccgcagcacctcctacccagagtttatgagaaaaaagtttaccaccactaatcttatgtttaccacgagaaaatacttgtgctatgaatatactttttcaaaaggtacattttgaaatacccctttaaaactgctttttttttccacgcccagtatcccacccacttgtttttgcttccaataaattttttgggaaaactcca

SEQ ID NO: 712532 - DNA, 884 bp, Homo sapiens
ccgagggtacgtctttggccccgtccgagcgccccccttggtggttgttcgccacggcggcgtcgcgcccgcgttcgggtccgccggtggtgtttgtcaggccccgccgcgggtgtgttcccgccgcacgattgttttgttggtcggcgcacccagcgcgccttctgcatcggcaccgcttcgggtggcgccgagagggcctcgctctctacctgtcctggttgggggcgagggacgcacaacctccttcggaacatcgtctgcggcgcgcgtggatcttccctcgccacggtgggtgcgcacggcctgcctctgagggtgcaaaccgctcacacgtcgttcctgttgggcccccgcgcacttacattgtgcgcggggtagcctcctctcgtcgctcctccgtcgcggatgattgtattcccccggccgccccatctttgtgtttctcttgcgtgggggggccatcccctcgcgcgggcgggggcacgcaaccgatgttctctcttctctcctcgcggcggcgatctttcttcgagcgccgccactcgtcggggtgtatcttcctgcggcagccgcgcgctcacacgaacttgtttcatctcccccgggtgtgcgtttggagtggtcggcgcccccccagcgcacaccacacgctggcgtgtggtgcagcacactcacgcacgggttcattcactcgcttcagtgtggagcagggttggtgcctcccccaccttgtggtgccccccccacgcgattacgtcccccccgccgtggcttttctctctcggtcgcgctcctttctacgcacgccatagattgggccaccccccctgttcttgtcccccccgggaagttgggatattaaatcacaaaccaacataaca

SEQ ID NO: 712533 - DNA, 851 bp, Homo sapiens
gaactcggtggtggccactgcgcagaccagacttcgctcgtactcgtggcgcctcgcttcgctttgcctccgcaatcatgtctgacaaacccgatatggctgagcatcgagtaaattcgatccagtcgaaactgagagaagacagagacgcaggagaaaaatccactgccttccatagaaacgatgaacaggagaagcaagtcaggcgaatcgtaatgaggcgtgcgccgccaatatgcgctgtgcattgccacaagcattgccttcttatttatacttctttgtagctgtttaactgggtaagatgcactgaggttggttccagtttaacttgactgtgctgcccctttcacatcatagaactactgacatccgaaggccgtcgcctgctttcccatctgtactatctatctggctggctagggaaaggcaaagaactgtgcatgttggtgaaggccggaagtggggtggaagaagtggggtgggcacgacagtgcagactctaggagtacatagccaagctggcccaaggctgtgctgtaggctgtacgtgcagtgtcatcagagtgccatttctttctttcgtcccgcgtgcttctgactatatggaatgccaaatttccgttatatatgcatatagctccttaatggcaacataatttaatgtgtgggctccggtcagtccgggacaccgtgtaaacccatgtgctgggccttaccgctgtcgtggtggctcggacgccgcgttgcaagggaccgggtccaggcccgtggagtctcccagtaaacccgcggcccgggctttcacaccagaggtgtgggtagggcgtaaaggccaaagcgtaaccggg

SEQ ID NO: 712534 - DNA, 430 bp, Homo sapiens
  misc_feature (394)..(394): n is a, c, g, or t
tcctttaaattaatgcctgtacttactaattaaactttctttaatattacattttgtcaaatgaacctcacttctattgctacctagtaatgtttggtttggttctttattttggtatttctgactcttacaatttagaatcttttattaaaacattgaaaccaggcgtggtgattcacgcctttaatcccagcattttgagatgctgaggtggggggattgcttgaggcaaggtatttgagactggcctgagccacatagtgagatcctgtttttacaaaagataaaaaaaattagccaagcctggcagtcctagcttctcaggagggtgaggtgggaggatagctagagcttgggagtttgatgttgtagtaagctatgatcacaccagtgnactcaagtcttggcaacagagtgacaccctgcctca

SEQ ID NO: 712535 - DNA, 167 bp, Homo sapiens
ggttggctcaagtcgtttccacacactcgattttctctccgtattccaggcttggagtcttctgttaacccattgcgtggatgcctcacgagaatcaccatttatgatgatcaagcctatccattctctcaattcttacccttcactctcaccagttcttccctcga

SEQ ID NO: 712536 - DNA, 135 bp, Homo sapiens
  misc_feature (99)..(99): n is a, c, g, or t
  misc_feature (129)..(129): n is a, c, g, or t
gcagcacgttgatcactggcgcgtcggcttcctgcacctcgggttgctgccgtcgcagtctgccatcgcaaccggctccgcagtgttcagcgtgttgtnctcactggccgcccgatggttcgggaagcnggtacc

SEQ ID NO: 712537 - DNA, 98 bp, Homo sapiens
tcaagcttctaacgatgtacggggacatgtctgtagctattttcctccctttctctgtacctctaagaagaaagaatctaactgaaaataccaaaaaa

SEQ ID NO: 712538 - DNA, 416 bp, Homo sapiens
tttcgatacttcgacagccggctcagctcctcatggccctgctgcaactgggtcgcctgggcctccaccaaacgcacgcacaactccatgatgtcaaacaatcactcatatgtactacaatcacagtagatctagcagagacataatccagtgcccgtccccggtaaccagatagagccgtcactcaaagcagctcctgcctcttctgactcctgggccaggcgcctgggaacctctgcgttgtgggtcagggcagcctccaggctctcagccccccgccagaaatcccggcgagcctctcggaaaccccgtagacctctgaggatgggaaaataacacagaatcgcagctaacacccacctgccccagcagagcattcccagggtaaagccctcatgtccttccagttagtctct

SEQ ID NO: 712539 - DNA, 777 bp, Homo sapiens
ggtggcggtccgctccctccgcggctcatggcgagccgacgtcttggcacggatccgggaccctcaggccgttgcagtcgccgtgccggctgctcgggccccagccgccgggacgctgtggtgactccgtcgcgctctcgcccgtcggccccgttctccgcaccgatgacccaatatgctcagggactaattgtcattagcctccggtagcggccgtaaggtagactcgggccttgtctggcatagtgcgccctgcacaaggaatccattaatttggacgagggtcattgaagaaatcgcatgaaccaaagaagatctctggcaaccatcatttagtaggataacatacatttcattgttagaagaaggccttgaagtagccgggcacggggttgccagggttggattgacgatacttccgatgaggagagtggagattccagtaccagtgatctcattcagtatgtctagctgatccaaggggacaatagaatctataggtgggtcgatgacgatatggggctgacctggtttggagattaatagcatgtgttgtctaattgccttccagtagcaatcctccattgggacagatcgtagggtatccctttgagaaatagatcgcttgcgtttgttttgcaactggccgagataattatagtatcgaaatgccaataacctttaatccctttaagggggacctggcatggaaggaactgttctgtagggggggaaacagggattttgcgaagcccaggaaggaggattctgaaatta

SEQ ID NO: 712540 - DNA, 524 bp, Homo sapiens
ctggaaaacctcttcttgggggcctgtcttgagagtttccatgaaaaaggccgtctcttccatttttagaccttctgtcgcccccccccggggtccagcctttacatggtggccgataaattgcacccgccccccgaaaaagctgaaaggggggttggttattttttttaaaaagccaggctgggtgcccagatttttttttaattggggccggggggtttgggggcacaagccgtccccccccctccgccaggggtttaaaaggcccaaagcccttccctttaaagcccgatgggggccctgaatttttggaaaaaactttatccgaaaagcggggccgggggccccaactggggcaccccagattttgggttttttttgaggccccttaaggaaaggtggaaaaaaaacccccccaagaaaggtggaataattaaacttttttataaaggggggcctcccttttgggaaccccctttttggggttaatttttgagaattgggataaaattggttccttttta

SEQ ID NO: 712541 - DNA, 713 bp, Homo sapiens
gtttggtggggttacacgcgggttcaacatgcgtatcgaaaacgtgtctatttctgtgtcggtggcccatctatcctggacacggtcagtgactgttcgtccgcaacgattgcaaggtgttcagatttgtgcaaatctaaagtgtcataaagaaactttgaaacactgaagcgcaatcctcgcaaagttaggtggaccaaagcattccggaaagcagctggtaacagagcttacagtggataattcatttgacatttgaaaaagcgtagaaatgaacctatcaaataccagcgcaggagctatggagataaaactattgatgcgatgaagagaggttgaagaaatcaaacagaagcgccaagctaaatttataatgaacagattgaagcaaaagataaagagctacagaaagtgcaggatatcaaagacagtcaagcaaaagatccatcttatccgagcccctcttgcaggcttaggggagacagttggaagagaaagtggtacagcagttacaagcaggatgtggacatggaagatgcgtccttgaaaaatctctgtaaccattgtcttttatgtacatttgacaatgccctttggatacttggaacctgtaactgatttactctttcgtacagtaaggtcacttaaatgaaaaagcgattaagagacatctttgctgcatgggcaatctacataatatcagatattacgga

SEQ ID NO: 712542 - DNA, 315 bp, Homo sapiens
cctgagacgaattcatcacttgacgatgagtgtaaagagagtccagaacaacaacagccttacgcaaagaagagtaaaattgcaatcatcagggagaagcacacagctttgatgacgcccatcgtatttgctttggagcatgtgaggagtatcacagcggatcctgaagaaacacctcatgaaaaatggtttcaggataagtatggtgatgccattaaaaatgccctcagaataactgaagactccattgaacccagccaagcctgggagcagctggattccatttaaagagataatgctaagttcgatcgagct

SEQ ID NO: 712543 - DNA, 155 bp, Homo sapiens
cagtgtataatgagacagcgatagtattattcttctaggcatacgtagggacggatatgaggtgtgagcgactatactagatattcctagaagtgagatggtacatgctagtataatatttatgtaaatgaggggcaactcgaaagccccaagcg

SEQ ID NO: 712544 - DNA, 356 bp, Homo sapiens
ctgcgcatccacgcatggcactctcgtctggcctcccttttggaccaccatgcctgctcacaggcttggcaacaacattccttcctcccagctattcgcacgacgctgttccctctgcctggcaatgacggaaccgtggcacaggctccactggtgttttacgagggttaagcctcttcttcatatggtgccattttctctcccgagtgacccccagcctccagtgtctaagttcttagaatgggagtgaggtggacacattggcctggcatatagccagcagcccctatcctcttcttcccggcctcttttgcatccacttggcttccctgccccccatgcgtcgattgccaggt

SEQ ID NO: 712545 - DNA, 106 bp, Homo sapiens
gcctcttcataactacctgatgttcctgtcgacgtgggatagaggaacggtcccacagccgagcatcctaaagccccggccctgtgaacaggcaagcttatctttc

SEQ ID NO: 712546 - DNA, 421 bp, Homo sapiens
ctagatacaacatgagcagtgctctaaggtacacggctggggtgcagctagaagctgactgactcaccttttcctgagtgacccacatagccgccttccaccttctaacaaggtcctataacatgccttcgctggtggcttgtggttcacattgtgaccaaggaactgcatgatacacttctgctgggggaggagagaataaagatctatcaatcactaagccagaccctgaacttgctcaccaaactgtccactctgctgtgactataatcactgctgctcaggaacctatcgaaagtgcatgcagcccttcgaatctggggacctgcatccatggattcaaccagcagactgaagatattcgagacaaatcactcaaagatggctattacgaattacacaatagagtgtgacaactctt

SEQ ID NO: 712547 - DNA, 393 bp, Homo sapiens
ctcggtgtcgtaatgctccagaagaaccctctttactctgccttcggcgtttctcaccgcagagggagtctctcctcacagacaccacatgctggggaatgtagcggggtcacacctagatgccagcacatctactgagtctcactacgaggcccatggcatgtactacctaggttaccactagctgattattcaaggcccaagggctctttagtcagatagtgaagaatcctgccattactgagtccttcccttcaaggaagcaggttcccttgtagcccagagtttgtttagagatgttatcccaaagctgagacctgaaaggggggtctcatgactctgaccagtgccccctcctactgtaagctagtatccaagatgcaagacaaagtc

SEQ ID NO: 712548 - DNA, 599 bp, Homo sapiens
  misc_feature (3)..(3): n is a, c, g, or t
  misc_feature (327)..(327): n is a, c, g, or t
  misc_feature (329)..(329): n is a, c, g, or t
  misc_feature (338)..(338): n is a, c, g, or t
  misc_feature (400)..(401): n is a, c, g, or t
  misc_feature (453)..(453): n is a, c, g, or t
  misc_feature (455)..(455): n is a, c, g, or t
  misc_feature (467)..(467): n is a, c, g, or t
  misc_feature (471)..(472): n is a, c, g, or t
  misc_feature (495)..(495): n is a, c, g, or t
  misc_feature (503)..(503): n is a, c, g, or t
  misc_feature (514)..(514): n is a, c, g, or t
  misc_feature (517)..(517): n is a, c, g, or t
  misc_feature (520)..(521): n is a, c, g, or t
  misc_feature (555)..(555): n is a, c, g, or t
ttngcaggccaatgatttcatcaatatccaattaaattttagtgtgacaactacatttagtttgttttcttacacagattgaacattcaccattatgacagtttcatcatgctaaaatctattcacaaacttacactttggaaaaaagtgtatttctagaaaattttatgtacaatacaaatggaatagatattaagtcactgaattgtcaagctacataaaataaaaccaatcaaccaccagtagtatacattaacagcatttttgaaaaaaaattttcttttacattcagcagagttatgttcatgaagaatttctacatttttnanagtaatganagtgtacacaatttaataattgtgaaaatagaaagaattaaatagcccaaatatagtataannctaaacaccgttactgtctatcagtttgggcttatgtgaaataaagggcgcngnggctctggggcngttnngctttgggctttgggggtgggtnggccatgngcgcagagganggnttnngctttacattgacacatttctgtgtgtcaatgtngaagggaaaagaggtttaattataccttttaagcaggcaaacca

SEQ ID NO: 712549 - DNA, 185 bp, Homo sapiens
  misc_feature (178)..(178): n is a, c, g, or t
cggccatgccgcactgtcagcggcgtatgccgccggagcgccagcgaaaccgcaagcgacagtcgcgatatcccgcacggtgtcgtagcgcagcagcgggtggtcatggacatcctgcgatgcccagatcaacccggccagatcaccctgcccataaaagacgcatgtcacccgcaanctggtac

SEQ ID NO: 712550 - DNA, 118 bp, Homo sapiens
ttactgagaaaggaaggccaagggatgaggtggaacgggcctggggcgccacagactaaggcagagactcccctacctagcgcccagcccaaacagttggccgatcctgcccatgctt

SEQ ID NO: 712551 - DNA, 214 bp, Homo sapiens
gtatccccatacagagtacattataaattcaaagctaaattctttcattacactgaaatcgctaaaaaaaaaaaaaaaaaaaaaaaaaaaaaaactttggcttaaaaaattctcccccgggttaagtttttccatttaatagttttcttgttgggggccatattttcccccagaaatttttcccactttaggtgtaaacatttggaaccgcggg

SEQ ID NO: 712552 - DNA, 187 bp, Homo sapiens
gagaatctgagcttgagatggaggctgctcagagccagctctgcccaacgaacccctcgtcaatttccagtgcggaagcagcccctggacgactggtgccacatggcaggactgggcgtggtcttgcaggaggatctccagtacccctgcctgccctcccttacatgtcctctctgtccttgaatgt

SEQ ID NO: 712553 - DNA, 116 bp, Homo sapiens
tagctggcccagattcggattgatagtgagaaagtgctgacgtagaagtggagctggacgggcttagagacacagtgaaggccctgactcgggaacaagagaagctccttgggcaa

SEQ ID NO: 712554 - DNA, 430 bp, Homo sapiens
tccagcgtccggatccgggccagctgctccagctgcagcaccttgtagggctgcagctcttgcacctgctgtgccatctgtgccgcgcgcgcctccatctccaacagctgcgcgcgcaccccgtcctcgcgcccgtggtagagcgaggccagttccgcccgctgccagtggatctgcgctaggtccacgcggttctgctcgtccagccggacgatggctttggcgcagcgctgggcgcgcgcgctcacgtagctggcgtagagccggttctcctcgcgcaggcgcagcgcctcgcggtccaggaaggcgttctctcgcagcacctggtcaacgctctcctcgcaggtgtccagctgctccgagagcagcgcgtgttcgcgttgcaggtactgcgcgcgctccgatagcggctgctcggcacccgcggccg

SEQ ID NO: 712555 - DNA, 2509 bp, Homo sapiens
  misc_feature (8)..(8): n is a, c, g, or t
agcggagnagcctctgctccaccgcggcgagaggcatgggcacgtggctgccgagggtggccgagctctgggaagaaaagcccgtgtgcctctgcatagcgtcgctacagcgctgactcggtgtggattgattggaaaggtttgagggagtacttgggaagcatggtggcacatgatgagactggaggtctcctacctattaaaaggaccatacgagtcctagatgtcaataaccagtccttcagagaacaagaggagccaagcaataaaagagttcgacctctggctcgtgtcacgtccttggcaaatttaatctctcctgtaagaaatggagctgtcagacgttttggtcaaacaatacagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggcaatatatgaaatgtcccgaggtgaacaggatttaattgaggatctcaaacttgcaagaaaggcctaccatgaccccatgttaaagttgtccatcatgtcagaagaggaactcacacatatatttggtgatctggactcttacatacctctgcatgaagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacataaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgagttatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgta

SEQ ID NO: 712556 - DNA, 1098 bp, Homo sapiens
cgccttgaaaccagacatctgatcagcatgcaaacacacacacacacacacacacacacacacacaacacacacacatacacacgcccggggaggcaggccggagagacctcgctcgcgcaagaaggaggggaagacgacggaaggcataggcatcaaatacagacacgacaagtagagaacaaggagtacaaagaaagactgagaaacacataaagcacacgacacccaaacaagaggataccaacacacagacgagacgggccaaaaaaagagaaagaagaaaaacaaagaaaacgaacgaaacacaaacgcaaactcaagaagacacgcaacactcaggcagcgagagagacaaacacacaacagacgacccggagaaaggaagccacaaaagaaggacaaaagaaagacacgactagacgagaaaacaagcgaaaaaaaaaagaacgcgcacgacacaaagacaacccaagggacaaaagacgaaagagaaggaaaaaaacgaagcaagaagcaaaagaaaaaagaaacaaaggagacaaaaagcccaacgaacaagaacaggagaagaacgaaaacaacaccaaagaaaaaagacagaaaacgaaaacaaaaagaaaaagaaagaaaaaggcagaagagagaagaagcggaccagaagcaaggaaaagagaagcagccaaaccacagagccagaaagaggcggaccggacacgaacgccaagagcaggaacacggcaggaacagaggcgagagaaagacgacgcgcgacaaaaaaacagggagaagacaggagagcagaaaggcacaaggagaacagagcagacgatagcacggaacagagaagcaaaggagagagaagaaagagacccaaacggagcacaacgggagagaaaaacacgcagacagaaacacggacggagagcaagaaaaagaaagaggaacacgagagagacgcaaagacgcagaacaaaaacagcaaaagaaaaagacagaacaaacgaaaaggaaaagcaaaccgaacgccaaagccacaaaaacacaaaaagaaaacaaagaagaagaaagagaagacgaacaaagaaaagacagaaag

SEQ ID NO: 712557 - DNA, 464 bp, Homo sapiens
  misc_feature (8)..(8): n is a, c, g, or t
agcggagnagcctctgctccaccgcggcgagaggcatgggcacgtggctgccgagggtggccgagctctgggaagaaaagcccgtgtgcctctgcatagcgtcgctacagcgctgactcggtgtggattgattggaaaggtttgagggagtacttgggaagcatggtggcacatgatgagactggaggtctcctacctattaaaaggaccatacgagtcctagatgtcaataaccagtccttcagagaacaagaggtaagactttaagagaaacgttaggcaaaaggaatgttttctaactccacggagcttttaaaatttttaacaaggtattaacagtataattttaaacttttgatcttattattacaatgtatgttcttgatttatgtgcaagcttgaaatgtgtttagggactgtggtctaagtttaaatagtttatacatagcatagcttgagtgtac

SEQ ID NO: 712558 - DNA, 957 bp, Homo sapiens
gttattatcgaaaccatcagcctactcattcacccacgtagccctggcgtacgcctaaccgcttagcattactgcatgaggcacgtactcatgcaccataattggaagcgcgacgcctagcaatatcgatcggcattgaatggcttccctctacagcttatcatcttcacaagttctaattctactgactatcctagtacagatcgctgtcgacccttaaatccacagcctacgcttttcatcagctttctagataagccttctacactgcacgacaacacataatgacccaccaatcaccatgccatatcactatagtaaaacccagcccatgacccctaacaggggccctctcattcctcctaatgacctccggactaccatgtgatttcaacttccactccataacgctcctcatactaggactagtaaccaagcacagctaaccatagtaccaatgagtggcggcgatgtatacacgaggaaagccacatatcctaatggccatcatcacggagccatccctgtcccaaaaaaggccttcgatattcgggatacctcctatttattactcggtccgaagtattgttcttcgcagagattttgctgaggccttttagcactccagcctagtccctaccccctactggggaggcgatgtgggccgcaggtggcattaccccgctcatatccgctataagttccagtcctaacacatgcgtttctcgcatgggagttttatcacctggctctcatggtctactgtgtctcacgtcggcatgttccagcctggtattccattactgggtcctattttcccctaaggctcagaattgggtccgtgcctgccagggtttagctctcttttggccggtcccgggtgcggttaggtccgtcccatggcccccattttgtccccttttttccccgcttttttggggctgtttcctgtggcca

SEQ ID NO: 712559 - DNA, 349 bp, Homo sapiens
acaggtacggtccgaatcgatattcgaagcgtcggatatacaggagttctgaatatcaactttgaagaaagggtgaatcccgaggtgccatgtatttacatcgacaagctggagtacctggatgaaaagcagagggaccccagaatcgaagcgagcaaagtgctgctgtgccatggggagctgcggagcaagagtggacataaaccttttaaccaatttttttccccatgggttttccacacgaacgaattctttgaggatatcctggaccttcaggaccccgatcaaccacgggaaaacgtaaacgggtcaacctctttaaccaggatgttacccgggtcaggccaaa

SEQ ID NO: 712560 - DNA, 3236 bp, Homo sapiens
  misc_feature (8)..(8): n is a, c, g, or t
agcggagnagcctctgctccaccgcggcgagaggcatgggcacgtggctgccgagggtggccgagctctgggaagaaaagcccgtgtgcctctgcatagcgtcgctacagcgctgactcggtgtggattgattggaaaggtttgagggagtacttgggaagcatggtggcacatgatgagactggaggtctcctacctattaaaaggaccatacgagtcctagatgtcaataaccagtccttcagagaacaagaggagccaagcaataaaagagttcgacctctggctcgtgtcacgtccttggcaaatttaatctctcctgtaagaaatggagctgtcagacgttttggtcaaacaatacagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggcaatatatgaaatgtcccgaggtgaacaggatttaattgaggatctcaaacttgcaagaaaggcctaccatgaccccatgttaaagttgtccatcatgtcagaagaggaactcacacatatatttggtgatctggactcttacatacctctgcatgaagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacataaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgagttatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatttttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttggtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactatta

SEQ ID NO: 712561 - DNA, 3356 bp, Homo sapiens
gcggtggcggctgcagtccgctgagaggcgctttctgcctggcagaggctggcgggcatcgtgcccgtccctgccggtctcccgggcacccggccaccgccccaccccctcctccgtgccatggagcccgagctggcggctcagaagcagcctcgaccgcggaggcgaagccgccgggcctctgggctcagcacggagggagcgacggggccttcggccgacacctccgggtcggagctggacgggagatgttcccttcggagaggcagctccttcacattcttaacacctggccccaactgggacttcactttgaaaagaaaacgcagagagaaagatgatgatgttgtaagccttagcagccttgatctgaaggagccaagcaataaaagagttcgacctctggctcgtgtcacgtccttggcaaatttaatctctcctgtaagaaatggagctgtcagacgttttggtcaaacaatacagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggcaatatatgaaatgtcccgaggtgaacaggatttaattgaggatctcaaacttgcaagaaaggcctaccatgaccccatgttaaagttgtccatcatgtcagaagaggaactcacacatatatttggtgatctggactcttacatacctctgcatgaagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacataaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgagttatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatttttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttggtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactatta

SEQ ID NO: 712562 - DNA, 3193 bp, Homo sapiens
  misc_feature (8)..(8): n is a, c, g, or t
agcggagnagcctctgctccaccgcggcgagaggcatgggcacgtggctgccgagggtggccgagctctgggaagaaaagcccgtgtgcctctgcatagcgtcgctacagcgctgactcggtgtggattgattggaaaggtttgagggagtacttgggaagcatggtggcacatgatgagactggaggtctcctacctattaaaaggaccatacgagtcctagatgtcaataaccagtccttcagagaacaagaggagccaagcaataaaagagttcgacctctggctcgtgtcacgtccttggcaaatttaatctctcctgtaagaaatggagctgtcagacgttttggtcaaacaatacagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggcaatatatgaaatgtcccgaggtgaacaggatttaattgaggatctcaaacttgcaagaaaggcctaccatgaccccatgttaaagttgtccatcatgtcagaagaggaactcacacatatatttggtgatctggactcttacatacctctgcatgaagatttgttgacaagaataggagaagcaaccaagcctgatggaacagtggagcagattggtcacattctcgtgagctggtggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacataaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgagttatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatttttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttggtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactatta

SEQ ID NO: 712563 - DNA, 3685 bp, Homo sapiens
  misc_feature (988)..(988): n is a, c, g, or t
gcggtggcggctgcagtccgctgagaggcgctttctgcctggcagaggctggcgggcatcgtgcccgtccctgccggtctcccgggcacccggccaccgccccaccccctcctccgtgccatggagcccgagctggcggctcagaagcagcctcgaccgcggaggcgaagccgccgggcctctgggctcagcacggagggagcgacggggccttcggccgacacctccgggtcggagctggacgggagatgttcccttcggagaggcagctccttcacattcttaacacctggccccaactgggacttcactttgaaaagaaaacgcagagagaaagatgatgatgttgtaagccttagcagccttgatctgaaggagccaagcaataaaagagttcgacctctggctcgtgtcacgtccttggcaaatttaatctctcctgtaagaaatggagctgtcagacgttttggtcaaacaatacagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggcaatatatgaaatgtcccgaggtgaacaggatttaattgaggatctcaaacttgcaagaaaggtcagtaaataactttttatcagatgccctagtttttaaaaattacatttcacaaaatctaaaggatagttttcttaacctttagaagtagaagaatagaaaatatctactggtgaatacattttttttaggtgaggtctagacacatcctcaaatacaagtattagtaagagagtttatttggggattaatacatactaatttattttatgtgtagcaaacagaatccacgctagcttttatgtaattaattctctttgattccaagtatagntccctcatgttttcctcacatgatctctctgtgacacatttctcccctctgacaggcctaccatgaccccatgttaaagttgtccatcatgtcagaagaggaactcacacatatatttggtgatctggactcttacatacctctgcatgaagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacataaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgagttatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatttttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttggtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactatta

SEQ ID NO: 712564 - DNA, 104 bp, Homo sapiens
tgagctcaaccaaaggctggcaagctttgggcctcatttaagggattttgatgagccgatgggccctggaggcagcccattaaagcatttggctcgtttttgga

SEQ ID NO: 712565 - DNA, 3823 bp, Homo sapiens
  misc_feature (988)..(988): n is a, c, g, or t
gcggtggcggctgcagtccgctgagaggcgctttctgcctggcagaggctggcgggcatcgtgcccgtccctgccggtctcccgggcacccggccaccgccccaccccctcctccgtgccatggagcccgagctggcggctcagaagcagcctcgaccgcggaggcgaagccgccgggcctctgggctcagcacggagggagcgacggggccttcggccgacacctccgggtcggagctggacgggagatgttcccttcggagaggcagctccttcacattcttaacacctggccccaactgggacttcactttgaaaagaaaacgcagagagaaagatgatgatgttgtaagccttagcagccttgatctgaaggagccaagcaataaaagagttcgacctctggctcgtgtcacgtccttggcaaatttaatctctcctgtaagaaatggagctgtcagacgttttggtcaaacaatacagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggcaatatatgaaatgtcccgaggtgaacaggatttaattgaggatctcaaacttgcaagaaaggtcagtaaataactttttatcagatgccctagtttttaaaaattacatttcacaaaatctaaaggatagttttcttaacctttagaagtagaagaatagaaaatatctactggtgaatacattttttttaggtgaggtctagacacatcctcaaatacaagtattagtaagagagtttatttggggattaatacatactaatttattttatgtgtagcaaacagaatccacgctagcttttatgtaattaattctctttgattccaagtatagntccctcatgttttcctcacatgatctctctgtgacacatttctcccctctgacaggcctaccatgaccccatgttaaagttgtccatcatgtcagaagaggaactcacacatatatttggtgatctggactcttacatacctctgcatgaaggttagatgtgccacttaattgtcattaaatctaaagagccagcggtgcatgtaattttcagtctaaacttctaatgtagtgctgacctattttttaaataaacctgttaatggtgtttatgcttttttatcacttcagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacataaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgagttatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatttttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttggtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactatta

SEQ ID NO: 712566 - DNA, 3546 bp, Homo sapiens
  misc_feature (8)..(8): n is a, c, g, or t
  misc_feature (3290)..(3290): n is a, c, g, or t
agcggagnagcctctgctccaccgcggcgagaggcatgggcacgtggctgccgagggtggccgagctctgggaagaaaagcccgtgtgcctctgcatagcgtcgctacagcgctgactcggtgtggattgattggaaaggtttgagggagtacttgggaagcatggtggcacatgatgagactggaggtctcctacctattaaaaggaccatacgagtcctagatgtcaataaccagtccttcagagaacaagaggagccaagcaataaaagagttcgacctctggctcgtgtcacgtccttggcaaatttaatctctcctgtaagaaatggagctgtcagacgttttggtcaaacaatacagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggcaatatatgaaatgtcccgaggtgaacaggatttaattgaggatctcaaacttgcaagaaaggcctaccatgaccccatgttaaagttgtccatcatgtcagaagaggaactcacacatatatttggtgatctggactcttacatacctctgcatgaagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacataaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgagttatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatttttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttggtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactattaaaaaaaaaaaaagcacacacataatcaccctgaaggtttcttgcctggtggctnctattgttgggggcatttggcaaaatatgctggtgtggcaaaggaggtagtggtaagcctcataaaagttagtaaaaattgtagttcaacctttgaaatcattgatgaatcagcgaaaggtaggtaagtcttgtgttaggaaatcttttaagaacatggtgtaatccagacacagcaattggtattgaaaataactgaacacctggtaccttcctggataggatagtaagggtagtagtggcaaggatcctgatta

SEQ ID NO: 712567 - DNA, 255 bp, Homo sapiens
  misc_feature (15)..(15): n is a, c, g, or t
  misc_feature (37)..(37): n is a, c, g, or t
  misc_feature (48)..(48): n is a, c, g, or t
  misc_feature (81)..(81): n is a, c, g, or t
  misc_feature (162)..(162): n is a, c, g, or t
  misc_feature (179)..(179): n is a, c, g, or t
  misc_feature (195)..(195): n is a, c, g, or t
  misc_feature (210)..(210): n is a, c, g, or t
  misc_feature (218)..(218): n is a, c, g, or t
  misc_feature (228)..(228): n is a, c, g, or t
  misc_feature (248)..(248): n is a, c, g, or t
gcacgagctcgtgcncaacagggcctgagatttcatntgctctccttnctggagcccagaggagggcagcagaagggggtngtgtctccaaccccccagcactgagggacgaccggggctctcctcatttcacccctccctttctcccctgccccaggactnggcacttctgggtgggncagtgggtccagattnggctcacactgagantgtaaganctacacacanaatttctattaaattaaatnttgtgtc

SEQ ID NO: 712568 - DNA, 3180 bp, Homo sapiens
  misc_feature (2)..(2): n is a, c, g, or t
  misc_feature (16)..(16): n is a, c, g, or t
  misc_feature (483)..(483): n is a, c, g, or t
anattcggaacgaggnctgaattacaattttcagactgagttactttttaaaatgccgttcaaaacatcaaataatgtaattatcagttgtatataattttcctttctcgaaggaatgacctctgatgtttgctggatgtttttaggcaatatatgaaatgtcccgaggtgaacaggatttaattgaggatctcaaacttgcaagaaaggtcagtaaataactttttatcagatgccctagtttttaaaaattacatttcacaaaatctaaaggatagttttcttaacctttagaagtagaagaatagaaaatatctactggtgaatacattttttttaggtgaggtctagacacatcctcaaatacaagtattagtaagagagtttatttggggattaatacatactaatttattttatgtgtagcaaacagaatccacgctagcttttatgtaattaattctctttgattccaagtatagntccctcatgttttcctcacatgatctctctgtgacacatttctcccctctgacaggcctaccatgaccccatgttaaagttgtccatcatgtcagaagaggaactcacacatatatttggtgatctggactcttacatacctctgcatgaagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacataaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgagttatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatttttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttggtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactatta

SEQ ID NO: 712569 - DNA, 1142 bp, Homo sapiens
  misc_feature (4)..(4): n is a, c, g, or t
tgcncggcccctcctctcctttcgtgcgtggggtattttaaatattagaacccgggcacggccttctctttttttttgtatgttgtgtgaccgcctctttcctgatgtttggtgttccttcctcgtggagttggattacctctcccttgatccacccccgcgcttttgttttttgtagtccccctccttctcattttgtgtgttagatcactcgctgtggcgcggcctcgctgttattccattcgatccgtctctcgcagaggatgttttttatgtcttctcttgtggctccccgcggcggggcgggagttattatcacactttttttcatcaccccaacgcgaggtaactcactcgattttttttgtgcccccttctttgggcccgcgccttttttatgttggggtagcacacactcatttttatgacacacacaccagggtttgtgtgttgtccacacacaaaatagaacccgcttgcttgtgttttatcccgctcttcctctcgagatttatttctccgcgccgagttatatcatcgccgcgctttcgtgtagagtggggcccccccccctctctacatgggagacttctctctgtggtgggtgatatcacacctgtgtggcacacacacacagtttggttttttctctcttctagattttttttcattacattgaatacactccactctctctcgcccacacctctttttatacacctctgcggggttgccatattttacctctccttacagagacaacctctttttttagacaattcatctttttttctcgcgcgagttaaatacaccacgacattttttgtgtgaacaacaaacacacaggaggtggttgacactttatgggcgcccaataggtgctccacaggagtgtgttagaacccctggtgtcacccaggccccctccgtatagataccaagaaggagaaagaagaaagaacacttccctatgctggggtggtttcctcccccatacattaatgattcccccccccaccattgatttctcccctcttccaaatttcccagttgacccccttataaaaggggggggccttgggggcccccccttttttgtgttgccccaccaaaaaaatccccgtgttgttttcacacccaca

SEQ ID NO: 712570 - DNA, 330 bp, Homo sapiens
gggcccacttggaggatgaactgttatctgtaatggacagtaacgcccgttctcctttggtgaaagtagatgacaggtaggtgtggtctgtgtggtcgctggaagtcctttgttcaatagctgtgccacgcagttgaccgtagctaatcccagcgactccgagtgcactggaggcggccagtgaccgtgagaccaggcccatgtcgtccgtcacgtttacgtgcagagaggcaccctctgtttcttggtgcatggccgctgcagggctgcctgcttccccagaagtcgtgctcatgctggtgttggtgagggtgacagaccgcagtgtgc

SEQ ID NO: 712571 - DNA, 418 bp, Homo sapiens
ggatgtgaatgttgctacagcagtgtgtgaacggtgcagatccccggactgtacttgagtctgcgatcgccctcgcgattatatctgcgcttggaacctgcgggaccatctctttaggccatctcctgcttctgtgacctgccagcaccgattgtgtggttagcttcttgttgtcaccgaccatgagctgccagattcgccagaatcattccaccagcgtggaagcaggcgataacaggctggtcaatttgtaccagctgtcctgctacacctacctctctgtggggtgatatttcaaccgcgacgatgtggctgtgcaaggcgtgcgccactacttgcgtgaattggccgaggagaagcgcgagggctaggagcgtatactggacgcgctaccagcgagcgggtcgcgctctattac

SEQ ID NO: 712572 - DNA, 206 bp, Homo sapiens
aacttacacttttatttatcaaattcacaaaattcacagtgatgctgactgtgtaataaccactatggggaaacatcccgtaaacctgcctgttgccatgccaatgaaatgactgaactggtgacatctgtttgaccatgctttgtgtggctggtagaatgccaccgtagtgcatacactttgtacctcaggggtcaagagagggt

SEQ ID NO: 712573 - DNA, 302 bp, Homo sapiens
  misc_feature (3)..(3): n is a, c, g, or t
  misc_feature (45)..(45): n is a, c, g, or t
  misc_feature (113)..(113): n is a, c, g, or t
  misc_feature (127)..(127): n is a, c, g, or t
  misc_feature (139)..(139): n is a, c, g, or t
  misc_feature (204)..(204): n is a, c, g, or t
  misc_feature (265)..(265): n is a, c, g, or t
tantacccagctttctttttaatacaaatgttatttatagtttanaatgaatgcactgcataaaaactttgtagccttcattattgtaaaacatattcaagatccctacagtnagagtgaaacattnacaaagatttgncgttaatgaagactacacagaaaacctttcctagggatttgtgtggatcagatccatatcttggnaaatttttgagttttacattcttaccagaaaagtcccatttaaaagtgatcatttgtaagnccaaaatataaataaaaagtttcaaaaatctatctga

SEQ ID NO: 712574 - DNA, 182 bp, Homo sapiens
cagccaatctgatgtttgtacgtccagttgtcccctcttctagacacattctaatggccgatggtgatagctgtggtttatggtactgaggctctaaactcgtaagaagtttcgcagaccttacatccagtaccctgatgctacagacgaggacttcacctcacacatagttcagcgtctga

SEQ ID NO: 712575 - DNA, 263 bp, Homo sapiens
gagcccagaacatatcccccataaaaaagtcaccccaacaccgtatggtcctcgaccacagtggcatcaaataggaaaaaaatgacaggtacgcacctgtagttcctgctactagggaggctgaggtgggaggctcgcttgaggccaggagctcaagaccagcctgggccaacatggccagaccctatctttgcatatttgcaatatatatatctaaacacatataggcaaggtattcaattgaacacatttccatcgattcc

SEQ ID NO: 712576 - DNA, 158 bp, Homo sapiens
attctgttcattcaacatacaactttagggaatggaagtaagttcatttttcagctgtgttgtcagtaggtccggtgtctagggtagtgaatcctgtaagttcacatttatgattaggtcacgagttgacattgagattgtccttttccctgatccaa

SEQ ID NO: 712577 - DNA, 662 bp, Homo sapiens
gtttttcattttaatgaagtctaacttataaattttatctttttatggttattgctttctgtgtcttgcctgaaaaaaaccactgcctactccattggaggagatagtctcccttttttattttttgtaagaatttgatagttttagcttttaaatttagatctgtaatccacttgggttaatattgtgaatggtgtgaatagaggtcaaggatcttttttttttttccaccgggataaccagttcttccagcatcatggttgaaaacatttcctttccctatgggattgcccttgggttccttgggccaaagatcagatgaccattaaagcgtggggtctatttctgggactcttttcggctttccacaagatctggttttgaagatccctggtgtgagtaccacacggtctggattgctatagcttaatagtgaagtctggaaaccagatagtataggtgctccaacgcttattcttctcaggatagcttgggatatcccgaggttctgggggttccattgtccaaccagtgggggttctgaagaaaagcgggcgggatcatgatcgcagcgcatcaccgctgtcaacaattgccagattcgaacctccttacttgccgactgtgtagccctggttactctgggcaacaagcaagacttg

SEQ ID NO: 712578 - DNA, 346 bp, Homo sapiens
  misc_feature (63)..(63): n is a, c, g, or t
agctggcaaagagagccaccttaaatatccataggctgaagttggaaagaagggaaacacccnaacttattccttaaagaaagtactttgcccccaggtactgtggcttaggccagtaatccctagcatttggggaagccaagttgggcagatggcttgaaccccaggatttcgagatcagccctggacaacatggagaaaccccatctctacaaaatatgtaaaatttaactgcttggtgggcctgcacttctggtcccagctattccagggctagggtgggaggattgtttgatccctggaggtcaaggctgcagtgagccatgatcacagcaatgcgctccag

SEQ ID NO: 712579 - DNA, 235 bp, Homo sapiens
tacactcctcccacctccccacctttggactctccgatgtattattcactctctgtgtcatgtgtacacactgtttagcccccacttacaagtgagaccatgtggtatctgattttccatttttgaattatttcacataggataatgatctccagttccatccatattgctgcaaaagctgagtagtatatcacggtatacattacaccacagttttcttttttttttctttttt

SEQ ID NO: 712580 - DNA, 426 bp, Homo sapiens
atcatctgatccttacatctttgttgctactttttactaatatctagctccctatctttattattttaaaagaatatacaggccgggtgcagtggctcatgcctgtaatcccagcactttgggaggccgaggcgggtggatcacttgaggtcaggagttcaacaccagcctggccaacatggtgaaaccccgtctctacaaaaatacaaaaaaattagccgagcatggtggcacacgactataatcccaggtacccgggaggctgagacaggagaatcgcttgaacccgggaggcggaggttgcagtgagctgagatagtgccattgcacaccagcatgggcgacagagtgagacttcatctcaaaaaaagggagaaattatattgaggccagcctggacaataagaccacatctccaaaaggaaa

SEQ ID NO: 712581 - DNA, 123 bp, Homo sapiens
  misc_feature (77)..(77): n is a, c, g, or t
  misc_feature (91)..(91): n is a, c, g, or t
gctccctccgcgcagccgagccacatcgatcagacaccatggggaaggtgaaggtcggagtcaacgcatttggtcgntattggggcgcctngtcaccacggcctgccttttaactcctggtaa

SEQ ID NO: 712582 - DNA, 240 bp, Homo sapiens
ctatagagctagcaacgagagccagccacctgcagctggtgctgccacctacgtaaggctggagaagcaagtacacggccaaggcacaaggagcagcaggcacagacagaaagctctgccagctctatcctggaggcgctcaaggagaactacaaggtgcacccggcccacaaggtggccatgatcctggacccgcagcagaagctgaggcctgtgccaccctaccagcacgaggagacc

SEQ ID NO: 712583 - DNA, 149 bp, Homo sapiens
tgtgtctttcctgtatgactgtgaggctgacatcaatggctgcgcatgatgctggatgagctgacccttgccagtgagctgactggagatcagatctgaagtgcctgaagtgaagagctggcctacctgaagaagaaccaacatactgt

SEQ ID NO: 712584 - DNA, 120 bp, Homo sapiens
agacatagaataaagttaaatgtcatcaacagaggaatggataaagatgtgttatatatttacaacggaatattactcagccataaaaaacaatcttgcacgttcgtgacaaaacgggat

SEQ ID NO: 712585 - DNA, 126 bp, Homo sapiens
  misc_feature (16)..(16): n is a, c, g, or t
taaaagccagcgctgntttatgggtaatggggtaatccttctcaggttttccagtgaaaatggggacactaaaatactgagtctctggtcatgggtgtgacagtgcctggcacaggccctgtcaca

SEQ ID NO: 712586 - DNA, 158 bp, Homo sapiens
acgagcatgctgccttcaggcatctgtttaacaaagcacatcttgcaccgcccttaatccatttaaccctgagtggacacagcacatgtttcagagagcacagggttgggggcagggactgcttcagttgtcgacgcggccgcgtcgaccctcacgag

SEQ ID NO: 712587 - DNA, 792 bp, Homo sapiens
gacagagctgctgctgctagaagtctgtcaaaagacctagatcggccagaatctcaatctccaaagaggcccccatgtacgtgactttgagacccctatctggggcaacgacccctgccgaagggctgaccacagtggcactatctgtctctatcagtgaactgtgctgaagagctctcaacagacctgactgcccctgctgtcctgtcctgaggtgccccaaggtgagcacccccaccaaaccgaagacgatccggcacgccacgcagcctgtaccaggtggacgaagaggtggatgcgtgctcccacgggcctgcacgactattctcttctccaggcttgcagcgctgcaaacatgctgcacgcaaacgctgcaggtgcccaccctgagagctcatactgcaaccatgcgccatgtagatgccccgcaagcaaccccaacgatgcgatactaatgtcagatggcacaccacgaccatccaccacctgccgacggaatatggctacaccaactggactctaacccaaatacatatcactgcgctcactcgtccagcgacacacctagccctcccctactccacccacaggacctaacctgagacccacacaaccatacactcctgggacacgtatcacgccttgacgctggaccactcccgaaccacacccattggcacaacatcccactttagattaattactcgcacccaagacctgaccgacaccccatcccatgcacccacagcagcgaacaagtactccacatcagctctcctcacgctaccaaaa

SEQ ID NO: 712588 - DNA, 112 bp, Homo sapiens
tgtgctcccaccagctcactctctgtagtctatgaggaggatgggtccttcaaggagtatcgtttcttcgggcgcaatccagatgcggtaatagtagatacgtgccgttatt

SEQ ID NO: 712589 - DNA, 702 bp, Homo sapiens
ggccgcggacctggtttaggccggggccgcgataactagggaatcacggccagcgataaggagtgattgcccagtggccatgaagatccagttgctcaaggacatctagatcaagtccctggcggagaactatctctcgtccatggccattaaggaattagacaccatagatttcttcctggtggccatactgccggatcaggatttgacgcgtatgccagtgcagaagcagaccctggcatgacagcgtatcaggttcaaggcatttcatgttatcgaggactacaatggccacgtagatctggacgtcaaatgctgcaaggaggtgaccatcgccatgcgtggcaccatcattgctggcaaggtctacataggcaccagcgcagcgggtactagagtaaccctatcatgaatgcccgacacttgccgttttacggtgccaagccgctgcggttcattcaatggtacgcataaatccgttcacccaatgggactaagaattctattcataacctgctgctacagagctggtgatgagggatgaattcaatgaacgctacaccttaggccagttctggactgccacccttggctttgtcctacctttgacgacactcctaagtacttacagtacactggactccaacatttgtaaggatactgaattaacctaagactcctataaggcgttctgacgccccg

SEQ ID NO: 712590 - DNA, 451 bp, Homo sapiens
gaccaagatcacaaaaagaagccagttcttttctgctttctgttcctcgcctggagagagctctggccacttccattttctttctttctttttgaaatgaaggaacagagcttcaagttttcctttgcacaacagcccccaggagctttaaaacctactgatgcctcagccccaccttcagagattcggacttaattgggatggagtgggacttcccagggtattctaatatgccaccgaagttgaggaccactggcttgtcactgtgctatcttttccatgtttacctctaacaatgatcatggatcctttcctccctggctgagtgtatacagcctcactcagagactggaaacctacaccgaggccttttttgtttgtgttttcaatgtgttcattttatttatttatttgaagatactgctttttattacaaaatcacacagttaaa

SEQ ID NO: 712591 - DNA, 190 bp, Homo sapiens
ccaaccccatcagctcatgagtgaaaccgtcagcccttcaaatggtgtatgtatgacagcctattggtgccttgattccccaatttcactgatccgttcgtcagtgttattatctggcatggatgatttgccagaggaaactaaatagttccatataaatttaacttttaatacatgtttccaattgcta

SEQ ID NO: 712592 - DNA, 128 bp, Homo sapiens
tcaccctcatgcgttcctggagctctgaagaagctagcccagctgtcagatttcatcctagctactacagacgacaggattggagttgctgttgatcggggtcctgcgagcactgttcagaccaggag

SEQ ID NO: 712593 - DNA, 826 bp, Homo sapiens
actgtactgctgccatctcggctcactgcagcctccctgcctgattctcctgcctcagcctgccgagtgcctgcgattgcaggcgcgcgccaccacgcctgactggttttcttatttttttggtggagacggggtttcgctgtgttggccgggctggtctccagctccgaactgcgactgatccgccagcctcggcctcccaaggtgccgggattgcagacggagtctggttcactcagtgctcaatggtgcccaggctggagtgcagtggcgtgatctcggctcgctacaacctccacctcccagccgcctgcccttggctcccaaagtgccaagattgcagcctctgccccgcacccggtctgggatgtgaggagcgcctctaccacagccgcgacccgtactgggaggtgaggagcgtctctgcccagcgccccgtctgaagaagtgaggagacctcccgctgtcaaccgccccaatatgacacgctgcaggagcacctccgccggcacccactcagtctgcgcaattgacgaccgtaatctgaccggggaagcctacaccatccccgggacgcgacggacagagcacgcgacagccccccccgcaccggaggccgacgccaccacacacgctagcaacaacgaccaacaaccgaaccacacaacctcacacccacctacaaccccacattcacccacccccccactcacccccaccaccaccacaccccaacaccacacaaacaccccccactcgcactccacccaaccacacacaacacccacaaccacccacccacccacaacccccccacccccccccc

SEQ ID NO: 712594 - DNA, 247 bp, Homo sapiens
aaagatcgagagaggagcagaactttgtgggagcagatgggtcagataggataaaatatgcagagagagatgttcatgtgggcaccatgtcccctagcacttcataggtaaaggacctgaaaggacccgtcctgtttatcttttcttcaagcaaaaagaagaagcagagctgtagcgtgaagtcaccttggcctggctgcctggcaggcagtgaatagggtatctcccttgatgagcactgaccgct

SEQ ID NO: 712595 - DNA, 1463 bp, Homo sapiens
  misc_feature (564)..(564): n is a, c, g, or t
ctcgactgaatgagctctgctggacgcatatccccaagacagcaaccaatcagagagatacagagaccgattatgcaagcaggtacaatgaatcgcatgatgaatgcactaggcacatacacgatcagacgatcccatcgtgtcatccagcaatggcacctactatacaacaaacagaagcatatatacaacagtgatgatgagtcatgaccacacccacagcactgacctgtgaacactaactgatacccactcaaccgattatactgactgtgatactacgcatatgactgtgcttgtggactacgcacaatcactgtattacatatactatgttctatattgaccttgacatgcgacaaattaagtacaccccaccgcactttgattgactatgacactggacaacagacatctaccttggagcacgtacctaacatagttactttctatctacgatctgaccaaatcgatgatcgaacagagaacacatcacattacacacggagaattaacattattgtcgacgtcacaaaacagataacaagaacaaccgtggatagncaccacactggctaacttaccagattggagattgatagaaacgatgagaacagccaacagctaactgtagaccgctacaacatacaatatgagatatacattggcaccgtacgcactacgttgaccacacataccacttacattgaacactagaacatcaggcaatacgacgttagcggaatactagtacctatatattacacttacatgtaacaacctgggaacgaacacacgtgtacaactaagatgtgcagatagcacgaagcttggactagggacccaagcaacggacgacgtagtgaatccacggagtcacaatgtcgccttagtggtgtgcaacagacacgcgtgacaagtgaatgttcactagcaacactagagtgttgccattgacaatagggagacacgatttattgcgtcctaagacagcagcgttgactaggaaccacaagtgtgtctccgcagaacgatgtccgaagcagcccagtactagtagatacagtacacaacagcgtgtggatagtgtgacgacatggttcgccatatcgcagactcagtaccattggcgggcttatctgactcttcactgacacgctgtgtctcctctataagagtcctagactagcatactcatgtgccgaatgtcgtatctcttacgcatagagcatgtagatctcttgatatcctagaactgtcagcatcctgcacaagtatgatctatgtacatgtggacactacgctgatatgatacacactaatatacactacaggttgactcgtacagctgacagggtactgagctacgctcgtctctacgctatctctgactaagactagcgtgaatatccacttggcctacatttctcgttcatcgtttcacttactggcatcacacttcc

SEQ ID NO: 712596 - DNA, 407 bp, Homo sapiens
ttttttaggatcccgtcatgggggaaggtcctttaaattatgctcaactgtggggcgggcctttaaaatgccccatactttgggggtttcaaaaatggaacccccgttgtacaggggttgggtgggggttgcaggactcccctcccaagcctccttatgtcaaggacagggggacaggggtggcctcccccagtccccaagcccccctgtgccttgttgtttgctggggggccatagctggccctgccccccgtaaaggccctcgcccattttcccccttcctgtacccctcggggccagcatcctccccttttttaactgaccagtgggggtttctccctgctgccaggtccttccccttcccggggggtttttgtgcccctgaataaagttccccttttttttca

SEQ ID NO: 712597 - DNA, 108 bp, Homo sapiens
cggcctactacaggtgtagtctcttctcccgtctcttataagtaccctggtatactggattcagcgcctatctagttagtgcaggatgtatcccatctgcaagatcct

SEQ ID NO: 712598 - DNA, 868 bp, Homo sapiens
  misc_feature (867)..(867): n is a, c, g, or t
tgggtagagacagggtcctcaccatgtggtcgccgggctgtggttccttgaactccttaggctcaaggtggcagtcctttccacctcagccctcccaagggtgcgtgagatttacagactttgagccgcggagtggcttggccagactcttattttttaaatggccctaccttagtggccaaaactttgggagtgccataaaagtggatctcaggagagctatgatgccgtgccaattaagagctctacttttggaattaaatcagatacagtagggggtttcccttaagttcaaaatatgggccctgtccatgttttaaaccctaccttggagtgttatcttacatagacaatagccagtggtgtatacgcttttctctgaaagattctggtatcctctccggaagtttcttctctactcttggaagtgtgagctttcattagccccaaaaaattcttgggcgaaagggactttaatagtacttacggcaaagggtaccatattattcctggactttgggcaagaaattcccttccataagagtcccctcgggttgttccttcttctttttcaccgccttgaaattgcaccacagatttatattatgtccccttcttaactaggagtctttggttatttctcccagttaatagttcacccagtgacggagggggacacgccgtgtacccacattggaacgcgagggaggacccgagcgggaacacactccgtgagtggaacgttttgaaaagacgggtgaggacgttcacatttgagtgggacatagtcacgcggcgtatcggtgacgatctggagaacacaagaaaaagagcaccaaaagcggagagagtgtatgccatcgtccna

SEQ ID NO: 712599 - DNA, 347 bp, Homo sapiens
tgaggagacaaagtctcactctgtcgcccaggctggagtgcagtggtgcaatctcaactcactacaacctccgcctcccgggttcatgccattctcctgcctcagcctcccgagtagctgggaccacaggcacgcgccaccaagcccggctaattttttgtatttttaatagagacggggtttctcagtattagccaggatggtcttgatctcctgaccccgcgatccacctgcctcggcctcccaaagtgtcgggactacaggcgtgacaaccgtagcctggcccaaaaacaggatttttttggtacatctgaaacatgataacaatagtaaaatcgctgtcgacg

SEQ ID NO: 712600 - DNA, 417 bp, Homo sapiens
aataccccattggtcggcggccaagagtcaccgtgcatagtctatcacgaggtggcaccgggcggcagctgtcctcacaactgcggcgtgtacttcaccacagggaatgggcacaagcttggaagattttcggctttgtgatcctcagtgtccagtgtcacccagatgggccggaagctgcctttgaagccaacgaatgccatttgctctttcaacttgagacccctgtctgcccggggcttttccagcactctggtccatgggcctctggagacgtatcttccctttgatgccataagcactatggaattgtcagggatggtcgccacatagttcaaaagctgccatggtatgccttgcagaatggagttcctgaagctcgtgtggctcaccacgcgcccttggttcccgtcaatc

SEQ ID NO: 712601 - DNA, 566 bp, Homo sapiens
agcccctcgcgttcccgacgtgtccgttccccccgtgccgtcgttcgtcccgccaccgacgcgcctggcttccgcaggccgtattccaccgaggagaaggaatcgtatcgtatgtccgctatccagaagctccactctttcgaccccttgctgatgcaagtaagggtgatgaccctgctgtcctgctggcacgtgaggattatatccatataagaattcaacagagaaacggaggaagacccttactactgtccaatgggatcgctgatgcttccgatcaacaagaaactagtgaaggcggtccaagacacaacttaagcctgcactgtggtactgtcattgagcatcgcggactcatgggagaagtaattcagacccaccagcggctcgacccaaccgcaagacacacatgccatgcttcctccgtaacacattcgcacttggctacggacgatcaagctgaaggtccaatgggttttccatgtgctatgtggatcacttgacgcttaaactgaggatttcctctgtcaatcgcagtcagactctgcccttactcctcccttgct

SEQ ID NO: 712602 - DNA, 159 bp, Homo sapiens
cccgatcacgcagactggccaacgtggtgaggctcatctctgctgaaaatacaaaaatgagtcgggcgtggtggcagagacctgtagtctcagctgctcgggaggctgaggcaggagaatggcttgggcccgggagctggatgttgcagtgtgcttccg

SEQ ID NO: 712603 - DNA, 215 bp, Homo sapiens
tggggcagtggccctgacctgagacctgggcctggctcccacgtccatgagtgtatttcttacacctgccatgtcccggcccggccgctgtggagcccctgcttcatttgcacgtgggctacgtaggacgacaacccagattctgtgagtgttacgacaagcgaacgccgcgaagtcctgagggacaggagccccctgggctgccagttggataa

SEQ ID NO: 712604 - DNA, 500 bp, Homo sapiens
agagagagagagagagagaaaaaacgagaggctcagagagaacaagctactggcctgaggacacacagcctccacttcctgggctcaggtgatcctcatgcctcagcctcctatgtaactgggactacaggggcaagccaccatgcccagttaattttcttttcttttttgtagacatgaggtcttgctatgttgcccgggctggtctgaatctcctgggttctagtgatcctcctgcctcagcctcccaaagtgctagaattaggagtgtgagccacggtgccgggcctatggagtttttcttgaggttgggaaggacgtctgtttcctctccctttccctgttctggagctttttcactgctgtcctgacctctgtctactcctggttggtcacgggacattggtggctcaggagtgttggggacactccattcctttgagagtgtgggctacctgtagattgactggctgacttgcaaaagcttccttgtgattaag

SEQ ID NO: 712605 - DNA, 467 bp, Homo sapiens
  misc_feature (93)..(93): n is a, c, g, or t
  misc_feature (162)..(162): n is a, c, g, or t
tactccagcctgggcaacaagagtgaaatccgtctcaaaaaacaaaacaaaacaaaagaaacaaaaagtgtgcggttcaagctgggtgtggtngtcacgcctgtaatcccaacactttgggaggccaaagtggacggatcacttgaggccaggagttcgagnccagcctggccaacatgacaaaatcccatctctactaaagatacaaaaattagcaaggcatggtggcttacacctgtaatcccagctacctgggaggctgaggcacgagaatctcttgaatacagaagacgaaggtggcagggagtcgaggttgcgtcactgagctccagcctggcaaaaaaaaaaaaaagtatacagtttagtgattccagtatattcacagagctgtgcagccatcaccacagccagacataggacaccccagaggtaccaggtgtccctcagctgttgaccccccaggatgt

SEQ ID NO: 712606 - DNA, 179 bp, Homo sapiens
  misc_feature (35)..(35): n is a, c, g, or t
  misc_feature (56)..(56): n is a, c, g, or t
  misc_feature (114)..(114): n is a, c, g, or t
  misc_feature (166)..(166): n is a, c, g, or t
aggagatccgcatgttgaagaaggtcgtgtcggtncatccgggagatgtgctcatnacctcctgcacgtacaacacggaagaccgggagctggccacagtggggggcttcgggntcctggaggagatgtgtgtcaatacgtgcactactacccccagacgcagctngagctctgcaaga

SEQ ID NO: 712607 - DNA, 276 bp, Homo sapiens
cccccccccccctttaagggaaagggccttccccgaaaaaaggggggtttttggttttaaaccaatttttttttaccccacgttgggggaaaaccgggggggccttttgttaagggggaaattcttggtttccgggttttttttttgggggggttccccccctggggggggaaacaattttccccggtatttttttaaccgggggaaattcccccccctttggggggccttttttttggggcctttttttccccccacaattttttttttttttta

SEQ ID NO: 712608 - DNA, 174 bp, Homo sapiens
  misc_feature (63)..(64): n is a, c, g, or t
  misc_feature (99)..(99): n is a, c, g, or t
tggggcagcacccagccccacaccaggcaggaggccaccgtgacccgggcaacggcagcatcnnccagtctcaccaccggcatccgggggccgctctcnaaaaaagaacccaggacattgaaattaaggcccaccccaagcccagaatgacctcgcaagaccccccactccacg

SEQ ID NO: 712609 - DNA, 619 bp, Homo sapiens
gaattcactgggcgcatcttacaagtaatttttggattctgcattgactacctacaagtgccttctgggtgcaagtccacaggcaagatttgttctgcaaatcttccatgaccaaggtcacctctttggattggcagacccagggagtccatattgggaagataaattcacacttcaccccttgttgagatctccatccagccttgctcctctgataaccagtttttggcatctcagatgaggaagagtgatgggcgacaggtgatggtgacaactattaataagatctgaaagtaaacagtctcatgaaaggtggccaggagagggcagtcaccttttatcaggagcacagactgaatttgcaaagggtcctacaggtatggatctctggcagctgctgttgaccttggcactggcaggatcaagtgatgctttttctggaagtgaggctctgaaatacctacttccaagagaacgaaatttattcaagaaatgttggatggaaattgaagagtgagcttggaaacgagacacagagtggcaggagcccagaccaacctgtttatgaaagatgcctttgcccatagagggaaaaatacaccttaaaacctcaaaaaaa

SEQ ID NO: 712610 - DNA, 368 bp, Homo sapiens
  misc_feature (1)..(1): n is a, c, g, or t
ntccgcagtatacatgcgcaatgtacccatcagctttccacatataagatgcacagtgggtatgccacccttccatcttccgcgttttgtccaaatagattctttgggattgttgccaatggcccaaagtcaaatgcaagtcctgtctctcctagagatgcggtacacgcccttcttttattgagaactagacttccctctccggcttctgaaagtattgtcacgtaagtgggtgtctccggctcacgtagtgagtaaattctgataccgttgtctgatgtcaacagcaaagtgtgaggatccaggatttcacgtgtataacatgcagcatgttatagagtcagagaggtagaacttgtaaaatatct

SEQ ID NO: 712611 - DNA, 229 bp, Homo sapiens
tccatttgacttctctactggactcttgagtactctcatccacgggtgattgtcagaataagtgggtctgtggggagcatgacggctgaaaactcctattcctatcttacttgtattacctcaaagccttccaattttagagaaaaaaatattttcaacctagaattttatacctagtcaaataatcaatcagaaaagaaaaaataaaaacctggcctcggtgacctca

SEQ ID NO: 712612 - DNA, 1003 bp, Homo sapiens
agtactgggactacgggcgtgcgccacaagcctggctaatttatgtatttttttagtggagacggggtttcaccatgtggccaggctggtctctgacttctgacctcgtgatctgcctgcctcggctcccaaagtgccgggatgtgccatgcactccagcctgggcgacagtgtgagcctccatctccaaaaaaaaaaaaaaggtgggtttataagccggccttctttttcttattcccagggctcttaaagttccgtacagataaagggaagagatcccagttctggataacatatgaggaagattcctgagttggtggctccagatacgaaattgatgtgctggactcaactggggtattagtcctgacctggcttcctggaggacttggtcaggtactggcttctccgagagggccccaagtgtgtgcggcgggtgggagggattgggcccgggaaactggtgaaaggcccggtctcagcggggaccctccatcagaaaaaattctcattcttcgagggccatgaaggggacatgacatggtggagatgcctgggacccaagagaactcaaagaagaggcaagccccagagatggcaactgaggatggccacctggtatttccctgggcccctcatcatgaagggcatctccaggggcgggacacatggccggtcatggggcccgatacaaaaactgttcctggccacgaaagcgaggtggtcgccgacgatggtggtaccacaatcaaccgggagcgggtcagaacagggggggcaagggaggctgtgctatggcccacgcatggcaaggctagcagaaaaccgggcctgggaatcaccctgaggatgggcattaccagaaaccccatagcctaagttggacataggtgccggccgacagccttgggcttggtggacagcatgcacagagacacacgagagtggacacatgcccaataggatatccacgacataagaaggattgagtaccaccaagacg

SEQ ID NO: 712613 - DNA, 489 bp, Homo sapiens
agcaatgcaaagtgtatttgctaccatagaaaaatggttatacaagaagcaacttacaacactgcaaatatagtattcctttttttaaaaaaagttcatattcatgtgcatttatgtgaatgtattacataagaaaagttcagaagtcaaaaccttcacaaatacctctagattttgtgaattgaaaatttaaaggcaccaaccactacagaattaaaaataaataaactaacattttataacccaactttctggtcaagttttgcagcatctattatttaccctccctccccaaaattcttgagatattgtgatactgtaaactgaatgaatgtttaatataattgtacatttatcaccagaattatgaaatcagaagtgaaaattttaataggtaacttgcttgacactgaatcaatttttcccttagttaatgttccaacttgtatcatttcctttattacaaagggaacgaattcttcatggcca

SEQ ID NO: 712614 - DNA, 234 bp, Homo sapiens
tccccccccaaaaaggggtttttggcccccccccccccccccctgggttccaaggggggggggggccggcccgctccatccctttttcttgggggatttctttttcccgggccccagcccccccccccccccccgggggtgggggaaaaattaagggttgggtgcccttcttttgcggggggctttgttttttttttttttaaggccccccaattaaaattaaaagggtcttta

SEQ ID NO: 712615 - DNA, 185 bp, Homo sapiens
aaaagccgatttctaggggagacggcaataccgggtgaccgggcacagatgaataggcaagcagatcagaaagagatcttaatacatggtgaatagaggtcctgatttctagagagatctccaaggtggaattattaaaaccctcacatttacctcctctgggagctctgtgggagttaaacagc

SEQ ID NO: 712616 - DNA, 408 bp, Homo sapiens
gggagaaaatccgatcctgtgctctgtcaaagagggcgccactcactcactcactcggctcccaccaaggaacccaagggtgaaacgaggagggagacgggagaagagatgcgggacccggggtcaggcccagcggctgggattacaagcaagccctatgtgacatacttcctggcccgcccccagctctcgctctcagacgctcagcttagctgggactcggtgtcccactgtgatgcctctgcatggggtaccaccacaacccgctcactgcatgatcctgcgcctgtcaagtcccacctcacctttagggaagtggactctggccctgagggcctgtcctgctctgtgcacctgcccgcccggggtgtcctttctaccacagcatttctcacacggcatcacaat

SEQ ID NO: 712617 - DNA, 631 bp, Homo sapiens
cctggaggcagaccaagtctggacaaccctgcgagtgaccctgaagaaatgaaagccctgctccagtaacccagaagctgactgggtccacgcacagcctgaagcatgaggaagctcattgtgggcttcatttttcttaaattttggacttacagtaagggcttcaactgttcttactcaaactggggactattcccagtgtattcatcaggtcagtgaggtaggacagcaaatgaaaacaatctttctgttctatagttattatcaatgtatgggaacgttaaaagagacttgtttgtataatgccactcagtacaaggtatgtagcccaggaaatgacttgacctgatgtgtgttataaccatctgagcccctacaacaccagtttgaattagattagaactggcctttcctaggtgataccagtgaattactactagaacgagaaagggatcccaaacagtaactttaagattggacgcttgtgcagcttatagtaaaggcgggacggtgtggtccttaatggaacgagtagagtaaaacaaatctgctgagcggggtggcactggcactgccgtttaggatggaacgaacagggtttcgcaagaagccctcgtgcgggcacaaatcc

SEQ ID NO: 712618 - DNA, 321 bp, Homo sapiens
gttttttgcactttttaagttccgaaggttatttttttggaaattgaaaaaggtttggtgggccggcttttattccttttcccccaggatttacctcggattttttttaatcttttgggggttgcccggttcccggtttcctttataattggcttttccctttattaaaggaccttattcttggtcccctttttttttaggtggtttgaaatggttttttatccccgctttaactttgtttgcttggtacttttcttgtggttacaaatttctttggattgggggggccaccattaattaaaaattcccctccccccccca

SEQ ID NO: 712619 - DNA, 447 bp, Homo sapiens
ggctgtgggtccaggaggcacgaagtcggaggtgatctcaccatggcctggagtctcctcatagcttctgcgcactgctcttcacttctcatgacgacaggacctcgtgacgagccatccatctgaaccttggacagcaacacaatcactcgggtgtgatgcacctgtatcaccgcagaggatgagcaccggccgaggcagtcagccctgttgctggcaggatgccatgtgactaaaaggcacatatggctgcattaggctaactcagaagcaagtcgcaggcccagtggccacctgactttgagttattctacgagagaatctgcagaggccgctcatgggactcccgtgcgctgatttgtctggctcaatgcttcatgggacaataaggtgcacgttggactcaatcagctgtgattgtccaggcaccgagacgcatgacggctg

SEQ ID NO: 712620 - DNA, 618 bp, Homo sapiens
  misc_feature (520)..(520): n is a, c, g, or t
  misc_feature (526)..(526): n is a, c, g, or t
  misc_feature (528)..(528): n is a, c, g, or t
  misc_feature (530)..(532): n is a, c, g, or t
gcggccgctactactactaatcgcggcggtcgacctcgtagtaacagccattctcatcccgacccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaacctcattcacacgagaaaacaccctcatgttcatacacctatccccattttcctcctatcctcaaccgaaatcattacggggttccccctnaaacancncnnnggggccgctcaaagtcccgccggggccacattcgcaccgcatgtggtagggccaagggtgtagccgccggctgaccgacggaagta

SEQ ID NO: 712621 - DNA, 514 bp, Homo sapiens
ggtcgctgcggtgttgctgttggcagactcgattgttgcgtgacagcgaaatgaacgataatcaagaatgccggagcagacgatagtgagccgttctccaacccgtttgtgcccccgactggcgcacgaatgatggtatgatcctcactccgttccactcaaatctaagaatcgtcaccagaatgatagacgttcagtgaaacttctcatgacccccagggcttgctcctacctctgcgaccatgcttctaagttcacgtcaccatgagatgccaagggagtacaaatgaggactgaagacccagtcgtgcacgaaggaggaccaaagagaaagttctctatgccaagctacgccgaacacaccgaaagttgagagcagagagagagctagcagagaagtaccgggatcgtgccaaggaacggagagatggagtgagacacaacgtattatgaacgacacaccgagcttatcagtcacacagactaatctatacggcgctgtaggccccacatg

SEQ ID NO: 712622 - DNA, 142 bp, Homo sapiens
gtaccagcggcaggttcagctccatgataacctcttcagagagaccctccatgatgcttgacaatgccccgtgagactgttgccatgggctgcaatcgagtacacgtttcccctccgttgatctgggggacacgaatgttca

SEQ ID NO: 712623 - DNA, 173 bp, Homo sapiens
cattctcaaccccctgacaaaacacatagcctaccccttccttgtactaccctgcattaatcttaaaactaggcggctatggtataatacgcctcacactcattctcaacccctgacccccatgcctcaggatactcctcaatagccatcgctgtagtatacccaaagacaca

SEQ ID NO: 712624 - DNA, 306 bp, Homo sapiens
cacgcgtcgtgcacttgctgctgctagagcgctgagcactggcccgaaagaaagcaaaggagcagcaattgtgaagtaagagggagaaaagtttaccgatccttgaggcataatttcatattttttttaataggattgtgtaaagatgtcatctgatagcttccttgcaccttgaaaagattttcttttccttgtggatgatgcatatctatgttgtaaaatgacctcttcacgtgccatcttctgtgtgtaacatattggtgttttgacacgtcatctggtttgaaaaatcaggactcaggctgg

SEQ ID NO: 712625 - DNA, 1844 bp, Homo sapiens
  misc_feature (1746)..(1746): n is a, c, g, or t
  misc_feature (1752)..(1752): n is a, c, g, or t
  misc_feature (1754)..(1754): n is a, c, g, or t
  misc_feature (1756)..(1758): n is a, c, g, or t
ctttccagagtaggtagagggatgatgctaataagtaggctgtgggtggttgtgatgaccccaattatgtgttttttggaaagcatgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaacctcattcacacgagaaaacaccctcatgttcatacacctatccccattttcctcctatcctcaaccgaaatcattacggggttccccctnaaacancncnnnggggccgctcaaagtcccgccggggccacattcgcaccgcatgtggtagggccaagggtgtagccgccggctgaccgacggaagta

SEQ ID NO: 712626 - DNA, 226 bp, Homo sapiens
  misc_feature (69)..(69): n is a, c, g, or t
  misc_feature (128)..(128): n is a, c, g, or t
  misc_feature (166)..(167): n is a, c, g, or t
tggagaactctgctaaggcagtgcggaagggaaatatggggtgggagcccccacacagagtccctactngagcattgcgctagtggacgctgtgagacagagggccactaatcgcgttataccccaangaatgatggatccacctgacatgcttgcacttgtgcanncctggaaaagccacatgacacataaacaccatgcccgatagaaagcaccacagtgaggg

SEQ ID NO: 712627 - DNA, 1795 bp, Homo sapiens
ctttccagagtaggtagagggatgatgctaataagtaggctgtgggtggttgtgatgaccccaattatgtgttttttggaaagcatgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcattctccaccccttgacaaaacacatagcctaccccttgcttgatctatccctatgacgcataattgttacaagatacatctgtctacgacaatacagacctaatatcgctcattgcatactcttcaatcagccacatagaccttgatgtaacagccattctcattcaaacccgctgaagctttaccggtgcagtcattattatacatcgtccacagacttacatcctgattactattatgactagcagactcaaactacgaacgcactcacagtctcatgataatacactctcaatgactctaaactctactgccacttataactttt

SEQ ID NO: 712628 - DNA, 220 bp, Homo sapiens
cggagaatcagaaccactcttcgctgccggacagcgatggcactggcgggccagcaggaacacgcctggcttcaccatctgttgccgagtgcagtgtaggccgacaccggcgtcggtgcagccatggtgtgtggcagccagaagtggaaggggaattgcgcgcttttgttcagggcgccgatcagcaccagggcgagcatagatcgggtaccagcgaatg

SEQ ID NO: 712629 - DNA, 1907 bp, Homo sapiens
  misc_feature (1809)..(1809): n is a, c, g, or t
  misc_feature (1815)..(1815): n is a, c, g, or t
  misc_feature (1817)..(1817): n is a, c, g, or t
  misc_feature (1819)..(1821): n is a, c, g, or t
ctttccagagtaggtagagggatgatgctaataagtaggctgtgggtggttgtgatgaccccaattatgtgttttttggaaagcatgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagcttttgatgacttctagcaaggcttgctagaagtcatcaaaaagctattagtgggagtagagttggagtgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaacctcattcacacgagaaaacaccctcatgttcatacacctatccccattttcctcctatcctcaaccgaaatcattacggggttccccctnaaacancncnnnggggccgctcaaagtcccgccggggccacattcgcaccgcatgtggtagggccaagggtgtagccgccggctgaccgacggaagta

SEQ ID NO: 712630 - DNA, 146 bp, Homo sapiens
gcatcacaccatcagcatgaccctcaccactcactgtcatcaccaccatcatcaccatcaccttctccaccatcgtcaccatcatcatgaccaacaccattgacaccaccaccacaatcaccaacactgtgtctccaacacgatca

SEQ ID NO: 712631 - DNA, 199 bp, Homo sapiens
  misc_feature (71)..(71): n is a, c, g, or t
gtttttttttgggggccccccccagatttcccccggaaagggtccctgaatccctttttttgttccggggnttgggcagtttgtccccccttcgggtccctccccccccagttgggatgaatttccaaaccccccggggccccgttttaattttttttgtaggggtgtttttttttccataaatttggggcccccccca

SEQ ID NO: 712632 - DNA, 1706 bp, Homo sapiens
ctttccagagtaggtagagggatgatgctaataagtaggctgtgggtggttgtgatgaccccaattatgtgttttttggaaagcatgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaacccctggacaaaacacatagctaccccttccttgtgactatcctatgaggcataattataacaaggctccatctgctacgaaaaacggccttaaaaccgttaatgcaacttttaatcggccaaaggccctggagaaccagccttttaattcaaaccccttgagttcaaccggcgcagttttttatacggcccccggttacatccaatactattctgcctgtgaatttaaatatgaacgctttcacggggaataaaaacctttttaaggctttaaacttttccccacaaaaagattttttgaggactcaaaagagcttgttaaaccggttaccccccattatacacctgggggaacttttgtgtataaccctttttccagaaaaatctttttcttttgggggaaaatatttggcgggctttatccttttttttctccaacaagggggggttactcccccttataacaaaaacactttttcccagagaaaaccttttttgaaccacccaccccttgtttttttatctctcccatataaggtgtttttcttaaagcgcgcgctctgctctcttcactttatc

SEQ ID NO: 712633 - DNA, 1499 bp, Homo sapiens
ctttccagagtaggtagagggatgatgctaataagtaggctgtgggtggttgtgatgaccccaattatgtgttttttggaaagcatgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagcttttcagacgatttctagcacgcatcgctaacatcaccacagcgcacccatttgccag

SEQ ID NO: 712634 - DNA, 1427 bp, Homo sapiens
ctttccagagtaggtagagggatgatgctaataagtaggctgtgggtggttgtgatgaccccaattatgtgttttttggaaagcatgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcaccacattaacaacataaaaccctcattcacacgagaacga

SEQ ID NO: 712635 - DNA, 299 bp, Homo sapiens
  misc_feature (222)..(222): n is a, c, g, or t
ctcaaccttctgggctcaaacaatccacctcagcctcctgagtagctggggccacagttgcataccaccacgccctgttaatttttgttttaaaaacttttttgtgggccagttgcggtggctcacgcctgtaatcccagcactttgggaggcagaggcaggtggatcacctgaggtcaggagttcgagaccagcctggccagcatggtgaaatcccttctntactaaaaatacaaaaattagccgggcatgctggcatgtgcctataacccagctactcgggaggcttgagaccagag

SEQ ID NO: 712636 - DNA, 602 bp, Homo sapiens
  misc_feature (5)..(5): n is a, c, g, or t
  misc_feature (121)..(121): n is a, c, g, or t
  misc_feature (141)..(141): n is a, c, g, or t
  misc_feature (192)..(192): n is a, c, g, or t
  misc_feature (205)..(205): n is a, c, g, or t
  misc_feature (247)..(247): n is a, c, g, or t
  misc_feature (263)..(263): n is a, c, g, or t
  misc_feature (280)..(280): n is a, c, g, or t
  misc_feature (292)..(292): n is a, c, g, or t
  misc_feature (304)..(304): n is a, c, g, or t
  misc_feature (329)..(329): n is a, c, g, or t
  misc_feature (341)..(342): n is a, c, g, or t
  misc_feature (352)..(352): n is a, c, g, or t
  misc_feature (416)..(416): n is a, c, g, or t
  misc_feature (422)..(422): n is a, c, g, or t
  misc_feature (433)..(434): n is a, c, g, or t
  misc_feature (461)..(461): n is a, c, g, or t
  misc_feature (464)..(464): n is a, c, g, or t
  misc_feature (483)..(483): n is a, c, g, or t
  misc_feature (522)..(522): n is a, c, g, or t
  misc_feature (562)..(562): n is a, c, g, or t
tatantaataattatagaattttactatggtttgttttatattttttattgggacatcttgcagaaccgtgaagaacaagttcatttttttatttgataccttattaaggtaaattaaganatggtttttgcttaattttnttcggtttaaatggttagattttttaatcatttttactttttgttttatgngaattaaactatnttttatttttaaattaacaattgctattttggatgtaaaatntttccctgtgtaactnaaacttagggagatttngaagttggtgtnggctttgggttnattaaaagttttatttaaattttgnactcctaaagtnnatgggaaatnttttttttttgggaaaatattatattttaaagatatttggaggtagacacatccttctcctgtnactttnatgctgtattnnccaggcagctctggcaatgagacctgntgnagtaacaggcggttgttcnctgtccacttggaatttgctggaaaatgtccctgaagantggatagtgacctgtgcagcctttccagtcctggtaaatntggctgctccatatttggccacaccatggagacacaccac

SEQ ID NO: 712637 - DNA, 1850 bp, Homo sapiens
  misc_feature (1249)..(1249): n is a, c, g, or t
  misc_feature (1252)..(1252): n is a, c, g, or t
  misc_feature (1255)..(1255): n is a, c, g, or t
  misc_feature (1257)..(1257): n is a, c, g, or t
  misc_feature (1287)..(1287): n is a, c, g, or t
  misc_feature (1361)..(1361): n is a, c, g, or t
  misc_feature (1365)..(1365): n is a, c, g, or t
ctttccagagtaggtagagggatgatgctaataagtaggctgtgggtggttgtgatgaccccaattatgtgttttttggaaagcatgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaacccctggacaaaacacatagctaccccttccttgtgactatcctatgaggcataattataacaaggctccatcgtgcgctacgggacaagagcagggaccgttagaagagtccggcttccanttngcncnatactcttcaatcgagccacatagccctcngtagtaacagccagttgctcaatcgcgagagagcgttcgcgcgtggcacaggccgtttcgagcccggggccggncagntcgattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcattctccaccccttgacaaaacacatagcctaccccttgcttgatctatccctatgacgcataattgttacaagatacatctgtctacgacaatacagacctaatatcgctcattgcatactcttcaatcagccacatagaccttgatgtaacagccattctcattcaaacccgctgaagctttaccggtgcagtcattattatacatcgtccacagacttacatcctgattactattatgactagcagactcaaactacgaacgcactcacagtctcatgataatacactctcaatgactctaaactctactgccacttataactttt

SEQ ID NO: 712638 - DNA, 200 bp, Homo sapiens
gatggccgggtcccctgggtagacctaacataagcattcttatataactatatatattatcctaactactaccgcgttcctactactcaacttaaactccagcgaccacgagcctactactatctcgcgacctgaaacaagctaacatgagtaacacccttaattccatccaccctcctctccctaggaggcctgcgccc

SEQ ID NO: 712639 - DNA, 406 bp, Homo sapiens
tagcatagctgcatgtgtgtgcgtgtgtgtggtcagaatatctaagctatactctcttagcaggtcccaagtatagaatatattaactatagtcaccaatcgggacgttagtgtcaagaacttatacatctgataactctatgttggtacccttcaacatttcctatttcccctactccctgacccctagtaaccacccttctactctctgtttctctgagttcaagctttatagaattccatatgtaactgggatagtgcagtatttgtctttctgtgtctggctatttcacttagcataatatcctccaggttcatctatgttgtcataaatggcatgatttcctgctttttaaaggatgaatatttcattgtgtgtgtgtatatatgtgtgtgtgtgtgtctg

SEQ ID NO: 712640 - DNA, 1535 bp, Homo sapiens
ctttccagagtaggtagagggatgatgctaataagtaggctgtgggtggttgtgatgaccccaattatgtgttttttggaaagcatgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaacccctgaagttcacgggccggcattctcataatcgccacggataaatcctcataaatatatggcagaaataatagagggtcaagggggaaaaaacctcaagggaaatggccccatagttggagtcttaagggcgaacgcgtaccccctataatgagagtctgtgaactctcgaaattctcataggaaaaggcccttaaagggggccaaaagaaagactccacgaacagaaagagtggagacgatcgtg

SEQ ID NO: 712641 - DNA, 1132 bp, Homo sapiens
tgaattaccttgtttcttatcggtctcccggaaggcataataaatcggccacgacatgatccgggtatactaatcccgttggcttacaacacggtaaaggagttcgaactaaggtataccgacggaatccccttttcatgaggaacttatttcgcgttacaatggctaaatctgatctcgtgagcaacggggcaacatggttccctacgttattcctttccgatacctaacgtaataggtaataacgtgggtaaaacctttcattttagcgcctcggtccatttcggggacttgcatcctcgggacaatatgagggttaccataagggaactgggcgacatcaggatacacgggattactctctgcggccctctagttttacggatgcctggtatctacagacctattttaggatgctctgctgcgcgatgttttgcttcatgcgtttcatctagatacgagcttagcttatgatctcgtggattccagacatccgtaacaatggacggcacatgatgtgcgtgataattgcgcagtgttcattgcatatctattacacggtcgtaacgataccgaacatatggatgctatcattaccctatatgtattctagtacgggtaaacctcatctctgatcgatagactagcgtaatttacgagagtattcttcatataatatgttggatccttacttctagccacagtgttgttatctgttatgcttaccatgtcgtagtgattcttgatcctcagctcactttcatacatataagtcgtcacgtggtctatgcgaactgctcccgtggagatgttaaagtcatgaaatgcacccagatatcggccaagagcagctttggacatctttgaacgatgcaaggatgtaattacactaagcgtggaatgcggggtatttagggatctgtagtagagccttatatgaaataatcgcatgggaatgctgaacttgctggatactatatgtgaaagtgctgtgcatcgtgatctggcttttgctatattattcatgggttctgtgggcagtcaacgtatcctttctgaagctctaagaagacctgcccatgatactatgtagcagaaatacgaagaagaattacgccgtggtacagcctgc

SEQ ID NO: 712642 - DNA, 956 bp, Homo sapiens
gaatcggaggacaatacagtatgctaccctttaacacatttattggactagtcgtgtccgtactatagcttcacaacaatcctaatcctaataccaactatctccctaattgaaaacaatatactcgaatgggcctgtccttgtcagtgataaaactaaattacgccagtcttgtaaatctggcaggatgaaaacctttatgccaatgggctacaatctagttgaaccaagtctttagctccaccatggagcacccaaagcatacggattgctaaattgtataacatattctctgtgcctgttcatggggtgaagcagattgggggtagcacccaaggtatgacatctagcccagtcatcaagcagatttgtattccccgtacgattactgcctagccacctagtgaaatatatgtaccggtacgcataatatacttgacccaccctgttgttacagtatataaacccaatcgtagaatcaaaaacctccgctcgctcgatgctatagctacatggcaaggtatcagcaaatacaaatcctcaacctatcagagcatcaactgcaagtccaaagtgaccccgtcaccccatttaggataccacgaaagtttaccaccctaaatagacatgcgtacttaacagtcatctgaccgtaactgcagattacagtcaatgtaccttctcgtgcgcatgggatgacccccctcaggatgaggggtcctggtcgcattctcgtgaaatcaatttcccggaagagtggagcactcgtactggaccattagcactggggtaactaaaggaatggttcgacactgttctcacttaaggcaataagcgcaatagccacagtccctaaaacatctcagaaaaggtttacttacagtgggacccagcatggaagcgagggacaacatgcacgacggccattaacgtggtggcctaaaaaaaagttttcg

SEQ ID NO: 712643 - DNA, 197 bp, Homo sapiens
gatgagctggtaccataggaatactgggcatgttactcacatgcattagtagctagtttttatttgagaaagtaacagcaaggaactgattgaaaactaaactatacatagtacttaagatgctgcacatagctggaagaaggccaggtgccaagttattaagaaaagattaatgaaatgagacaaggtatagccga

SEQ ID NO: 712644 - DNA, 109 bp, Homo sapiens
cccttcacaatcaggcaagccaacgccacttatccagtgaaccactatcacgaaaaaaactctacctctcatatactaaacatcaaacctatactacgggtaccgagct

SEQ ID NO: 712645 - DNA, 1033 bp, Homo sapiens
gaagctctggttcgatgtcttcatcaggtatacatcgctcgagtgacaaagcacaccatttgtctggtgatgtcattctgctgtgcaactcactgtgcaagtgctatctagtactctcttgagtctcatggtccaagctagatacgtcgaatgtttcacatagccgtttgatcagcactcatcaatggtgtaacaggtatacggccatactctcaataagtggtgaagaaaggtataaatatctggagacgatttggctagtgagtcatagtacgtgattggggtgacccaggataatcctatatatctaaaagtgaggaatgtgcgtgtaatcgggatgtagggatgctggaggatgtgtcttccagagaagagtagaagcctggacacgctcctatactaatatacaacatggcttttataatagagtgcactggtcgcactcaattgtgtaacttacacttgttacgcatccaagttcgactgtcgagctgattgaagtgtagtgggctggtacccattcctagaatgaaaagttacaagcatatttgtctagcacgctacatgctttgaaaatcgatactatgagatgcataataaagtccgactaattactgcacatagcatctctttataagcttaaaggtcttggcatacatagtagaaggagtgtggccggttatggttaccatcacgcgcgaagggcttgccatggtggatttgctgggctattaacagagaggctaccgatttaagggcctgtatgataaggattgtgcctagtttgttggcaatcgctttgccgacgaatctgcagattgcgtaagagtggtcaggcgcctccttggtgggggtgactagtggccaccccctggaataaacctcgcgggaaaaactcagcccgttactgtgaacaaacaattactccgggtgaattcccgacgagtatattaaataagcggcgataacaacaatggactccatcagacaaatgcaagagcacagtctcataggagacaactctataacaacg

SEQ ID NO: 712646 - DNA, 168 bp, Homo sapiens
ttcttaattggcttgagtggagctcaggggctattgggctccagggcaggatgcagtctggtgggggttgagctcaatacggtgctgtgatgtagttgcttggggctcctggtgtgagtgggacccagtgtgaattctctctctggaacggttagtcatgtggattcc

SEQ ID NO: 712647 - DNA, 908 bp, Homo sapiens
  misc_feature (42)..(42): n is a, c, g, or t
  misc_feature (166)..(166): n is a, c, g, or t
  misc_feature (170)..(170): n is a, c, g, or t
  misc_feature (192)..(192): n is a, c, g, or t
tactggggagcatacaaaatcccttagtcacacagtatttgnaatgccactggcaatcgctggtgcagctggagtttgtctcaggcaaggctcctgacttccttcttgccggctcaacttctccgactctaccagctgatgctcttcaccctgccagggacccctntttntcagctacggggatgagattgngcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttttccgctgggcctggacttttttcctatatccgccactgggaccagaatgagcgttttttggtagtgcttaactttggggatgtgggcctctcggctggactgcaggcctccgacctgcctgccagggccagcctgccagccaaggctgacctcctgctcagcacccagccaggccgtgaggagggctccccttttgagctggaacgcctgaaactggagcctcacgaaggggtggtggtccgcttcccctacgcggcctgacttcagcctgacatggacccactacccttttcctttccttcccaggccctttgggttttgattttttttttttttaaaaacaaacaaacaaactgttgcagattatgagtgaaccccccaatagggggttttttgccttcaaataaaagtcccccctgcatggtgaagtcttccctcaaagcgaggatgacctgaaaggactcggggggcctttttcgggttgggcaacacgggttcaca

SEQ ID NO: 712648 - DNA, 407 bp, Homo sapiens
  misc_feature (42)..(42): n is a, c, g, or t
tactggggagcatacaaaatcccttagtcacacagtatttgnaatgccactggcaatcgctggtgcagctggagtttgtctcaggcaaggctcctgacttccttcttgccggctcaacttctccgactctaccagctgatgctcttcaccctgccagggacccctgacttcagcctgacatggacccactacccttttcctttccttcccaggccctttgggttttgattttttttttttttaaaaacaaacaaacaaactgttgcagattatgagtgaaccccccaatagggggttttttgccttcaaataaaagtcccccctgcatggtgaagtcttccctcaaagcgaggatgacctgaaaggactcggggggcctttttcgggttgggcaacacgggttcaca

SEQ ID NO: 712649 - DNA, 358 bp, Homo sapiens
tttggggttttaatttttttctccccggccccaaaagccttgtccttttatataggagcctctttaaaaaaaaaaaaacctggtagggttttaaaataaaaatccgaggcctatctccccttttaatttgtcccgtaaaagttttattaatcaaatgaaaggtggccttgcccgaaactttccctttacctgccctactagggtagggagggcttagggatgtttcctgtgtcggatgggcttttctttttttcatatgatccattctgttgggattttcagtatttcctttttcaaagctaaaaagatataccttttggatacttgggggggggattaatttaagttttccccctta

SEQ ID NO: 712650 - DNA, 833 bp, Homo sapiens
  misc_feature (42)..(42): n is a, c, g, or t
  misc_feature (166)..(166): n is a, c, g, or t
  misc_feature (170)..(170): n is a, c, g, or t
  misc_feature (192)..(192): n is a, c, g, or t
tactggggagcatacaaaatcccttagtcacacagtatttgnaatgccactggcaatcgctggtgcagctggagtttgtctcaggcaaggctcctgacttccttcttgccggctcaacttctccgactctaccagctgatgctcttcaccctgccagggacccctntttntcagctacggggatgagattgngcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttttccgctgggcctggacttttttcctatatccgccactgggaccagaatgagcgttttttggtagtgcttaactttggggatgtgggcctctcggctggactgcaggcctccgacctgcctgccagggccagcctgccagccaaggctgacctcctgctcagcacccagccaggccgtgaggagggctccccttttgagctggaacgcctgaaactggagcctcacgaaggggtggtggtccgcttcccctacgcggcctgacttcagcctgacatggacccactacccttttcctttccttcccaggccctttgggttttgattttttttttttttaaaaacaaacaaacaaactgttgcagattatgagtgaaccccccaatagggggttttttgccttcaaataaaagtcccccctgcatggtg

SEQ ID NO: 712651 - DNA, 124 bp, Homo sapiens
ctaagttgtggctcaggagttgatcagttcttgggcagtgagagtgagtcgtcagaatgtttagtgagcctagggtgttgtgagtgtaaatcagtgcgatgagtagggcaagtgatcactccat

SEQ ID NO: 712652 - DNA, 670 bp, Homo sapiens
gcgaaggtgatcatcccacctcagcctcctgagtagctgggatatgtaccatagatagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttttccgctgggcctggacttttttcctatatccgccactgggaccagaatgagcgttttttggtagtgcttaactttggggatgtgggcctctcggctggactgcaggcctccgacctgcctgccagggccagcctgccagccaaggctgacctcctgctcagcacccagccaggccgtgaggagggctccccttttgagctggaacgcctgaaactggagcctcacgaaggggtggtggtccgcttcccctacgcggcctgacttcagcctgacatggacccactacccttttcctttccttcccaggccctttgggttttgattttttttttttttaaaaacaaacaaacaaactgttgcagattatgagtgaaccccccaatagggggttttttgccttcaaataaaagtcccccctgcatggtg

SEQ ID NO: 712653 - DNA, 763 bp, Homo sapiens
  misc_feature (42)..(42): n is a, c, g, or t
tactggggagcatacaaaatcccttagtcacacagtatttgnaatgccactggcaatcgctggtgcagctggagtttgtctcaggcaaggctcctgacttccttcttgccggctcaacttctccgactctaccagctgatgctcttcaccctgccagggaccagggacccctgttttcacggctaacggggactgagattggcctggactggcagcgtgccctctccgtggacagggccagagtgaagaccctggctccctcctttccttgttccggcggctgagtgaccagcggagtaaggagcgctccctactgcatggggacttccacgcgttttccgctgggcctggacttttttcctatatccgccactgggaccagaatgagcgttttttggtagtgcttaactttggggatgtgggcctctcggctggactgcaggcctccgacctgcctgccagggccagcctgccagccaaggctgacctcctgctcagcacccagccaggccgtgaggagggctccccttttgagctggaacgcctgaaactggagcctcacgaaggggtggtggtccgcttcccctacgcggcctgacttcagcctgacatggacccactacccttttcctttccttcccaggccctttgggttttgattttttttttttttaaaaacaaacaaacaaactgttgcagattatgagtgaaccccccaatagggggttttttgccttcaaataaaagtcccccctgcatggtg

SEQ ID NO: 712654 - DNA, 1491 bp, Homo sapiens
  misc_feature (282)..(282): n is a, c, g, or t
  misc_feature (346)..(346): n is a, c, g, or t
  misc_feature (372)..(372): n is a, c, g, or t
  misc_feature (374)..(374): n is a, c, g, or t
  misc_feature (556)..(556): n is a, c, g, or t
ggatggcgaaaggaaatgaagcgtcacacggtgaaacggaaggtggctccggtcccatcggtcgtggatgatctggagtgcttatagtaacatgatggcttgaatccctcatgatgatgcagaaagaggccattctcacatattgggcatagtggcaggatcagtcacgagtcgcacaaagatgagacacgtgcaatgctcgtcttatgcgtaaattggtgcaccggtatgagtgatcaagggtttgcgatcaaggattgaatagggccggtgcatcgtatngcaagttgggctctgtaataagttgccgtcacgttcctgcatttatacccatgtcttcaccacntagagtcgcatttgggtcggcgcgananacgcagattacacttctatgctagtttgtccaagcgtttggctcgcaaactagcgatgacgagccatccaaggtagggaacgataatgactaaatgggatgtgagaggccaacagcttgccggcatggaaccttgtttcgggtctctctgagttgcacggggaagcacacgttacagcgctntgggcatttgtgaccagcaccggacgaggggatctggttccccggaatacttggagaaggaaaggacgcggactctaatagagtcgccgctttcctagaaagcctggaagagcaaagaatatatcactaacgcggtatcacaacacggaatgcaatatggcgcatcgggtactgaagatcacaagtagatagagcgcttttcgacagactttggtggatggtcgcatagaatttttggcgactcttcggggacttgattgaggaaggtctctcccactccttattaaagcttaaggtaccttggtctccccgtgtaggcaaccttttggcacgtaaagtggggttccgcatatcaacatttgcggagggtggtgcccccactgttaactgcgtcataaaatatccaaatggtgggaaacacggcgcataaaatgaacgttgggcgcggacctttttggttcaaacgtacctagcgtatatgggcaaaaggagcccttatgggacaaaacccttcactgttgaggttggcggggctcctttttacaacccaattcaagggggcgtgtggaagacccttccttgtgaagtgtgaaacaacacacgtgtgggcgcggcattatttatgcgccataacagtggccgcatggacatctaggggggagggcacttatttgccacgatgagatccccaaggttttaagcaaaactcgaaaacgtggaatttatccgacattgtgagcgcgcctccacggggccggaatgccaacttgagatcggcccttgaatcaaagatcgagttcacgttgtgggaaccccgtaaacgctccgttgtggtgtggcttgccgacacattcaggcgcatccgcctacgccagcaacgggggctccaagggcctccttatggtgccattctcgggcaccttcacccacttggg

SEQ ID NO: 712655 - DNA, 330 bp, Homo sapiens
tataacttcacacccaagccctgccagcccccgcttcctaagccataccctagatggagctgctcaagcgcctggacccatccgctgcctatcaacggggttgactgcaactccttgtccttcctgagtgtctatcaccgacggcgacctgggagacagcgggacgcggacgacgggcttggagatggaccccatcgactgcacaacacccgagtaccatacttgccagtgtatgccgggagcggacactgtgtcccctgcagaccccaaaaacgtgactggaaaccctatggcagagcctgaaagtacataaccatgagcaggatggaa

SEQ ID NO: 712656 - DNA, 200 bp, Homo sapiens
gttgtggttggcctgtttgctgggcgtgatctggcacctgacgtcacaccggcaccatgcgctttcacttcgtgcatctcgcagctgagcgacggcctgcagatcgtggcgctggccatgggcctgttcggcgtggccgacttcctcaagaacatcaaccagatcggcggcgacaccaaggtcaccagtaccaaggtcag

SEQ ID NO: 712657 - DNA, 650 bp, Homo sapiens
cctattggggtgttctgcgcgagtgtgagagggaagcgccgcggccctgtatttctagacctgcccttcgcctggttcgatggcgccttgatgaccccgggtcccctgacctgcctgcaatttcggaaattgcgctgtgctcctgtgctacggcctgtggctgtacttgcctgcgtgctgcccaatctggctggcaagatgaagcgtctccctggtggccgcgatgctgctgctggtcagcgcggcgcgggccgaggcaggaggcacaagcaaggaggacgtgggccggtggtcggcatcgacctggggaccaccgtactcctgcgtcggcgtgttcgaagaacgtgccgcgtggaagatcatcgccaacgatcagggccaaccgacttcacgccgttcctatgtcgcccttcactcctgaaggggaccgtctgattggccgatgcccgccaagaaccagctcaacctcgaaggcccgaggaacaccgggtcctcttggaacgggccaaagccgggcatccaattctgggcccgttcacccgtttggcacatttgacccccggttcctggtcgcaacgcaagggcaacatttcaagggtttcctttgccccgttcccaaccggtgcgtccgcactaccgaccacctcacc

SEQ ID NO: 712658 - DNA, 339 bp, Homo sapiens
tacttttccacaggcttaaagttcagaaggctgaggctaggagaggttgcagtcttgtgccttcagctcaggccagtagccagatagagaagctgaaatgagcagaccactccacaagctctggagagggtgtgtgtgtacatgtatgtgtatgtgtgtgcatgtacatgtgtatgtgtgcagatgtagtatgtgcatgtacatgtgtgcacatgcacgtttgcatgtatgtgtgtacctgtgtgtgtactgtgtggttgggtgtgtacttgtgtgtgcgtgtatgtgtgtgtgtacgtgtgtgtgatgtgtgtttagtgggggtgcttctcggcctcc

SEQ ID NO: 712659 - DNA, 766 bp, Homo sapiens
gtgatgtccctgtccagttcggcttgcccgtggctgctgacgttacgagaccatttagcttcagttggagcagcagcaattgttgtctccttatttaaaattttctggcaaatgcttgtagagaagctggagtgtatacatctaccaagaacataattctggctagtcacttcaatgaaggaggagcagagccagctgcagtttgatatgactcggaagtcttttccctttgttttctcactattgcaagagaccagaaaattattttaagacactataaaagtaagccgtgtagtgtttggaattgtgaacgtcggttctgcactactgcgtgaaagatgtactgcagtcagcttcagggcagcttcctgccacagcatgcattaagatgaagttggaatttacaaagctggctcaacaagatgttgagattctacttaatttgaggacaatgttggcctaatactggaaaataatgtctttcagaaaaaggtttctttggtgtagttgtctaagacagaggaagccaatggatttcaagttatatgatgaaattctgaattaatgaacagtggaacaacttgtatagaacttacttgattatcttgggatctatggtgtattaatgatgctgaccatatgtccttcatcctcttgttcctaaggtaaacaaaaacagataacgaaacaatggagaactcgattctatttacaagtataaatgctgagttatgtcctggtgaagaacgaccgagattttggttac

SEQ ID NO: 712660 - DNA, 1030 bp, Homo sapiens
tgggtcataggggggggattggtggccatgtgcccctgggggtttggtaatgacggtgctaaaaaaaaaaagctttttttttttaatgattggtctttgccccctgtgtctttgagtgctctggtataacgttattggatataaagttgggagacgctccataaaaaaaaagtggtggccataggttttcactaaaaaacaacaaaacaaacaaaacaaaaaaaaaaagggggggcggcgcgcaaaaaaaagaaaaatccccactcgggagggggcgcccagcgatctaccgcggctaccccaggtttctttgggcaaccagacgggggggccccataataggggcgcgctcgatataaaaaacggcaagcgacgggcgccggcgttcaacccagcgcgtcgcagcaggggaaaacccgggaaccgggcggacgaactttggggagaggcgagacccctatccttcggggggggggggcgacactatggggcggcaacctcactaacaacgaggaagataagccggcctcagaggggaacaatcaaaacaaattacaacgggggtacacggggcgcacccccaacccggcgaaatatcgctcaggccgcaaggaaagtattgcctcaccgggagcaatcggtcttgtcgaagacattttcataccggaggatgcttagatacactcgacaccgcacgcaacacagacacaacagagacaaccagataggcagccagccaatcaggggcaagcacacgccgacacgaccgcggccagcagaggaccacaccacgacagcagcaacaggccgagccgcgcacccacccgcgcgcaagactccgaacgcgaggcgagcaagcccacgaagagcgcgaagagcgccatagagccacaaggaagtagaccgcgaacaccgaaccgaagcgaaagaagcgtgagaagcggcgagcgtagagggacgcggccgagcccgcagacgaacaaagagaaggcgagcgagcgcggccaaagcaagccaggagagggtccat

SEQ ID NO: 712661 - DNA, 994 bp, Homo sapiens
taatcgcaatggcggttcctaatgcttaccgaacgaaaaattcttaggctatatacaactacgcaaaggacccaacgtagtaggcaccctacgggctactacaaccttcgctgacgccataaaactcttacaccaaagagcccctaaaacccggcacatctaccatcaccctctacatcaccgcccgaacttagactctcaccatcgctcttctactatgaacccaccataacccatacacacaagagccgctagaaaaacatcagaacaaggcctcacaatcagaaacataagacgcacactcatagcccatagcagagaaagacatacaagcctctgacacgggaagagcacaataaaacgcaagaaaagccacaagaacggagaaaagaagagaaagaagggacaaaaaagaacaaagaatcgaaaaaaacagactagagacaaagacaaacagagcagagcaaacaacccaacaccgaggacgggacccaaagaaaaccggacagacagcacccaacagagcaaaaaacaacaagaccagaacatgcacaggaacaacaggacaaccaacagaccacaccgaacaaaaaaacagacagaaaacgaacacaaacaccacgaagacgacaagacgaacgagcgagagaacaagcagcgaacggccacaaacaagcaaaaaacagagagaaaacccacgagccgcgaaggaacacgagacgagaaccactagccccgccagccacaacagaagaccggacacagcagaaacacaatcaaacaaagaagaccagcgaagacagaaaacccaagaaaagcaccaaacaagtagaagagcaacagaagcgaaaccagaacacgaaggacaagaaacgccggaagaagaagaaaaagacacaaagaacgacagcagaggaaaagaagacagcagcagcaagagaaacagaagaaaaaaaaaacagcgacagccagaggaacaacggagcgagacaca

SEQ ID NO: 712662 - DNA, 680 bp, Homo sapiens
  misc_feature (680)..(680): n is a, c, g, or t
acgagtagatgagatgatgagatgaaatgagatgaaaagatgaaactgtatgcgatgacatagtgaacatgatgagatgaagatgagtgtagaaatggacatgtagatgacatgtattgagatgaccatgaaatgacataatgaatatgaaataatgaccatgatgatgatactgaggtacatgacttggatgctattcaatgaggatgtccaatgaaatgtgcagaatgtctgagtatacagaccatgatgagcatgaaatgatgaaatgagatgagataaaatgagatgaaatgatgagatgagatgaaatatgagatgaaatgacataatgactgacatgatgaaccggcaatcaatgcacaatgccacaatgccgcagcctgcagatgctcacgcagttgcaacatgcagcatgcacctgcatgcaccatgcatgcagcatgcacactgcatgcagcatgccacatgctgcctgcaccctgcacctgcacttgcatgcccatcacaccctgcaccacggcacatgcagccatgttccatggatggcgaatgcaacatgcagaatgccacatgcagcagccacatgcatcgcatggagcatacacatggctctgcaatcgcatggacatgccattggatgaccatgcatgagcatgaatgtatgcacatgaatggan

SEQ ID NO: 712663 - DNA, 630 bp, Homo sapiens
  misc_feature (630)..(630): n is a, c, g, or t
ctttgaaaaaagtatctcaaaaaggcaacatgggccgagcgcagtggctcacgcctgtaatcccagcacttggggaggccaaggtgggaggatcccttgaagccaggagtttgagacaagcctgggcaacaaaaagcaagaccctatctcggaaaaaacaaacacaaaacaaacaaaaagaaaaaaacactttggggcgcgcgcgctctgaggccctctggagaaaagtttttaaacacaattctcggttgggaagcgcgcgaggggaccacaaatgagacgtgaacagggaacacacgtggcgccaaacaacggatggtcacacaaaaagaagacaccaggggagacaagagaacaaagagcggagaggagagagtctcctccacaccattataagaacaagcgccacggggggggaaaaccacaccgagaaaggcggccctcgagcgaaaacaacattcacccacagggatgtggagagcatcacagaaaaaagagggaacacaaaaccaggggggagagatcaaaaaaacagaaaaaggggaagagcggcccaaaaggacagacacaaccaaagagtaccacacaacatatgaacaccgcccgcagcatatcgtgggggggacacan

SEQ ID NO: 712664 - DNA, 802 bp, Homo sapiens
  misc_feature (588)..(588): n is a, c, g, or t
ggtggctgatatcgtacgtgtgacttgggatcgtcggtcgggggatctaccgattgtggcctctgctagtggtcagaggtactggatgcgtaagtagtaccctggccagacagatggagatggcaagggtcctgggcagagcattttggtcagaagcgggtgacagctagacagtgcagattctctctcccggttctgagcaggcggtaacgagaaattcaaaaggctggattacggtagcatctctgtgccctcctgaggtgtatgtctgcggccggcatggttagccgttttaggaggctcggtattcactttgggatagccaactccaaaaatgtaatcggcagggtgtctgggtctcagtgtcagacgatctagcatattttcgttttccatgtgggttcctgtttttcggattcgcctctggtgggtgtcagtaaactcccagttgactttccttttttcataacatcaaacactttagttaacgaaggtgcttctttctcattcttggcatctcctagacttccactatctgacttgaatctagctgattttttcctggaaagagtatcacattcgatgagnttatgggaactgaagagctgtctccggctatctaaacttgatgttaacttccctcggtacaacttaattcacttccttcagattttccgctgctctatcactttgcagtttcctcgaaagcttctgaataagttgggacacggatgttccttcgttacagcgccttatatgagttgcttttctattgcttcctgtttccgtactaggcatacta

SEQ ID NO: 712665 - DNA, 581 bp, Homo sapiens
  misc_feature (540)..(540): n is a, c, g, or t
gcacgcccagctaattttatatttttagtggagtcaggtttctccatgttggacaggctggtctcggactcccgacctcaggtgatacacccacctcggcctcccagggtactgggattgcaggtgtgagccaccacgcccagctgccagtttcttatttcttgtagagatggggtctcgctatgttacccaggctggtcttgaactcctgaacatgagtgatcctccaacctcggcctcccaacgtgctgggattacaggtgtgaaccaccgtgcccagccttaaattgatttttcttaataattggctgagcatgctggctcgcacctgtggtcccagcactttgggaggccgaagcaggcagattgcctgaggtcaggagtttgagaccagcctggccagcatggcgagaccccatctctacaaaaaatacgaagatttatctggattggctgggcacgttggctcatgcctgtgatcccagcacattgggaggccgaggccaggtggatcacctgaggtcgggaattcgagagcangctgacgcaatatggtgaaaccccatctctactaaaaatac

SEQ ID NO: 712666 - DNA, 202 bp, Homo sapiens
gcagactcgggactggatcgatgggactcaccggcctctccatcaggcccgatcttccagaagggcctgaaggatggaactatcttatgcacactcatgaacaacgcttacgagccgcgtgctccgttgccgcaagatcaaccagctccatgctgtacactggcaccaggctagaaaacctgtccaagcttcatctaaggcc

SEQ ID NO: 712667 - DNA, 191 bp, Homo sapiens
cggggtccaaaggcccggttttgggggccccttaattttcccgttttgggggcccccccgggggccccctttttggccctttttttaggccccccaagggggggggggattgggggggggggacccgggtttggtttttttttttccccccccggggtttaaaaattaaggttgccgggttttgcccccca

SEQ ID NO: 712668 - DNA, 460 bp, Homo sapiens
cgttattgaaaaatcgtaagtttttaaaagaaattattatttttaacactttcttcaagcccccttgttttatgctaataactgttttgttaggccctatcctatgtagctgttaaacatggtcacaggcatgtagtacattctatgtccgtatactttaaccaaaatatctgtactggacgtgctcgcaggcatgtcccagctcacagcctatgccccttttttatttcggaatgttattacttttctaagtccttttgtaaactacttcctcttttcccttgtctttccattacttttacctgttttaaaaagttttaaactgttacccaatcaagttttagtttaaattttaagatctggctccagcaacggagacacaatacaattacaaggacaaactacgtaaagaataaaaattgcatccctcctttatttagatatgctctcgccattgttc

SEQ ID NO: 712669 - DNA, 631 bp, Homo sapiens
cggtccaggagcagagagagagagggggggaagacaaccagatctcatgagaacttactatcaaaggaatagcaccaaggggatgttgctaaaccattcagaaaggacgaccctcattatcctgtcaccttgcaccaggccccacccccaacattggggattacagtgacatgacatttgggcagggacacagatccaaaccatacatttcatatagttgttctataaattttatccagagatgaggattgcttgagctcaggagttagagaccagccttggcaagatagggagatcccatctctaccaaaaattaaaaaaaaaaaaaaaattagcggggtgtgggggtgcgtgcctgtggttggtcccagctactggggaggctgaggtaggaggatggctggggccggggaggtagaggatgcagtgagcaccactgcactccagccggggtgacggagtgaaaccctgtctcagaaaaaaattctttttaattttaatccagagtttatagtccaatctatgggagggtcattgggaaaggggccattacttggccagaagaagaaccttcctggtttacattgggagaaaaatagatggaatcctatagtatcgtgtgagttgactt

SEQ ID NO: 712670 - DNA, 870 bp, Homo sapiens
agcggggaggcgcagcctgagcagcagagtgcagtggcagctgggagaggcgggagcatgctgtgtggcagcagagctggattggggtgttgagtccaggctgagtagggggcagcccactgctcttggtccctgtgccttgctgggtggtgcccttgccctgaactccatgtgcagcgtgggacagggcgaggtgccaccttagtctggctaggggagggcggacgatgaggagtgatgggtgcagcgcatgctggcacactccatcctctgtcaggaagccaagcaggtaccctggcaagaggcagacctggcttgatgccagctgttggccaagcaatgagtactttccctacagaagcactggtgatagaggccgggtgcgcctgcccggctggcatgcacattagcagccaggacatgccttgcatgtgaagtgcaccttagtgatgatgtactagaggactacttgtcagatctgacattatacacggccatgcaaacgatagcatgtcacagtggatggcccatgtcaagcctggtgcttacccccgagttggaaagacatggtctatacaccgtaccctaacttggcatggttagaaggtaccccaggaatgagtgtgtagaatggaccacccacaacatagaagacttggccccaacgggaagggggcgcataagcgtccgggttcaagtgcgatcatacagttcatccccagaaaaggcgagctggtgtcgttgcgatgtggtgacatgaggcttaaccacatgaaggttgcgcaactggtaaaaatccctatgtgccagggcatggttggcatctactatggagtcacatgagatccaaaaagtagctgtgctcaattg

SEQ ID NO: 712671 - DNA, 375 bp, Homo sapiens
gtgactggggtcttgggctgctgcgccaccttcaaggagcgtcggaacctgctgcgcctggtcaggagggcgcagggccacggggtgggggtggtgcaaatgggcccaaagaggttgtcgctgccggctttgaacctgtgccttgctgtgctcacctgggggggggtcacggtcctatcacacctgcctactacggtgggtccctacgttcctgctggaccaggtaagggaagacaccacctgcacaaaaaagcttcagggtgggcggacgcccttcaccctccacctggactccacgcgaaccagggcgaagaccctgttatcaggtgcattttggatccagatttggtcttagagcaaggtttccctttgagc

SEQ ID NO: 712672 - DNA, 243 bp, Homo sapiens
gtagctctagaccatccctatatgctgtctcaaaaataataataattcaaattgaaaggtgaggctatttataataatcttttaactttgagaccgagtctcagtctagcataccaggctagagtgcactggtgcaatctcggttcagttgcaactccacctcccgggttcaaacagttctatactagcctcaagcctcccaagtaagctggggattattgggcaccccggaagcaacacctg

SEQ ID NO: 712673 - DNA, 945 bp, Homo sapiens
acctcggggtgcgccctttggcacccggtaagatatgtgttctcgtccctcaaacggacctctcttctcaaaaccgcgcccttggtccagtggcgcccctgtcccgcccgttcgagggtattccctaaccgcgtcgtggttggccctcttaatatctgggcgggcggatacaacaccatgcgggggctgctccaccacaaacatgacgtcgtggtggctccaggatactattcgaccccacaggaggggcccgccctgacatggttccatcgcggctggtgctgcccccatgagagttacgtcctcctcccgccccccgccttcttgttcacgaccaatggagggtttgcgcttcccacccatggcgttcttagagagtgacccccccccccgggtaaggttgttttgttgttgctcacccccactccccgcgtcctcattcttcttgcctatgacacacacacggcacgatgttctcttcttgctccggctcttgtcttctagaaaataatggcatggtttgtacaactgtaaactacaaataaggcgcgcgcaccacactgtatttattttttctctctcgctggcgtgagcctgttttccatgaagtatctattcttgaggagaagattcgcgcctttaacttccttgactgcaaatgttcctaaatatgtgggatctggcattacatacaaagaaataatatgtcttatgttttaattgtattgcccaagagactagggcagcaggccccttcgtgcaaaattttcttctagggcgggggcgaggggagcgggattcgcgtctacttaggcccgcctctctgagtgtacttcacccaagaataaagggaatttaaataatagatagaggaggcacacaaacaatacaacaaacagaaataaaacaaaaatcaaaaaagaaaacaaaacgacccacatgaca

SEQ ID NO: 712674 - DNA, 355 bp, Homo sapiens
ctcccgtccttcgtggcacgccttgttcctgtggggctgggaactggacagccggataagtcaatcagggcagagtccgatgtcctgtgggaattcttccgactgtccccatatctagtccagacctaattcaccaccgaagttttctttcaagagaatcaatttatatctatgctttccaaagcactcagttgacagtttttgtagaaataactttctctttgcactcatgcaaaaatccagttgccccaggatttaatgaaatcatagaactattgtaataaaaccagaatgaacagatctgggagtgaacacatttgatcctgtgtaagtatgagattccagtgtgggagca

SEQ ID NO: 712675 - DNA, 352 bp, Homo sapiens
tgcccgcgactctgatttcaaaaatgggggaaatgatgcccctgtgtccctgatcttctctgcctcttcatcctcttcggcatgtcatcgtcaggcttcagcgactctaatgagtgagcgagagtcaagccctccagaaaaagaggaagcccaagagaagactgggaaaactgagccaagcttcaccaaaagaaaacagccggttctctaacaaaacaccagatcaacctccccggcactgccaccaagatctgtcatctgataacgcagcatggaacatagaggtagagaagaactctcatgcactcctcccatgtaaaatggtggctacagggaaaagtactgggatagg

SEQ ID NO: 712676 - DNA, 728 bp, Homo sapiens
agtgggcacccggggctggaggaaagggccagctatgggagggctgtgtgcactcggagtgttgggtcgaagaatcttagggattatgaggggctcatggccagcgtacgtgtgccaggaagcaattctggaagcgcagcaacagcaatgctcccggagcagcatccagacacgtgtatggtgcccagcacccccaccttatgatccactgttacatggcactttgctcaggtccacgtgcaaagatgccgaccacaccagtgaaggccaagagggtcagcaccttccaggagtttgagagcaataccagcgatgcctgggacgctggggaggacgacgatgagctacctggccatggctggcgtgagagcctgaactaccgaggtggtcatggagacgtgcaaacgtgtagctgcgtaaccacaagaccagctggaagggtgcggcccacgctgcagtgaggggccagggcattcaggagaagcccaggcacgagggcagagccagcctacacgccacccagatgtgcgatctccggctggtagaacgtcggtcagtgagagaccacacgtactgttcctgcagaacagtgccaggggatgcaggccctctgaagaaggtcccagatcactacccaaacgtcgagcagcggacgaggctgggatggaacatcttagccccaagcacatctcagaagatcaggtgctgagcagagagagaggctcacg

SEQ ID NO: 712677 - DNA, 455 bp, Homo sapiens
tttttttttttgagacagagtctccgcatggagtgcgatgacgtgatcttggctcactgcaacctccgcctcctgggttcaagcgattctactgcctcagccttctgagaagctgggattacaggcatgcccaccacgcctggctaatttttggtatttttagtagagatggggtttcaccatgttggccaggctggtctcgaactcctgaccttgtgatccgcccacttcagcctcccaaagtgctgggattacaggtgtgagccactgcgctcagcctagaaatctttaaggtgcaataaggtttttttgtttgtttgtttgttttaacttcttgaaaaaaaatagagacagtgtctcactatgttgcccaggctggtctcaaactcctggcttcaagagatcctcctgcctcagccttccaaagcgctgggattacaggcgtgacaccaatt

SEQ ID NO: 712678 - DNA, 157 bp, Homo sapiens
ctatcacggccccccagatgggcctggacgatgcctcctgaccggccttgttgcttctggcctgcgcacgcgaagctcagtactgcgcgctactatgacagacacagtgctgcagcagctgctgcacgtggcgccctgccgaactgtcagttgcgta

SEQ ID NO: 712679 - DNA, 135 bp, Homo sapiens
gactctcaggatcccgacactctaggggcattccccacattctgcaggacaggagccaccttcccctctctcacctcccctggccctgttcaccagtaggttctctatgtattaatttctcggcctatccggact

SEQ ID NO: 712680 - DNA, 213 bp, Homo sapiens
  misc_feature (10)..(10): n is a, c, g, or t
tcaagatcgntgatcgctaccgtcctgtgtggtcgtgatatagtaggacagtggatctcgtcatcatcatgcgcgtcactataatgacgagcttggtacttagaagtcatagtactccgcgttaccgcgcttcattgaattttcacttgacatcagagcactggcagaaatcacatcggtcacaccgcgcgggctcgcgatgtttgtttaatt

SEQ ID NO: 712681 - DNA, 732 bp, Homo sapiens
agggtgtggggcatccatatagtcactccaggatgtatggagggttctcctactattaggacttggacgcttcgaaacgaaggcttctctgatcatgataattattaatattactgctgttatagaattgattgagcctaacagaatgataggatgtgacatgtggtgtatgcatcggtgtagtccgagataacgtcgggggtttccggataggccgagagagtgttgtgggaagaaagttagaatttacagctcagatgaatataaatagtgaaatggatttcggtgtagggttaggtctagggtgtatgctgtagaatagtgggaaatcagtgaatgaatgcctgtctagtgatgtgcagagatatagtgtcctattgatatgggacatagtggagagtgagtcgtacaaatgtaggacagtggtcggatagtaggtgaccgatagtcatgaatgatgtaggttgtgatggattacaagtggatcgacgtctaggcctacacgtgacggtgcaaaaaagtcccggatcgattgcactagggcgtcatgaggtgtttggaaacgaaatgcaatttcgatatatgcgtatccagtgtatgtggttgatagaagtccatgccttttcttagttaagactgactggtaggtggaatacgcgatcgcattattggccagcggtggggtcgaaatgatgctcgatgttcgttttcgatattatacactaactagta

SEQ ID NO: 712682 - DNA, 318 bp, Homo sapiens
agtagctctaagatcccagtacttattgcatacacagcatcaggagctttcagcgcattcggacagtcatgcatgtcgcgagcctctcactgtaaaggcgaggtgacgaatgagtcacgagctgagagcacatgacgactcgttctgatatagcagtacaggatgcacgcagagaggaggagattcgggaggaggcgagaggaggctaggcagacgcccatcactcagctttagttccttaccgtttactaactgcctttctctcctcaaattgtgtttgtgcctcttatctgtattgctaatcttgtgggactggga

SEQ ID NO: 712683 - DNA, 211 bp, Homo sapiens
  misc_feature (183)..(183): n is a, c, g, or t
ctctatcattgaatgctaccggtcacggtctgatccggaattattgcctcaattatgtgccgccgtgttccgtcagtacgcgaaggatatcggttcattaagttggactaaatgctcttccttcagaggattatccggggcatctactcgatgaaaaaccattgattaatttctttgtatttnagcataacacttttgaaaaaaccctttc

SEQ ID NO: 712684 - DNA, 315 bp, Homo sapiens
gtggaatcctattagggcacgatattcttcctcgagcttcattatattagacacattagctttatctctttctgctgtcaataatttaacattggactgtatatcttccatactatttttcaaagtctttctatgcatacgctgtaaattcatctcatttctcttagtgatctcgatgaattttctgcatattgtaatcagccccttttcttggatgttctaaattattgaagctatcttcacgttgcgctattacttgtaagagcaagatcttcgctgtattatatgttggagtctctctagctctttcttata

SEQ ID NO: 712685 - DNA, 996 bp, Homo sapiens
agcaggagtattcggagcgcggaggacacggggcgcaacggtcctgtggtcgagcaacgtggtagagtacgctaccaggggccccctccggaggggggccattcagtccatggggtgcacacacgccagagtctcgaacggagagttaaagggggagcaaggtgcaaaacaagaggttatcctactgtgtgtaaaccggtctgccgccccgtggcaaggggtgtttccccgcgctggaaccgtagggggtgctgcaacccacgaagcatcaagggggtcggacaatattagcagactaccggggaggttacagtacgccgcaactggggcggggtggacgaccaaatgtggcgttgtgtcggttgtcaagtccgaaatggctatgcctcaaccccttttgtccccacaactgatgggggttttctagtaatgtgcaagcgggcaggggattgtttgcgtttacagtgttttcattcgtacgacctcttgtttccactctggtgggttatcattaggcaacggtgggctcccacacacggatgggttttaaggcaaggggcgtgcccaccattataagcgagggtgggcaccacgagggtgtcttttgttatacagaacgactccacatctttgtgggttccaaaatctagatgtctttgtcaaattgctcgcgccctccaaagctgtggttacaaaatattctaagcgcgggcggacgatgcgtaatatctcgcccggtgataaatacccccgccgactaggatcttgggcgggaaaattatgaaaaaatactatttcgtgccgggaggtatttagcggatagtctgtttttctaataaattaatttgagacacctttctgtttcgcaatatacacgaactacgatcatgacttggttgtagacagaccgcttcgagtgcacgagtaagagcgtgcgtcggggggaaaaaggtttaatttgcccccaagaaaaaaacaaaaaacgccacaaaaaca

SEQ ID NO: 712686 - DNA, 203 bp, Homo sapiens
  misc_feature (115)..(115): n is a, c, g, or t
  misc_feature (137)..(137): n is a, c, g, or t
  misc_feature (167)..(167): n is a, c, g, or t
gatctagaggatcctgggatgaggaacgtcactcaagtattgtcactcatcggcagggtgagactgacctggctcctaatcataattcagggtaatgtggagtcaagagaagggncttgtgacaggcaaggccaatntagaatctttccctaggactgatgtataanaagctggggggaaaatgcttttctctttcccctggg

SEQ ID NO: 712687 - DNA, 363 bp, Homo sapiens
gctcgacttttttttttttaaatgttggacaattttggacaatgcctctgcccactgagaaccccataagttcaacaccaaaagtatcaaagtgatctacccccttaaatgcaaaatctctaaatcaggggatccgaaggaccattaaggctcatgtaaacacaacactctgtggaaaacattgtcaacgctatgaaagagaggcccatagacagaacatcatgaaagtctggaaaattacaccatagaagatgccattattatagaaaaaagtcatgaatgccatcaagccccaaagcaatagattcctgttggagaaaattgtgtccagatgttgtacacatgacttcgcgggatttacaa

SEQ ID NO: 712688 - DNA, 167 bp, Homo sapiens
aaaaaaatttttaaaagtagccgaacatagtggtgcatgcctgtaatcccagctacttgggaggctgaggtgggaggatcacttatgcccaggaggttgaggctgcagtgaactgagattgtgccactgcactgtagcctgggcggcttagtgagatgctgtctgaa

SEQ ID NO: 712689 - DNA, 1525 bp, Homo sapiens
aggaacatgcagcgtgcctcagtgaagctacagatgatgtgaatccctgatggggccatctactccagtccccatcatggaggacggaggaggtggaagctccacatccagaagacccagcagaggccccataggacgcgtcctagaaataaagaaacacaaaaccagggataccgaccgacggggattcacagaacgaggccaggtaaggcactgggcaggaagaagagcacatatgcagatagacgaagagaaacgacggagcgacgaacgaacgcggagggacggagcgcgagccagacggccacaggagaggcaaatggacaccacagcgcagccacacgaccgcacccggagcacccaacaggaccctcatcatcacacaaacagaaaacaaagccaccccagagaagggcagataaaacaacaaccaaaggcaagaccaagacaacaagggacagacacacagccagcacccaggggtgaacactccacacgagaacacctgaaaacgacacacagaccacgaacaacaaaacacaaaggacccacacaacgagagtcaccaaagaaaaccacaacaaccacacggagacaccgaagcagcacacaacatccccccaccagcaacgacaggagacacgaaaggcgacaaacccaacaaaacacacacctagccccaaacccgccaggggacgaagacacgcggcaacacaaacgacacagagctagagacggcaacgacgcaaaccccaacgcagacaggaatccaaacaagcaacaccaacacacaaaggacatgcacacacacaacaagagagaaaaaaaaaacaacaagaagaaacagaactaagagaaaggaaccacacaagggagagggcgaccacatacccacaggacaatatacagacgacgaacacaaacgacgacaaccacaagaagcagggaaacacacagacgccaacaacgagagagaacagacagaacatgacaacaagacgaaccacaacggaacgaaaaagcagccgaccaagacagcagggcacacagcaacgtgccaagaaacaaaaaacgagcaagcaaaaacaagaacagcgacaaaaacagaagaacacaacagcagcaagaaaaaacgagagaagaaagaagcaagagaacacagaacaaacagaaggagcaacaaaagagcgaacaggcgagacacagagtacgcaaagaagccacaaaaagcaaaagacccaacgaaaaaagggagggacagcgaagcagaagaaaacacgcgacccagcccagagagaagacaaccacagcgcggcagaaccagacaaaacgagagagagccgcacggccagcacgccgacacgagccggacacgcgcaccgccagcggagacgaaaacggcagcacacagaagcaaccgagcacgcacaaacaaagagaacagaaagcgcacacagcgcaacgcgaggcagcggcgaagcgcacgcacgaacgcaacacgcgaaacacaggagacggacaggaa

SEQ ID NO: 712690 - DNA, 407 bp, Homo sapiens
  misc_feature (45)..(45): n is a, c, g, or t
  misc_feature (84)..(85): n is a, c, g, or t
  misc_feature (97)..(98): n is a, c, g, or t
  misc_feature (100)..(101): n is a, c, g, or t
  misc_feature (104)..(104): n is a, c, g, or t
  misc_feature (109)..(109): n is a, c, g, or t
  misc_feature (117)..(117): n is a, c, g, or t
  misc_feature (121)..(122): n is a, c, g, or t
  misc_feature (131)..(131): n is a, c, g, or t
  misc_feature (142)..(142): n is a, c, g, or t
  misc_feature (204)..(204): n is a, c, g, or t
  misc_feature (208)..(208): n is a, c, g, or t
  misc_feature (210)..(210): n is a, c, g, or t
  misc_feature (225)..(225): n is a, c, g, or t
  misc_feature (234)..(235): n is a, c, g, or t
  misc_feature (248)..(248): n is a, c, g, or t
  misc_feature (289)..(289): n is a, c, g, or t
  misc_feature (317)..(317): n is a, c, g, or t
  misc_feature (330)..(330): n is a, c, g, or t
  misc_feature (402)..(402): n is a, c, g, or t
gagtaactgtgccaaattcttaaaatttctttaggtgtggttttngtcatgtagcagtttttatgtagatctatatataaaagnncacacctccccnncnngcnaatgngggggctnaatnngaatctgtncaacctaaatngtagttacagtcctctattgtgcgaaaatagttacactacatacacaaatatacaataggcnaaananccttcatggtaaganagcctaggnnccagctacctgtnaccattttgtcactctcatagttttgtgtcatccattgttngagaagaaagaggcacaggactattgtnttttatgaatttnggtgacagttgtcaaatttgtacagtgaactctgttccccctcattttagtctttttacccccctttcaagntcctc

SEQ ID NO: 712691 - DNA, 154 bp, Homo sapiens
ccagatacaccggcagatacacttaatgaattcattgttttccacagtatgttaaaatatttaaagaacagttatttgctacctgcacgagtttccagacaaggtttttgtctgagaagtggaatgaaaatgttcagtatctctcagaagatag

SEQ ID NO: 712692 - DNA, 594 bp, Homo sapiens
  misc_feature (548)..(548): n is a, c, g, or t
  misc_feature (584)..(584): n is a, c, g, or t
cactcgtatggcacaatgagtgaggtgaaaagcttcttgttatgttaacataagcaacatactcgttttcgagctgttaacatgacggccatggctctttaactgatctgaatcttagctggaaccatggccaaacggaaataacttacatcagactgtgcagacaaagccccattaaataggtgatgaattttggatcgcacttttcagcgtatctagcctacgcgtgtcaacgaactaggtgtcgctggacccctcctattgagtgtccgttgtatgccattctcctaataactcattacgtgctgcgaaacacccgggtgaagcaaggggcccgaacaatgtcattatcataaccattacgatgtcgatgctcctagagtaaaagacacactggttgctgagtccaatgacatgcacgagcatacactaagatattcaccaaccacatctttgcttgtacacgcaattatcctcaaactctgtaatcgagattgattccattacatgaactgctatgccatttatggatggagaagaacttgtgngctcaggatacatactaataacatcagcgccactcnattgctatct

SEQ ID NO: 712693 - DNA, 135 bp, Homo sapiens
gacgatggagcttgattgcgtgtgatgggtcaaagatatacatacggtctctgtgttggagaaccctctcggagtgtaggaagctgaataatttatgaaggagaggggtcagggttgattcgggaggatcctatt

SEQ ID NO: 712694 - DNA, 121 bp, Homo sapiens
ttgagccggtctttccgttctgtcccctcacggctgggccctttcgtgctacccgtgtcccctgttttactaccgactcactgacttactggaccgactcccttttggaccccttttacca

SEQ ID NO: 712695 - DNA, 230 bp, Homo sapiens
gcgaagactgtggtggtacggggagagactccttctgcttgagaaaggggagggaagagtacgggaactttgtttttgcatgcttaggtatcagcttgaccacagtaaggcagagcaacaagagggttcttgaggtccctgattccaggccttggctcttggatggtatttctgcacctgaactgggccacagtcttcgcctgatccacagtcttcgcctgatgggtacc

SEQ ID NO: 712696 - DNA, 1283 bp, Homo sapiens
  misc_feature (1)..(1): n is a, c, g, or t
  misc_feature (7)..(7): n is a, c, g, or t
  misc_feature (9)..(9): n is a, c, g, or t
  misc_feature (12)..(12): n is a, c, g, or t
  misc_feature (14)..(15): n is a, c, g, or t
  misc_feature (17)..(17): n is a, c, g, or t
  misc_feature (21)..(21): n is a, c, g, or t
  misc_feature (25)..(25): n is a, c, g, or t
  misc_feature (34)..(34): n is a, c, g, or t
nacgctngncancnngnccgntcgnctccacgcnggtcaccaacaccagcatccagttcaacctgcgcaacctctaccgcctctccaaggccctcttcccgccggagcccctggtgctgcgagagatgtgcaagcagggataccgggatggcctgcgctttctgcagcggaacggcctcctgaaccggcccaaccccttgctggcgttgccccccgcccgcccccacggcccagaggacaaggaccaggcagtggagagcgcccaagcggaggattactcgcagctgcccggagaagatcacatcctggagcacctgcccgcccggctcaatgaggccctgctggaggcctgcgtggagcccacggacctgctgaccaccctctccaacatgctgcctgtgcgtctggccacggccatgatggtgccctacacgctgccgctggagagcgctctgtccttcaccatccgcttgctggagtggctgcccgacgttcccgaggacatccggtggatgaaggagcagacgggcagcatctgccagtacctggtgatgcgcgccaagaggaagctgggcaggcacctgccctccaggctgccggagcaggtggagctgcgccgcgtccagtcgctgccgtccgtgccgctgtcctgcgccgcctacagagaggcactgcccggctggatgcgcaacaacctctcgctgggggacgcgctggccaagtgggaggagtgccagcgccagctgctgctcggcctcttctgcaccaacgtggccttcccgcccgaagctctgcgcatgcgcgcacccgccgacccggctcccgcccccgcggacccagcatccccgcagcaccagccggccgggcctgcccccttgctgagcacccctgctcccgaggcccggcccgtgatcggggccctggggctgtgagaccccgaccctctcgaggaaccctgcctgagacgcctccattaccactgcgcagtgagatgaggggactcacagttgccaagaggggtctttgccgtgggccccctcgccagccactcaccagctgcactgagaggggaggtttccacacccctcccctgggccgctgaggccccgcgcacctgtgccttaatcttccctcccctgtgctgcccgagcacctcccccgcccctttactcctgggaactttgcagctgcccttccctccccgtttttcatggcctgctgaaatatgtgtgtgaagaattatttattttcgccaaagcacatgtaataaatgctgcagccca

SEQ ID NO: 712697 - DNA, 1150 bp, Homo sapiens
  misc_feature (32)..(32): n is a, c, g, or t
tcgactctagaggatcccgtcagcatttcagnagcggaacggcctcctgaaccggcccaaccccttgctggcgttgccccccgcccgcccccacggcccagaggacaaggaccaggcagtggagagcgcccaagcggaggattactcgcagctgcccggagaagatcacatcctggagcacctgcccgcccggctcaatgaggccctgctggaggcctgcgtggagcccacggacctgctgaccaccctctccaacatgctgcctgtgcgtctggccacggccatgatggtgccctacacgctgccgctggagagcgctctgtccttcaccatccgcttgctggagtggctgcccgacgttcccgaggacatccggtggatgaaggagcagacgggcagcatctgccagtacctggtgatgcgcgccaagaggaagctgggcaggcacctgccctccaggctgccggagcaggtggagctgcgccgcgtccagtcgctgccgtccgtgccgctgtcctgcgccgcctacagagaggcactgcccggctggatgcgcaacaacctctcgctgggggacgcgctggccaagtgggaggagtgccagcgccagctgctgctcggcctcttctgcaccaacgtggccttcccgcccgaagctctgcgcatgcgcgcacccgccgacccggctcccgcccccgcggacccagcatccccgcagcaccagccggccgggcctgcccccttgctgagcacccctgctcccgaggcccggcccgtgatcggggccctggggctgtgagaccccgaccctctcgaggaaccctgcctgagacgcctccattaccactgcgcagtgagatgaggggactcacagttgccaagaggggtctttgccgtgggccccctcgccagccactcaccagctgcactgagaggggaggtttccacacccctcccctgggccgctgaggccccgcgcacctgtgccttaatcttccctcccctgtgctgcccgagcacctcccccgcccctttactcctgggaactttgcagctgcccttccctccccgtttttcatggcctgctgaaatatgtgtgtgaagaattatttattttcgccaaagcacatgtaataaatgctgcagccca

SEQ ID NO: 712698 - DNA, 441 bp, Homo sapiens
tgggagtgcattattttctctgcttaaaataaaagccggggctgggtgcagtggctcatgcctgtaatcccagcactttgggaggctgaggcgggtggatcacaatgtcaagagatggagaccatcctggccaacatggatgtaaaaatacaaaaatcagccgggcgtagtggaaagcgcctgtagtcccagctactcaggaggctgaggcagaagaatcaattgaacctgggaagtggaggttgcagtgagccgagatcacgccactgcactccagcctggcgacagagcaacactccgtctcaaataaagaaataaattaaagctgggcaggtggctcattcctgtaatcccagcactttgggaggtgaagcggatggatcacctggagtcacgaatttgaggccagcctggccaacgtggtgaaaccctgtttctact

SEQ ID NO: 712699 - DNA, 152 bp, Homo sapiens
atgagctggtaccactcattgatattcaaccgtgagcaaccgcagagaaacgccgcacacgcggggtcatcccgtgcctggcggcgagatgacggacgcgattacagcgtgcgcaagatccggttcagcagcggccccagcactttgaacga

SEQ ID NO: 712700 - DNA, 224 bp, Homo sapiens
ctcacgctcgaagttacgccgcagatcacgccggacggaacatcatcctcgacgtgaacatcaccaaggacagccgggcaagaccacgcctgccggattcgcgatcaacaccaagcacgtaaggacccaggtactgttcgagaccggcggccggtggtaatcggcggcatcttcgagcaaggtcgaccgggataaggtgtcgcaaatatcattccagggtaccc

SEQ ID NO: 712701 - DNA, 1156 bp, Homo sapiens
agcggccgcgctgatgaactgagaatcccttctctccccaaccccaggcctcctgaaccggcccaaccccttgctggcgttgccccccgcccgcccccacggcccagaggacaaggaccaggcagtggagagcgcccaagcggaggattactcgcagctgcccggagaagatcacatcctggagcacctgcccgcccggctcaatgaggccctgctggaggcctgcgtggagcccacggacctgctgaccaccctctccaacatgctgcctgtgcgtctggccacggccatgatggtgccctacacgctgccgctggagagcgctctgtccttcaccatccgcttgctggagtggctgcccgacgttcccgaggacatccggtggatgaaggagcagacgggcagcatctgccagtacctggtgatgcgcgccaagaggaagctgggcaggcacctgccctccaggctgccggagcaggtggagctgcgccgcgtccagtcgctgccgtccgtgccgctgtcctgcgccgcctacagagaggcactgcccggctggatgcgcaacaacctctcgctgggggacgcgctggccaagtgggaggagtgccagcgccagctgctgctcggcctcttctgcaccaacgtggccttcccgcccgaagctctgcgcatgcgcgcacccgccgacccggctcccgcccccgcggacccagcatccccgcagcaccagccggccgggcctgcccccttgctgagcacccctgctcccgaggcccggcccgtgatcggggccctggggctgtgagaccccgaccctctcgaggaaccctgcctgagacgcctccattaccactgcgcagtgagatgaggggactcacagttgccaagaggggtctttgccgtgggccccctcgccagccactcaccagctgcactgagaggggaggtttccacacccctcccctgggccgctgaggccccgcgcacctgtgccttaatcttccctcccctgtgctgcccgagcacctcccccgcccctttactcctgggaactttgcagctgcccttccctccccgtttttcatggcctgctgaaatatgtgtgtgaagaattatttattttcgccaaagcacatgtaataaatgctgcagccca

SEQ ID NO: 712702 - DNA, 812 bp, Homo sapiens
tgtcgaataattaagttatctccacgccaatgttcaaagagtacagaccagcatagttctgctaatcacagttttacagatgggcactatgaggtttgcaaaaagggagaaggatctttttcactgtactgtattgggacgctggtaacgtgttaacccaggtgttcagcatagcagctatatatatatatatatgtatatactttcattattcttcactataatttgccagacagagatcagaattgaacctgtcaatgtgaaataaacgagttctccttgtacttgaataataaccacgattccaacccaggtctgctttggggcttatcagaactcctttctaaggagcactagaatgagacatcatgttgctcgatcgtttcacatctgatatatcagactctaaagcagagatgtctaatggtgatactccaagcgtggcatagccatcacatttacaaccttccagatttgagctgccatggcgggaatccatatcagctcctgcataagattatatacacacagctgtccactcacaaaaaggctggatgttgcttacatccaactggcaatgctttattctatccaaggtacattcatactcaaaagaggccagtacatattgaccactcccttgaccctctcctgtgtcatcaagggccccaaaattaaccagctaggcacaggctacccaacctcacagtcgacatcgtacataaaacgattccatagatcattgaaccactagcacccaatcgcagaaacacaggagcttacacataaccctgactggctgcgctaagtat

SEQ ID NO: 712703 - DNA, 1034 bp, Homo sapiens
  misc_feature (1029)..(1029): n is a, c, g, or t
ggcggccccagtcagacgcaggcagccccaaagcctgaacaggcagggccagacccagcttcttcgcctccgccagcggggaccccgagctagagccgcagcgggacctgcccggcccccggctccagcgagcgagcggcgagcaggcggctcacagaggcctggccgcccacggaacccggggcccggcggccgccgccgcgatgtttccccgcgagaagacgtggaacatctcgttcgcgggctgcggcttcctcggcgtctactacgtcggcgtggcctcctgcctccgcgagcacgcgcccttcctggtggccaacgccacgcacatctacggcgcctcggccggggcgctcacggccacggcgctggtcaccggggtctgcctgggtgaggctggtgccaagttcattgaggtatctaaagaggcccggaagcggttcctgggccccctgcacccctccttcaacctggtaaagatcatccgcagtttcctgctgaaggtcctgcctgctgatagccatgagcatgccagtgggcgcctgggcatctccctgacccgcgtgtcagacggcgagaatgtcattatatcccacttcaactccaaggacgagctcatccaggccaatgtctgcagcggtttcatccccgtgtactgtgggctcatccctccctccctccagggggtgcgctacgtggatggtggcatttcagacaacctgccactctatgagcttaagaacaccatcacagtgtcccccttctcgggcgagagtgacatctgtccgcaggacagctccaccaacatccacgagctgcgggtcaccaacaccagcatccagttcaacctgcgcaacctctaccgcctctccaaggccctcttcccgccggagcccctggtgctgcgagagatgtgcaagcagggataccgggatggcctgcgctttctgcagcggaacggtgcgcggacccgggcgggagagggcggggtgggctcggctctgctaccccctgcgggccgcggccgcnagctt

SEQ ID NO: 712704 - DNA, 417 bp, Homo sapiens
  misc_feature (20)..(20): n is a, c, g, or t
  misc_feature (72)..(72): n is a, c, g, or t
  misc_feature (76)..(76): n is a, c, g, or t
  misc_feature (81)..(81): n is a, c, g, or t
  misc_feature (104)..(105): n is a, c, g, or t
  misc_feature (114)..(114): n is a, c, g, or t
  misc_feature (121)..(121): n is a, c, g, or t
  misc_feature (124)..(124): n is a, c, g, or t
  misc_feature (133)..(133): n is a, c, g, or t
  misc_feature (203)..(203): n is a, c, g, or t
  misc_feature (205)..(205): n is a, c, g, or t
  misc_feature (223)..(223): n is a, c, g, or t
  misc_feature (280)..(281): n is a, c, g, or t
  misc_feature (398)..(399): n is a, c, g, or t
catattgggagaaatttgangatgagaacttcatcctaaagcatacgggtcctggcatcttgtcatggcaanttgntgganccaacacaaatggttcccagttnntcatctgcnctgccangantgagtggtnggatggcaagcatgtggtgtctggcaaagtgatagagggcatgaatattgtggaggccatggagcgcttngngtccaggaatggcaagancagcaagaagatcaccattgctgactgtggacaactcgaataagtttgacttgtgtnntatcttaaccaccagatcattccttctgtagctcaggagagcacccctccaccccatttgctcgcagtatcctagaatctttgtgctctcgctgcagttccctttgggttccatgtnntccttgtaccctcccatg

SEQ ID NO: 712705 - DNA, 123 bp, Homo sapiens
tcacggagatgtacggctcctcttttgacttggcctatgactttcaacgggactattatgataggctgtacagttacccagcacgtgtacctcctcctcctcctattgctcgggctgtagtgc

SEQ ID NO: 712706 - DNA, 909 bp, Homo sapiens
tagtgtgccctgaaaaatgtacacgtttttcttattgttcaccacatgttcacctttatcagcgtggatactgtcagcatgagtacatatttcaacccactgcttgtcaaaagacatgagagtctcatattaaggaccatacattcagttccttggtccttggaagacctatatacttctgtagttacgtgaaaagcgaagagtcaattctgaattgattcatctttacattatttttccgaccatgtcatttgaaaacttgcttttaaccttctgcataagagattcttatgccaaaaacattaaacagaagaagtcattttttggctatgtaatacctcgcaactttgctctagaatcaagctcagttattattttcccaagttcgacccatgttccattatcagatgccttgtaaattatgtcttaacgttacttatagactaactttcctcttttccacctgccagatttgctaaacatagctcgaaaatgagcatgaaaaaagcagtacactgtattatttctcctaaaactaaggcatatctgtgtggttggcattgctgctcctatgtggtacgtctcggatagtagatgcttctacagcgtaagaagtagcgtatgataattccctttgtatctcttccagtacatcagtgctgaaaaactcctgacttcttggatcatagtgcactgaattacagtataatggttggtggcccagtacagctatatattgtggctcttacagccttgggattcatgtgccttttaaaatctctattcccttgttccactctaaaggcacggtaccagtttgccataagttgcgctgaacagggtgggacacattcacgggcgctcgaagaatcttgcgaacaaaaaaaaggggggcaaacacggggccaa

SEQ ID NO: 712707 - DNA, 1298 bp, Homo sapiens
agcggccgcgctgatgaactgagaatcccttctctccccaaccccaggcctcctgaaccggcccaaccccttgctggcgttgccccccgcccgcccccacggcccagaggacaaggaccaggcagtggagagcgcccaagcggaggattactcgcagctgcccggagaagatcacatcctggagcacctgcccgcccggctcaatgagggtgcgcacctgggggacgggaggggaggaggggaggcaggagggaaagagagagaggagaggacggtgagcaggggagggaagccgagcgggtcctgggccccgctgcctccactggccgccgacctcccgcccacccgcagccctgctggaggcctgcgtggagcccacggacctgctgaccaccctctccaacatgctgcctgtgcgtctggccacggccatgatggtgccctacacgctgccgctggagagcgctctgtccttcaccatccgcttgctggagtggctgcccgacgttcccgaggacatccggtggatgaaggagcagacgggcagcatctgccagtacctggtgatgcgcgccaagaggaagctgggcaggcacctgccctccaggctgccggagcaggtggagctgcgccgcgtccagtcgctgccgtccgtgccgctgtcctgcgccgcctacagagaggcactgcccggctggatgcgcaacaacctctcgctgggggacgcgctggccaagtgggaggagtgccagcgccagctgctgctcggcctcttctgcaccaacgtggccttcccgcccgaagctctgcgcatgcgcgcacccgccgacccggctcccgcccccgcggacccagcatccccgcagcaccagccggccgggcctgcccccttgctgagcacccctgctcccgaggcccggcccgtgatcggggccctggggctgtgagaccccgaccctctcgaggaaccctgcctgagacgcctccattaccactgcgcagtgagatgaggggactcacagttgccaagaggggtctttgccgtgggccccctcgccagccactcaccagctgcactgagaggggaggtttccacacccctcccctgggccgctgaggccccgcgcacctgtgccttaatcttccctcccctgtgctgcccgagcacctcccccgcccctttactcctgggaactttgcagctgcccttccctccccgtttttcatggcctgctgaaatatgtgtgtgaagaattatttattttcgccaaagcacatgtaataaatgctgcagccca

SEQ ID NO: 712708 - DNA, 1106 bp, Homo sapiens
ggcctctagctgctgatgagcttcagagctcaagatatagacagatgctggctgatgcaccacgtctgttggagaacgagcatccatgggctccgcaaggtcattgatgcacaccaagtatcgacatcggacatgctagtcgtggcagacagcgatctgaggcgtctccaggagggagctgctcttcactgaagaagaaccacgaagaggaagtaacaggcctacaagcccagattgccagctcagggtagaccgtggaggtagatgcccccaaatctcaggagctcgaccaaagatcatggacagacatccgggcccaatatgacgatgctggctctggacagaaccgagaggacgctacgacaacgtactggtctcaagcacgacttgaggacgagcatgcacagtggtcaccctagacagtctgctgaggttggacgctgcctagagtaccgacgctcacgagagtctagagacagtacagtccacgtccttgcgagaatcgaccctggaactccatgagaaatctcgaacggtccagcttggagaaacatgcctgacgccggtggcaagccctggtaatgccctacaagattgagaagcactcatcaaacgggatcctgcctgcagcctttgaagtccaggagcatgggaacaggatcccggggtcagaagggacagcgcaccaggtcccaggatgatatgaggcgccctggttgacaacatgaacggtcaaagcgtggtcggcttgagaatcgcccaaccttaccgcacgccttgcttggaacgatggcgagggcattttcgatcttggatagaatgcctaggggagagcagcaacaatccaatgcgaatcgcatccagagaagaccagcccaagccctgcccgggcagtacgtgcaaaagcgcaacaggcatgcaagagtcttgaagacccaaatggacaaccacagggtccaggcggccattaagagcacaccccgcacgcagaggatacgcactatgggggcaaacaaggaggcgcccaataaccgagcacacagaagtacaaaggccaacacaaacacaacacgtcgaaggcgagacacactccgaggacacgacac

SEQ ID NO: 712709 - DNA, 867 bp, Homo sapiens
  misc_feature (849)..(849): n is a, c, g, or t
ggcggccccagtcagacgcaggcagccccaaagcctgaacaggcagggccagacccagcttcttcgcctccgccagcggggaccccgagctagagccgcagcgggacctgcccggcccccggctccagcgagcgagcggcgagcaggcggctcacagaggcctggccgcccacggaacccggggcccggcggccgccgccgcgatgtttccccgcgagaagacgtggaacatctcgttcgcgggctgcggcttcctcggcgtctactacgtcggcgtggcctcctgcctccgcgagcacgcgcccttcctggtggccaacgccacgcacatctacggcgcctcggccggggcgctcacggccacggcgctggtcaccggggtctgcctgggtgaggctggtgccaagttcattgaggtatctaaagaggcccggaagcggttcctgggccccctgcacccctccttcaacctggtaaagatcatccgcagtttcctgctgaaggtcctgcctgctgatagccatgagcatgccagtgggcgcctgggcatctccctgacccgcgtgtcagacggcgagaatgtcattatatcccacttcaactccaaggacgagctcatccaggccaatgtctgcagcggtttcatccccgtgtactgtgggctcatccctccctccctccagggggtgcgctacgtggatggtggcatttcagacaacctgccactctatgagcttaagaacaccatcacagtgtcccccttctcgggcgagagtgacatctgtccgcaggacagctccaccaacatccacgagctgcgggtcaccaacaccagcatccagttcaganccgcgcctcagttcagat

SEQ ID NO: 712710 - DNA, 296 bp, Homo sapiens
ttgtgctctttgctctgttgcccagggtgaagtggggtagtgcgatcttggttcactgcagcctcaacctcctgagatcaagcgatcctcccacctcagcctcccaaatagctaggactacaggcacacattaccacacgtagctaatttttttttttttttttttttttggggggggaaagaaggttttttaatttagcaaggggggtttagaatttccggggctaaagagtttctccccttttgtcccccaaaggggttgggtttacggtaaaaaccccccggcctggacaaaa

SEQ ID NO: 712711 - DNA, 1408 bp, Homo sapiens
  misc_feature (813)..(813): n is a, c, g, or t
  misc_feature (847)..(847): n is a, c, g, or t
  misc_feature (855)..(855): n is a, c, g, or t
  misc_feature (1403)..(1403): n is a, c, g, or t
ggcggccccagtcagacgcaggcagccccaaagcctgaacaggcagggccagacccagcttcttcgcctccgccagcggggaccccgagctagagccgcagcgggacctgcccggcccccggctccagcgagcgagcggcgagcaggcggctcacagaggcctggccgcccacggaacccggggcccggcggccgccgccgcgatgtttccccgcgagaagacgtggaacatctcgttcgcgggctgcggcttcctcggcgtctactacgtcggcgtggcctcctgcctccgcgagcacgcgcccttcctggtggccaacgccacgcacatctacggcgcctcggccggggcgctcacggccacggcgctggtcaccggggtctgcctgggtgaggctggtgccaagttcattgaggtatctaaagaggcccggaagcggttcctgggccccctgcacccctccttcaacctggtaaagatcatccgcagtttcctgctgaaggtcctgcctgctgatagccatgagcatgccagtgggcgcctgggcatctccctgacccgcgtgtcagacggcgagaatgtcattatatcccacttcaactccaaggacgagctcatccaggccaatgtctgcagcggtttcatccccgtgtactgtgggctcatccctccctccctccagggggtggtgagtattcctagccctggacaccttctatggggtgggccgtgggatgagggacagaggaggaggccgcctagagccatccttcaggcccttgctctgccaccgcctgttacccacttccccntgtgttactcaaaaacagctgtggcaacgcacgnttcctggncccccattcccttcctccgtccctgccttcccccgtctaccatctgctcagtgcccaggctggcccacagccagtgcccagtgggtaaaacgctcaaatgaggtagccactgaatggggcccttggtggccgggtggggtggctggggtgggtggccagtgcagccacaggccctcacatacggtcctgtctgtgtgtcccgtggaagcgctacgtggatggtggcatttcagacaacctgccactctatgagcttaagaacaccatcacagtgtcccccttctcgggcgagagtgacatctgtccgcaggacagctccaccaacatccacgagctgcgggtcaccaacaccagcatccagttcaacctgcgcaacctctaccgcctctccaaggccctcttcccgccggagcccctggtgctgcgagagatgtgcaagcagggataccgggatggcctgcgctttctgcagcggaacggtgcgcggacccgggcgggagagggcggggtgggctcggctctgctaccccctgcgggccgcggccgcnagctt

SEQ ID NO: 712712 - DNA, 1112 bp, Homo sapiens
attacctcagaaatttttttcttcgcaggatttttctgagccgttttaccacatccagacctagcccctaccaccccaattaggagggcactggccccccaacaggcatcacacccgctaaatcccctagaagtcccactcactaaaacacatccgtattactcgccatcaggagtatcaactcacctgagcatcaccaatagatctaatagaaaacagccgaacaccacaaatacatctcaagcactgcctctatctacacatctctcacatgggatctctagttattaccctcctacaagcctcagagatacttcgagtctcccattcaccattatccgcacgcgcatctacgagatcaacattaaaccagtagaacaacaggccttcccacggactatcacgtccattactcggctcaaactttcctcactcatcctgcttcattccgccacactcactatctcacacctttaccatccaaaacacactcacataagggactccggaaacgccgaccgaccctgaactaacaggacatacacagtcaaaacggtcggctaagcaacaaataacccagaaatgacaatccccaaataccacgcaagacggggccgcaaccaccacagcaagcaaaaacaacacaaaaagaacaaatcacgcaaaagaaagccaaaagggacgaacgacatcgcgtacgagcgggggcggcgggccgccgcggggccgagggcagaatgatcccaccagaaccaaccacacccgtgcagagccactgctacggacaccgtaaacgcccgacctgccccaaggcacaagggagatagaaccaatgagatggacgacagaagagaaacacgggacggaaccggagacaaggaaggagacggcagcaaataaaaagccagacgaaaagacagacacttgaggggagcaacaaagaggcacacaagcacaggacgacaacacgaagcacgagggcggcgcaaaagcgaaagcagaccacacgagtggggatgtataagaacaaggacggggaacacaccaggagccagcgagaggaaagaagcccacgaacggggcggggcacgcagaagagaaggaaacgcaac

SEQ ID NO: 712713 - DNA, 157 bp, Homo sapiens
ctgatagactgctgtgcacgctgatgcgagttgctgacgctgccctgtgctcatgaagctgctccatcacggcaccgctggccgcccacatctcctttgtgaacaaggccgttgtcgactacttcttcgtggagctgctcctggaggcgcactatga

SEQ ID NO: 712714 - DNA, 375 bp, Homo sapiens
actttgggaggctgaggcgggcagaaaaactgaggtcaggagttctagaccagcctggccaacaggtgaaaccccgtctctactaaaaatataaaaaaattagccaggcatggtggtgggcacctgtaatcccagctactcgggaggctgaggcaggagaattgcttgaacccaggagatggaggttgcagtgagccggcacggtgccattgcactccaggcctgggcgacagagtgagactccatctcaaaaacaaaaaaaacacaaaattgctgcgtcacaggcacgagccactatgcctggctctcctctcgccttatcttatttttctctatctcgagacagggtgtttctctctcccccagcctggagtc

SEQ ID NO: 712715 - DNA, 1522 bp, Homo sapiens
  misc_feature (799)..(799): n is a, c, g, or t
  misc_feature (1186)..(1186): n is a, c, g, or t
ggcggccccagtcagacgcaggcagccccaaagcctgaacaggcagggccagacccagcttcttcgcctccgccagcggggaccccgagctagagccgcagcgggacctgcccggcccccggctccagcgagcgagcggcgagcaggcggctcacagaggcctggccgcccacggaacccggggcccggcggccgccgccgcgatgtttccccgcgagaagacgtggaacatctcgttcgcgggctgcggcttcctcggcgtctactacgtcggcgtggcctcctgcctccgcgagcacgcgcccttcctggtggccaacgccacgcacatctacggcgcctcggccggggcgctcacggccacggcgctggtcaccggggtctgcctgggtgagcggggccgggggcggcaggcggggggctggcgggaaggccgtgcggggccgggggatggtctccgtgagcggaggggccccgcggcgagtcggtgggtaccgtggggagggttccggtccgcgcctggggaacccggcgaggatccaatccgggtcgctggcctgggggcggggcctggtttgttttgctccgagggtgcccggggcccgcctgtcgggcgcaaaggtttgggggcgggcaggtgcagcaaaagctgcttaattggacagaaaaagtaactcgtgggcgggaccgtgagaatccgaggagggacctaagtcaccccgtggccctggatattacaaccggtgccagcggtcggtcacagtgtcctgggcttcgcagttgcaggctgctatcaggnggcctggcatggggtagcctcttgagaggcgtctgggaaccgtgacctggtccttcccaagggcccggaggaggagccccgctgaggtcagggctgggcgcgaaggggctctcctgccctctccttgcacacggtgccctgtggcctggctccccgctgcggcccaccgcgtttgcacacttcatgggtgagggtgcttctgggctctggtgcctgggtcaggagtggatgggtctctgtgtgctgggctggcctcggctcgcaccatcggctgccatgagggagtgatgtttacagcacacgacttcaggagcctgtgaggacacccaagatgacaggggcactctgctcagcaggagcctgtccggggctcacccctgccctctncctctgaactttgtcctgggagggagggggctggaccacagaagtgaacctcaacaggaacgacaataactagagctataattgagaaaagcacccatacgaaacacgataaaaacatcaatggaagaccaacagaaaagacgacagcaaaaggacagcaggaaacaagaacaataaaggacccaagaaaacacgagacgcaagagacaacatagtacaccacaggcgcaaagaaaaaggagacgaataaatacaaccgacaaagcagcaaaagatggaacaaaaaaacacgcagacaaagaaacaaaaggaaacaagaaaaaaaataaacaaagc

SEQ ID NO: 712716 - DNA, 1648 bp, Homo sapiens
  misc_feature (799)..(799): n is a, c, g, or t
  misc_feature (1186)..(1186): n is a, c, g, or t
ggcggccccagtcagacgcaggcagccccaaagcctgaacaggcagggccagacccagcttcttcgcctccgccagcggggaccccgagctagagccgcagcgggacctgcccggcccccggctccagcgagcgagcggcgagcaggcggctcacagaggcctggccgcccacggaacccggggcccggcggccgccgccgcgatgtttccccgcgagaagacgtggaacatctcgttcgcgggctgcggcttcctcggcgtctactacgtcggcgtggcctcctgcctccgcgagcacgcgcccttcctggtggccaacgccacgcacatctacggcgcctcggccggggcgctcacggccacggcgctggtcaccggggtctgcctgggtgagcggggccgggggcggcaggcggggggctggcgggaaggccgtgcggggccgggggatggtctccgtgagcggaggggccccgcggcgagtcggtgggtaccgtggggagggttccggtccgcgcctggggaacccggcgaggatccaatccgggtcgctggcctgggggcggggcctggtttgttttgctccgagggtgcccggggcccgcctgtcgggcgcaaaggtttgggggcgggcaggtgcagcaaaagctgcttaattggacagaaaaagtaactcgtgggcgggaccgtgagaatccgaggagggacctaagtcaccccgtggccctggatattacaaccggtgccagcggtcggtcacagtgtcctgggcttcgcagttgcaggctgctatcaggnggcctggcatggggtagcctcttgagaggcgtctgggaaccgtgacctggtccttcccaagggcccggaggaggagccccgctgaggtcagggctgggcgcgaaggggctctcctgccctctccttgcacacggtgccctgtggcctggctccccgctgcggcccaccgcgtttgcacacttcatgggtgagggtgcttctgggctctggtgcctgggtcaggagtggatgggtctctgtgtgctgggctggcctcggctcgcaccatcggctgccatgagggagtgatgtttacagcacacgacttcaggagcctgtgaggacacccaagatgacaggggcactctgctcagcaggagcctgtccggggctcacccctgccctctncctctcatggaggccttcagacaagcgcctcagtcggccccctggcttcaagatacatcaaggtccctgctacccgagccaaggacacctctcccacagtgcttccccaccctgctcccaacaagactccttctcacgggtggtcttgcacagctggagcccatagtgcagcaggtgctggctgaagagcccctggctccacactgccccactcctgaccagggtggggaagcactgtgggagaggtgtccttggctcgggtagcagggaccttgatgtatcttgaagccagggggccgactgaggcgcttgtctgaaggcctccatgagagggagagggcaggggtgagccccggacaggctcctgctgagcagagtgcgcctgtcatcttgggtgtcctcacaggctcctgaagtcgtgtgctgtaacatcactccctcatgcagcctattgtctacccc

SEQ ID NO: 712717 - DNA, 176 bp, Homo sapiens
ggtagaccagtgtcatgtatactccatgattttttttctcctccttcttcccttgactgttgggatacagaaatatttcacacaaatgatttctaatacgattgagtaggaaggaaatcagcttactttaaaagtctagaagcattcttaagtctgcttttcccagaatacaaaca

SEQ ID NO: 712718 - DNA, 812 bp, Homo sapiens
  misc_feature (330)..(330): n is a, c, g, or t
  misc_feature (499)..(499): n is a, c, g, or t
tcagagttgaaaaattttattaaacaaacaggtttcaacgaaaaagcaaatgaatacccctagaaaacttggacagcatttcccccagccagacaggcaggggaagggaggccaggaggggtaagccaaggggtgttccctaggaaagggccaggtttcccttctatccagcgtgggggccccgagaagcggcctcatttcagggaagctccaggagtggcagctgaaggcagcaggttttagcagccaaagcccaggcctaggtggatagacagggttccaaaagtggtgaccctttcatagggcgtggtatatctcaccagtgggggncgttcatgtgggctgacggatttcgtggcaaatattcggaacattcaacacagcggcagaaatgtggacagcattggaagctacctcatatcatttgtgcttcggtgatccatccgagctccgaaattttggcaacagctgattgcaagcgacgcagtataagaacagncgacccaagcacaccatttacagactaaagcttgaggccgacctatgctgaagaatcatgcccagaaggttcatgtagtccggcagtcgggtacgtccaaggccgcgttaatattcgctcgagaggggggattgtacctcagacactttgttacggcctccggtgggtccgacatatggtctagtggacataagcgagtcgaaaggcaacatcgttttttaaaccctgcggggcaatccctggaagaaccgcgtgatgccagggacaaacgcggcacgggaagcaacacctccttaaaattccactgtgctac

SEQ ID NO: 712719 - DNA, 381 bp, Homo sapiens
  misc_feature (12)..(12): n is a, c, g, or t
  misc_feature (27)..(27): n is a, c, g, or t
  misc_feature (63)..(63): n is a, c, g, or t
  misc_feature (223)..(224): n is a, c, g, or t
  misc_feature (296)..(296): n is a, c, g, or t
acttggcccctnccctaaagatggaanagttttggcaacccctgccttgtctccaggagcaancacttgcccaacagaaattctctgatgatatggctggttgtggtggctcacgcttgtaatcctagcacatcgggatgccgaggcaggtggatcccttgagctcaggagttcgagaccagcctgggcaacatggcgaaaccctgtctctacaaaaaatatnnaaaattagccaggtgtggtggcatctcaggaggccaagtcccagctacttgggaggctgaggtgggaggatnacttgagcccaggaggttgatgctgcaatgagctgtgattgcaccactgtactccagcctgggcaacagagcaaggtcctgcttc

SEQ ID NO: 712720 - DNA, 463 bp, Homo sapiens
ggccggagaggggggtgggggagcaaaaaccaaccccttttcccctgggttcctgttttggggcccgcaccaggaagggcccccttttttttttccccagcctttttattttcgcctttccaggaaatgggcccccccccctccatttggcattggtcccccccctggcctggtccatttgaggtttccagaggggccccaaatggtcctttctttttttggtttttttttcccccccccccagcctcatttttcctccgggagcctttcccccctaacctttggatcccccagcctcatgttctgccccctccctatcctgcctggtccctgggtttcccccagatccccttttttcaaacagggcccgggcgggggggggccgggggtggggcccagccccccaactgccccccccccccccctttttggtttattttataaaaaaatgggggggcttcca

SEQ ID NO: 712721 - DNA, 236 bp, Homo sapiens
cggcttcagcctcccgagtagctgggactacgggtacatgctaccatgcttggctaatgttcttgatttttttttttaaagagttaaagtctcattacatggccgggggtggtctagatctcctgagctcaagcgatctgcccacctgggcccccaaaaggcggggattataggtgtgagccacggcgcatggctgccagcttttggtgctctccctctccagggggtacggagct

SEQ ID NO: 712722 - DNA, 306 bp, Homo sapiens
ggaagaaggaagcttctccccttcctaagctgaagccaaagcgaaggctttaaaggccaagaaggcagttttgaaaggtgtccacagccacaaaaagaggaggatccgcacgtcacccaccttccggcggccgaggacaattcgattccggagacagcccaaatatcctcggaagagcgcttccacggcgaaccacgcttgaccattatgttatcatcaaggttcccgtgaccactgagcttcatgaggagtagagacacacacactgttttcatttggatgtaagccacagcccatttaacaggt

SEQ ID NO: 712723 - DNA, 165 bp, Homo sapiens
ctgtgactgcaaagtttttatggagatgtcagaaagggaggaggagctgtgctggggctggtctgggttggctttttcctaccggatcctcgggcatggaagcgaatccaggttggatctgcagcaaacctgtaacctgacggtttcccacacagacaggacatg

SEQ ID NO: 712724 - DNA, 404 bp, Homo sapiens
cggcttattggttcaaaaatttggtcatttccaaatcttgttcgcaaattttcgcaaagtattccgtcttagtattttccgtttgcgtttccgtctgcgcaactgttgaaaagggctatcggtctgggcttctttgctttaaggttttgtgccttaaggtgtttttgtttcaagtctatttagttggttaacgcctggtttttgccaatctggtatttgtaaaccttcggccatttactttgtaatgagtctctttataggctgatttgggttccgggatcccccttgattttttttttttttttttttttttttttttttttttttttttgcggcaataaattcagtagctttatttttatatttcaattaggttccttgtatgctcaagaaacaagtgtgac

SEQ ID NO: 712725 - DNA, 866 bp, Homo sapiens
aacatggcacgatagggcgggtgggaattggacgaggtctgtgctgcagtggtgcctcccgtcagcatgctctcggcctcgcccggctgcagcgctgtctccgcggcagttcagcacctcggccagaacaatgctaaagttagctgtgctaggggcctctggaggcatcgggcagccatttcacttctcctgaagaacagcccttggtgagccgctgagcctctatgatatcgcagcacgacacccggagtggcgcagatctgagaccacagtcgagaccaaagctcgctgtgaaaggctacctcggacctgaacagcctgcctgactgcctgaaaggttgtgatgtggtagttattccggcgtggagtccccagaaatgccaggcatgacccgggactgacctgttcaacacgcaatgccacgattgtggccaccctgaccgttgcactgtgtcccagggactggccgggaagaccatgatctgcgtcattgcctaggtccaggttaattccatcgcgatcccctatcgacagcagaagttgttcaagaagcatggagtgtaacaaccctggacaaagatcttcggcgtgacgacgcctggacgatcgtcagagccaacactttgttgcagagactgaagggttaggatccaagctcgagatccaagagtcacctgtcattggtggccatgctgggaagaaccatcatgccccctgatctcatcaggtgtagccccaatgtggactttccccaggaacaagtgacagcactcactgggcgggatccaggagggcgccatggagtggtccaggctaaagccggagcaggctctgcacactctccatgggggtaatgccggcgccgc

SEQ ID NO: 712726 - DNA, 840 bp, Homo sapiens
  misc_feature (840)..(840): n is a, c, g, or t
gggcgcggtggctcacgcttgtaatcccagcactttgggaggccgaggcgggcggatcacgaggtcatgagatcgaggaccatcctggctaacagcggtggaaaccccgtctctactataaaaaaatacataatacactagattagccggtcgtgatggcgggcgcctgatagttcccagcttactcatgggaggctgcatgtgcagagtaggatatggccgtgtaaccctgggagcggtcgagtaaggggtgcggttgagccgatgatcgcgctaattgcatctccagttctggtgcagacacggagtgagattccgtctcataatgaagtggacctggtaggccaagagattgctttatacccttttccttggtctctgacccagtcctagttgacaccatttctcgtatcaactccaagatttcagcgtggagattaattccataaccatcacagaatttataacgtataaggtatatttggacttgcttataggtcaatgagtatactgtaaaaataagcctcagggtattattatccttctaaagccggctacaacttcaagtgcacctatcttataccccacttactggttcgtcttagttggggaacacaagcgtagggcctggtgttcacctgcctggaggtgagcctcaggggcctcaatctggggtgcccaaaataaacttattcgctgaaatttcccctggcatttgttctggcccccttccgttctttgggttccccactgggcccaagttctcgagaggccctggtttttgtatttcttggcactcgtcctttcctcgggtctcccttgtgatcggcggggtggccn

SEQ ID NO: 712727 - DNA, 324 bp, Homo sapiens
gggaatttaaaaatagcaggaggaaagcagtgaatcacaatataagggaagccccatcagactaacagcagaaatcttataggccaggagagaatgcgactgatatacttcaacaatactggacagaatgaaactactggaccaagaatactacacctcgacacagctgtctttttagacatgaaggataaatacattctttcccagatcagaaaaaaatcaagggaatttatcaacactagatagccctacaagaaatgcttcagggagttctaaatctgaaagtgaaacgcggcaatatgtaccgccatggagtaaatggca

SEQ ID NO: 712728 - DNA, 324 bp, Homo sapiens
  misc_feature (203)..(203): n is a, c, g, or t
aaacagtattgcccttataaggaagccccagccaggtgtggtggctcacgcctataatcccagcactttgggaggctgaggcaggtggatcatgaggtcaggagttcgagaccagcctggccaataaggcaaaacaccatcttgactaaaaatacaaaaattagctgggcgtggtggcatgtgcctgtagtcccagctacttnggaggctaaggcaggagaattgcttgaacccaacaggcagaggttatagtgagccaagatcacacttcagcctgggcaataagagcaaaactatcttttaaaaaaaaaaaaggcagtgcca

SEQ ID NO: 712729 - DNA, 236 bp, Homo sapiens
  misc_feature (22)..(22): n is a, c, g, or t
  misc_feature (27)..(27): n is a, c, g, or t
  misc_feature (35)..(35): n is a, c, g, or t
aaaagtggagtgtttgtgtgcntgggngtgctttntctgtgaccagtgaagttggttgtgcgtttgtcaggctcggtgtccctgcagtgagatccaatttcgggtactcatataccgtagtagtccggtcttgaatcctggccgctggtgctcccgcctgcatctcggccctttgggggctgggtgggatccttggcctgggtcgctgcctgccccctggtgggcccccgtctcta

SEQ ID NO: 712730 - DNA, 172 bp, Homo sapiens
catccctttgtgaatgatcggactgctggtaatgacgctggaatcatgctgctgaatcataatatgactgctcatcatctgagccttgatgttgatcatagcctgactgctggtcatatgaatcttgtagaccatagactggctggtcataggcaggtgctcttccaacttg

SEQ ID NO: 712731 - DNA, 241 bp, Homo sapiens
ctctgagagcggtacaagagttctgtgcctgtgtgtccgagccctggaagccagccagtgcatttatttaaagctcttagaagcaactccttgggccaggaatgtgtgacccctgagatgggtccacgcatctcttctacacttccttctctccgtgggatactggcctcgtgttacaacgcgcattctctactcacgcatatacatgagctatagtcgcactttctgaatcacggtacgt

SEQ ID NO: 712732 - DNA, 812 bp, Homo sapiens
  misc_feature (41)..(41): n is a, c, g, or t
  misc_feature (58)..(58): n is a, c, g, or t
  misc_feature (63)..(63): n is a, c, g, or t
  misc_feature (67)..(67): n is a, c, g, or t
  misc_feature (70)..(70): n is a, c, g, or t
  misc_feature (84)..(84): n is a, c, g, or t
  misc_feature (87)..(87): n is a, c, g, or t
  misc_feature (144)..(144): n is a, c, g, or t
  misc_feature (162)..(162): n is a, c, g, or t
  misc_feature (183)..(183): n is a, c, g, or t
  misc_feature (204)..(204): n is a, c, g, or t
  misc_feature (264)..(264): n is a, c, g, or t
  misc_feature (272)..(272): n is a, c, g, or t
  misc_feature (303)..(303): n is a, c, g, or t
  misc_feature (312)..(312): n is a, c, g, or t
  misc_feature (324)..(324): n is a, c, g, or t
  misc_feature (358)..(358): n is a, c, g, or t
  misc_feature (370)..(370): n is a, c, g, or t
  misc_feature (394)..(394): n is a, c, g, or t
  misc_feature (407)..(407): n is a, c, g, or t
  misc_feature (415)..(415): n is a, c, g, or t
  misc_feature (422)..(422): n is a, c, g, or t
  misc_feature (429)..(429): n is a, c, g, or t
  misc_feature (522)..(522): n is a, c, g, or t
  misc_feature (558)..(558): n is a, c, g, or t
  misc_feature (590)..(590): n is a, c, g, or t
  misc_feature (606)..(606): n is a, c, g, or t
  misc_feature (646)..(646): n is a, c, g, or t
  misc_feature (658)..(658): n is a, c, g, or t
  misc_feature (675)..(675): n is a, c, g, or t
  misc_feature (703)..(703): n is a, c, g, or t
  misc_feature (708)..(708): n is a, c, g, or t
  misc_feature (724)..(724): n is a, c, g, or t
  misc_feature (732)..(732): n is a, c, g, or t
  misc_feature (749)..(749): n is a, c, g, or t
  misc_feature (772)..(772): n is a, c, g, or t
taattgctctatgcatttattattagctattattaatgcanaatgagggaacaaaaanctcanaaanacnctacacaatttcanaanacgcattgcaggggaaaaagtgactgagaaggatcaacagtttgctaaggtcttggnggacgcattcctgggggngggggacctctaatgcctggnggagggggtctcattcccggnggcggcatgccttttggcgtccctcgagcagggggaagcccaattggtgggcccatgggnggtctcanaccagggggaggagccaaaatgcctggaggnggggttgcnctgccgacgggngggggcggagtgccccgtcctggtgggtactgtnttggggctccancaatactggcagttgcagcaacancagccgctgctanagtgcctnttccctntggagtnattacctgctgggatggtcccccaactcctcggacagggcctgccaatccagcaggggcctggggaattggcacaccaactggtactcctctnccagctgccctaccaaccccagggcctccagcagcnccagcaagtggtacccgagcaatgccagtttntttgggggggggcccnccacagttatggataccaagttctccccacgcagcaacancagaaccaaaanccgctttttttcacgcnctggttgcttcgcattctttggcttganctttntgaactcatcacaatnacagaggntcaaattcatatgcttntaaaaagccttaaaggggcaatnaagattcggccattttgcaggataaatctcattctatagt

SEQ ID NO: 712733 - DNA, 635 bp, Homo sapiens
  misc_feature (2)..(2): n is a, c, g, or t
  misc_feature (11)..(11): n is a, c, g, or t
  misc_feature (34)..(34): n is a, c, g, or t
  misc_feature (46)..(46): n is a, c, g, or t
  misc_feature (60)..(60): n is a, c, g, or t
  misc_feature (85)..(85): n is a, c, g, or t
  misc_feature (141)..(141): n is a, c, g, or t
  misc_feature (237)..(238): n is a, c, g, or t
gncccaaggcnactgaggttcacacagatttctngctggccaatgngaatggtagagatngaaagtggaagagatgagatgaggnttccatgggtggctgtgtctgtacccttagcaagccacagctgctgtgggctgccntctcccgtggctgcagctactgtctccgtggtccggaacaccactccctccccttcaggccccagggtggtgacagctcctgctgtggccagcccnngtgcatagcacctcccttgttagttttccttataaagaatctctttgtacagtctcttcagtttggagagtaacatctctttccttcagggaccctgaccgggcccccgcctcgctggctcagcactgccaatgggacttgccatggggagtcactgtcatcttgtgtcatgttttgattaaaggagagggtcttccagtggaggagaggtcccagaatggagaccatgggacagtgaagctcttgaaactgaatgcccaacggtggattgtacgagctctttttttagagagaagatcatagctgtcattctatttgtgaaaactgtcccccaaaactgagccaaaaataaacattctaaacagtctcatgctaaataaagcaccagagaagccaa

SEQ ID NO: 712734 - DNA, 560 bp, Homo sapiens
ctagaggatcccgccggagggggtggggattgtgatgagaagtggttcttcaaattgtttttatggccttgcaaactcagaacttaaccatgataatgacatggtctgggaggggtgtctaagtttggctcaccatgagcagggaagggtggctgtgtaggagcaagtcctaattatagtgtaacagaaactcttctcaagatcagcagaggaaaacttaaacccatcaggggtgggggtatgcaaaggggaaattcctggtaggccttgtgaatttctgaaaggaaaaattgatttagtttacgtatctcacctttctcaggagaggccaggtgggctgaaaagggttggtctttgaccttcttatgatggtgggtccatctaaataaattggacagctcttcatgaagccatgaactctcgggtggggaatgatttcgtaagcagtcatttactccatatgccaccagcagcagccacatcagggctacaatcacgaccagcatggctaacatcaccatctccagaatcgccaccaccatctcctccacccaatatca

SEQ ID NO: 712735 - DNA, 140 bp, Homo sapiens
  misc_feature (83)..(83): n is a, c, g, or t
ggtcgtgcagctggaaagcaagaggaagaccatgcaggctcatcttctgaccaaggaggtcacccaggtggagagggaccccngcctggacagacaggcgggccagctcaggatccagatccagcaggtccgcggggagg

SEQ ID NO: 712736 - DNA, 188 bp, Homo sapiens
attgctcagatgagcgacgccaccacttatggcaaatggggtgctagctacccttaatcttccagcagcaattgacgatgtgtctggagacactgtacctcagtctatattgactacatccagatctgtgctagcacagggcggcctccagcactgtagcatccgctgcatcaaagcaatgcctgaat

SEQ ID NO: 712737 - DNA, 403 bp, Homo sapiens
tgaacattcgtgtccacggcaaagcaatgcaggtagcaggaactcaggaacgtgtattgattgagattttgtgcatcgatagaacacagtcacggaaatccgagaaattgtcatatgttatcagtcagaatttggacgagaccttgaacaggacattaggtcagatacatcaggacattttgaacgtttactcgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagc

SEQ ID NO: 712738 - DNA, 117 bp, Homo sapiens
gagggaggatattgaggcaagttaacagctgcaatgtgaccattataaataaaatagtgattgtaagtgttgatccagtataggagagagaggagatggtgatctggaggagaaggt

SEQ ID NO: 712739 - DNA, 236 bp, Homo sapiens
gggctactgtaatcccgacactttgggaagcttagatgggagaatccctaggggccaggagttcaataccagcctgggcaacatagggagaccctgtctctacaaaaaaaatttttaacaattagcccggtgtggtggtgtgagcctgcagtcccagctacttagaggcagatgtgggaggatcacttgagcccagtttgaggctagtccaggcaacatggcaagatcctatctct

SEQ ID NO: 712740 - DNA, 749 bp, Homo sapiens
  misc_feature (45)..(48): n is a, c, g, or t
  misc_feature (91)..(91): n is a, c, g, or t
  misc_feature (95)..(95): n is a, c, g, or t
  misc_feature (97)..(97): n is a, c, g, or t
  misc_feature (100)..(101): n is a, c, g, or t
  misc_feature (161)..(161): n is a, c, g, or t
  misc_feature (217)..(217): n is a, c, g, or t
actgtggctgtgggttttctcctatttctaaaaatgttctcttcnnnnctatgacagtttgaagtatggataaccaagagctcaggtcacncagncntgnnccccatcttgcttgcagttagctttgagatactaagcaagcgagggacttcactcttgancctgttttttcctcatctgtaaagtggggatagtggtacggcctacctcatagggntgtaatgagcactaaatgtgaagtgcttggcacagtgcctggcacatggtgagccacagctactgtgagtttctgtttatcccccttttttttttttataagcccatggtttattcttggagaattggtggtaacttcttcaggataacaccggagtccacaggctggagcagctggtgggcccagacagaactggcggtcccggctgggctggtccagcagggggggcgcttggcctcggtgagggcacagcagcaaggttcacgggatatccggggtgtctggtctgggggccaccaggcacaggttgggcttccgggtcagtgtcccgacacggggcgggaggggacaacggagcaaagcagcgcagggggtcagggaggggggacgacacgtgttggaaatcacattaccccaccctcagttgaagccccacgttccacaaacgtggggtcatagatggtccagtcaatggtccctccctggtgcagcacagcaccagaggaaggggtaactgaatctttaccacttg

SEQ ID NO: 712741 - DNA, 323 bp, Homo sapiens
cccccccccccccccccccccaaacaaacagggaagtttttttttgtggggggggggccgggcccccccctttttccttgggggcagggggggcctttttccgggcccgggggggaccccaaaattttttttttttttccccccccccctttaaggaaaggaagggttgggggagggccaacttttttgggccccgggtccggccccggccctttccccccctttttgggtgggcccaaacttgggggggggggggggggggggggggggggtttccccttttttccctttttttttaaaaaaaaggaaagccctttttggga

SEQ ID NO: 712742 - DNA, 1707 bp, Homo sapiens
  misc_feature (1707)..(1707): n is a, c, g, or t
gctctcccgagctgcagactcatgcaggacatcctcggggaccctggggacaactggccgacgtgggccggcatgagccctgaggttaaggcccggtcacagtcagggacccatgtgacgggggaaagtgctgccatggtctggactacgaggcgatagactagtacggggccatgcccgaggagtccctatgacgttccagctccacccacggctcgccacagatggcactccggcaacctgagggttacgaccgatctccgaactcgagaccccgaatcacagacacggggcgaaagagagtacgacgacgggaacgccatatacacagacgcagagaccaaacagacacatccaaagtgacaggacgcaaaggtgcacagggcaatacaaacacacacgagaaaaacagatggtaaccatgcaaggcatctaagccaatagcacaccacatatacaaaggagacggaaagaacgatcaagagcaaaaggcccagagtacacctgcatagaacacgaaagggaagaacaacaaggaacacaaaaggacgaccggagaaccggagagaggaaagaccgagccaatacgtgaaacacaagacagatccacgagtgcaacttaccaggaatggacgacacagacacacgaactacgacaacagaacacatggagaacgtgatacggcaacaacaaacggggcacacagaacagcgacacaacggagacatgacaatcgaaacaagtacaccagaggagtacgcacaaccgtgggcagacacacacatatgggcacgataccacgtaaccacgagaggggataaacacacgcgtgggcacgggtacaaccaccataggaaacagaggagaccacactgacaaagcacccgagagacaactaccaaactacggacacacacattagaaaaaaaagacaccaacagggacacagaagaaacacgggagaacacaaacagggaatagataaacccaactggagcgcacaacgagacaccaaataggggacaacgcagcagaaggataaagcgaacggagagacagacacacgagacacacgaacgagaccaaagcgaaaaggagaaaccgcaacgaacagaatgcgcagaagcagacaaccacaggagcaagagaaacacacacaacaaaaaagcagagatcacgacagacaagacacatgacaacacagaagcaaataaagtacaccagacaccacaggtgagattgagccaacacacccacgaaacaggacacaaggtagtaacaatacacgagcacagcacgagaacatgaggcacaacgaaacagccaaggaagcaacaacccacaaaagggaggagaaccaacacaggaacacgaaaaagaggatgcaatacacacgaaacagggacaaagaacacacacacaccgttaagcaacgagagaaaggaacggcagcacacattatcagagacataggagcgaccagaaacgaacaacaagggcgaccacgactatacaccacacgtctaagcacaaccacagtcgtaagaaagaggacacaacaccgaaagcagtgtagacgcaataagacaccgcagaggacaaacccaggtgaagtgagacacacagaaaacaaagaacataagcgaacaacaaaagaagaagagacgaacgagagaactacaaacactagcggggtagccacaagn

SEQ ID NO: 712743 - DNA, 802 bp, Homo sapiens
gcagcgacggttcttcattcctttacgagcacggcgctcttgcgctacgccctggatgagatgcccacgacgccttcctcagggcaccatcaagcatgaaccagtgcacatgatgtggtggatggggagggccgcaacgggccagaagttctccctgtgtattctgacgcctgagaaggagcatttcatccggtgcggagaccaaggagatcgtcagatgtggtggcttggatgatgctcatggtctatccccggtaccatacaagtcagcaatcagaacgaagaagacggaaagtggaggccctctcacacacacatggcagtcctggggacctgtcgctagatgggtggcatgttcaccatgcagtcgggcagacagcagcagcaggcagcagcatccccagtgctgagaaagtccccacacaccaagatccagcactctggtcagtgaagcaagagagaggagccgcgcacgggagcgggaggcgagagggccgcgtcctacgaccttgtgagctggtgctgaggttcctgtcccatccagcaggccctggctcaggagcgtggtgggcggcgtggggcctgtctgacagccactgagcccctgctgccctgctgcggagctttggggaagctgtatgcgggatcttgcccggaggcgggaggagcgccgaaagcgcgtcgggatgtcgattccacgacgggcccgggcttatgattgacctgggcctggtgttggcggcccagggggccttgggagcctcggcttagcccgtggattgacgggctcgggggccctttg

SEQ ID NO: 712744 - DNA, 191 bp, Homo sapiens
  misc_feature (19)..(19): n is a, c, g, or t
ctttggcatgtaattgtgnaaattattaaaatattataattagagctgggtgcagtggcttaatgcctgtaatcccggttatttgggaggttaaagtgggaggatcacttaagcccaggagtttgaggctgcaatgaagctatgattgcaccactgcattccagcctgggctacagagcaagacctcatct

SEQ ID NO: 712745 - DNA, 241 bp, Homo sapiens
ttttcaccagagaaggcgcccttcctatggccagaggtctcccccatggcattgtcctggatggcgaacctaaggatgatggtccagatcatacccagggtcatctttgctgttgccgtccacaatctctatctgccccgagtggagaccatgcatgacgccatttgctgggcaatacaagtccacgcgctttgttcacatgtgttgatttgtgtgcactctcactcttccccctgctccg

SEQ ID NO: 712746 - DNA, 1611 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaacgcgccttaatggatcctctagatcacccaca

SEQ ID NO: 712747 - DNA, 1634 bp, Homo sapiens
  misc_feature (122)..(122): n is a, c, g, or t
  misc_feature (1586)..(1586): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtcaaanaaaaaaaaaactaacaatgcggccgcatttcgagctccttggccttcg

SEQ ID NO: 712748 - DNA, 1652 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtcctactgcctggccagtcgtaggtggatctagcacgctgcgagcatagtgcttagtctgacagtcgcctgc

SEQ ID NO: 712749 - DNA, 105 bp, Homo sapiens
aaatgcattcaggcttctcacgagttgcacacagcttttactatgatgtcagagttgacaggcagctttgtaataagtaggtatgatttctgagtttgagtatga

SEQ ID NO: 712750 - DNA, 1864 bp, Homo sapiens
  misc_feature (122)..(122): n is a, c, g, or t
  misc_feature (1492)..(1492): n is a, c, g, or t
  misc_feature (1522)..(1523): n is a, c, g, or t
  misc_feature (1533)..(1533): n is a, c, g, or t
  misc_feature (1540)..(1540): n is a, c, g, or t
  misc_feature (1554)..(1554): n is a, c, g, or t
  misc_feature (1561)..(1561): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtactgcaaanaaaaaaaaaaaaaaaaaaaaaaaaaatttnngggccggccngggcccngaaaaaagtttttnaaacccnttcgtttgggggcggggccccattggtgttatagtcgaacccagtgtgcctcacagacgctgggtcccctaagagaagaaccccggtggtcccagagaaacaatgaggcgtcttggggtattctcccccaaatgtataaaaaaacgccccgcgggggtgcgaaccgagacgccgttttgtgaacacaatactcccaggatagtggaagtactgcgagggggccacaaacaggaggacatccaaatcacaacgagggactcccaagcagaaggcgctggattatctcaatatttacgcccccgc

SEQ ID NO: 712751 - DNA, 985 bp, Homo sapiens
  misc_feature (73)..(73): n is a, c, g, or t
  misc_feature (132)..(132): n is a, c, g, or t
  misc_feature (149)..(149): n is a, c, g, or t
  misc_feature (199)..(199): n is a, c, g, or t
  misc_feature (209)..(209): n is a, c, g, or t
  misc_feature (229)..(229): n is a, c, g, or t
  misc_feature (257)..(257): n is a, c, g, or t
  misc_feature (279)..(279): n is a, c, g, or t
  misc_feature (304)..(304): n is a, c, g, or t
  misc_feature (317)..(317): n is a, c, g, or t
  misc_feature (327)..(327): n is a, c, g, or t
  misc_feature (340)..(340): n is a, c, g, or t
  misc_feature (347)..(347): n is a, c, g, or t
  misc_feature (349)..(350): n is a, c, g, or t
  misc_feature (356)..(356): n is a, c, g, or t
  misc_feature (359)..(359): n is a, c, g, or t
  misc_feature (361)..(361): n is a, c, g, or t
  misc_feature (374)..(375): n is a, c, g, or t
  misc_feature (377)..(377): n is a, c, g, or t
  misc_feature (381)..(381): n is a, c, g, or t
  misc_feature (389)..(389): n is a, c, g, or t
  misc_feature (412)..(413): n is a, c, g, or t
  misc_feature (425)..(425): n is a, c, g, or t
  misc_feature (434)..(434): n is a, c, g, or t
  misc_feature (438)..(438): n is a, c, g, or t
  misc_feature (445)..(445): n is a, c, g, or t
  misc_feature (447)..(447): n is a, c, g, or t
  misc_feature (451)..(451): n is a, c, g, or t
  misc_feature (454)..(454): n is a, c, g, or t
  misc_feature (457)..(457): n is a, c, g, or t
  misc_feature (470)..(470): n is a, c, g, or t
  misc_feature (482)..(482): n is a, c, g, or t
  misc_feature (500)..(500): n is a, c, g, or t
  misc_feature (506)..(506): n is a, c, g, or t
agcggatttgtacacataacatgggttatttagtttaactctggcaaaaaaaaaaaaaaaaaaaaatttggtntgtggatgttggtataccgtccagtataaaagtgtcctaagcattttagccaatctttncacagtagagcatactnaagggctgctgggtactggagtatacttaaatataactccaaaatccagngactgggtgntaaaaccagggattagagcntgtaaagggtacatctagatccatattnggaatcttaaactggtattttnctctaagtatggctaatgagtaaanaaaagtctcatanggtagccaantgaaaaagaatgnaaggggnanngtgaanaantnagggggacaaaannangggnatgtgaanacgaagaatcctagttggagggnngactcatattcncgatggatncaangcgtgantnggtnggnaancttgtcccaaatntctaaaatccgnttctctgccaaaagcaangtcttnctgggtgatattggagttttaacagggtcaaatcttcctaattttcggtatcttagagggcacgcactagaagaaatcagcaggtctaatcccaccagttaagaaaactaccatcttcttgatttttaccgatttcaacaacaattctttccagtgaccttccttttagtgtaatctaccaattttaaacactaggctaaatatagggggtttcccctttcacccaagttgattgtcacagtccgatgcaaaatcaattgatcccgaatgatcgggggtaaaaaataacccaacggtgttcttaggggtcactttgggttgccaacacaatttacttggattaccggggtgtctggaccgggcccgattgggtcgctttgaaacgccgaattgagccaaacctgggaatgcctctaaaatccgaactatggactcgggttaaacccgggggacactacagtggctaatctcatgggaaa

SEQ ID NO: 712752 - DNA, 2062 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaacaaccgggtggggcgcgcgcgcgcgcgcgcggcgcccgcagaaagagctttacaaacaccccgcgggtggggcgcgcgcgcggggcgccaaaggagagaaagaagaaagtgtggaaaagagggtgtacccataggagaacaccgggggaaataaaataaggggggggagggtatccccacacaaattaaaaaacgccgggggggagaaacacgagagggtggtcttagggagaaaaacacccagaggagggaggccacgggaggagcacaaaaggaggggcacataacacaggggggagcaccaaaggaggccccaaagacaacaaaaaaaaaggcccgcgggtgcgagggggggggaggaaccgacgcacgcagcgcaacaaagcgcagcacaacccataccacaaaacaccacacaacaaccacacgaacaagaagggcacgaaacacaagcaaaagaccagacaccaagcgcgaaccgtacg

SEQ ID NO: 712753 - DNA, 1579 bp, Homo sapiens
  misc_feature (755)..(755): n is a, c, g, or t
  misc_feature (1099)..(1099): n is a, c, g, or t
  misc_feature (1143)..(1143): n is a, c, g, or t
  misc_feature (1177)..(1177): n is a, c, g, or t
  misc_feature (1302)..(1302): n is a, c, g, or t
tcaccctcctgagtttttactttggctccggggcgtggaacaattgtcttcaagcgggtcgctgttttgttgccctctggcgcctttgttggggcgcacacgtgtaggagcaccagttgtggtccaacaaatcctcgtgcgctggttgccgcgtgcgccgcggaatttcccccggggaatttttgttgtgacaccaccatgcgttctctggcgtctcccggagtgtgcccacccccgtcgttgtcgtgctccccgagattttatcaaagggccttctgtttgctttaaagcttgttaggcgcccctgcgttgttcgtgttcgggcgcccgctgccgaagttcgccgccattcccgttggaggttatttcttaacccggggggcccccttctcacttcttagctcgccccccgaatttggtgaggaatgggtgttttccttgcccgcggaagcagaatttgttaacaccaagagatttctccggcggggagatatttctctcgggtcacccagggtttttgttccccctcggtgagagttgtggtaaaagggggggaataaagaattggggcttcacacatgatagaggcaaccacagcaagagagggttgaacaccacatctgtgatagtgatctcgcgccgcttctcacatatttggtttgcgaaaaatatgccccccccccgcctctggataaagggccccccccccgaacagtggcgcgaaaaagggttgataccccgggataatgcccacnccacagcagaaattcacctcgggtgtgtttcggagatatatttggtcccacatcgagacgcccacctgtcacccccctcgtctcacgggagaaaacacacacggttgttgtcacacacacaaagagaaaggcctctcacctccacggagaagtgacacactctcgcacagggagtgtacacacacgaggaaaaatccacactcccacacaaagggaggaaacacctctcgaggagagagacccacgcagagagccccacgcagacagagagagtgagaaaccccctctcttaatgaacccccgcggggctgctcacgagacccacatatcacaagcaccacatncccttggctataattcttcacacaaacactattccacgcgtgtntctttatattggggtgagaaaccacatgagaatnccacagagatgggcacatgtggttgtcgtctatatttgtgagactacaccgctgagggagatgggtgtgacgccccaacataatatatgagattgttcctttataaggagatgggtttatgaganaatgtgagaaaaatggttataccacacactgttggccacattatattttggagtctatatcaccccgttcacatcactaaactggctctctggcttgtcacatccaccaccacacaccccggagcttatagagcacaaatgggagctgaatgtcactcttgaggctcttcacatttaattttgagctgtgaatttatatttggaggtggaaggccattgtttttaagaaaaacctgtcatgtaggttgtttaaaaattaaaagccatttaaactcca

SEQ ID NO: 712754 - DNA, 1540 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtattaacacccgcagaagggcactcagtataccttagcacgtgtttttttctttttct

SEQ ID NO: 712755 - DNA, 788 bp, Homo sapiens
gatcccggaagtgatgccgagcgcagatcgcttgcagcttgctagctgtgtgggctgggaggtctggtagggctgagcttgcaagaggatcaacatgcctttgctacgagatttactacatccgtccttggaagaggaaaagaaaaaacataaaaagaaacgcctagtacacaagtccaaaattcttactttatggctgtaaacatgtccaggttgctacaagatcaccacggtatttcagacatgctcagacagtggttcttatgtgtaggttgtcaacagtgttgtgccagctacaggaggaaaggccagactcacagaaggtctatcatttggcattctccacacccagtgatgagatgactgattatacatgtctctatcttcacctgcaaagtgtaccagcacatcttgagtgattaccaaaaataaccttatctttcatggtgtgctttcagtaagaatggcctgtcaaatggatatattgatacctcttgaccttgcagtgaactcccatttgaaccttcattttactagtacgttgagacccacacattggattccactgaggtgtgcgttacttgggacagaaagttaaggtcagcaagtcagaaggccaagacttaactacactggtatattcggacatgagaaatttaataaacaagataagtaactcatagaagaagacagaagtgtgacatggcaccaagggtggattgccgagtagcacttcagacacgggattgtgcacccgcgaaagtaactgacggacccagtaggtaccc

SEQ ID NO: 712756 - DNA, 769 bp, Homo sapiens
  misc_feature (213)..(213): n is a, c, g, or t
  misc_feature (320)..(320): n is a, c, g, or t
  misc_feature (404)..(404): n is a, c, g, or t
agcctgttaagaaaggttttaaacccatagaggccaactgacaaggcatatccgctacaaggaataccatgggaccctaattttcaaggattgttacaagctggacgatttaaagtagtcaaaccagtttaccagcccaagagttgggctacatatccttaggtttaagcgcagtggcatagatcaatgcaatcaattcaatcagtgatcttnttttaagcacgaacaaagcagatgaaaagttatgcgttccacaagaagaatgcgattttcagagcatttatagacgtctagaaaccccatgcatagggacttccttntggaaaggttaagaaatcctgagaaaaaagcctcgtcaaaatgtgtttgtaaactctgacggtacaggaaaatactactggaancagaattaagtgtagaatcagggcagaccagaatatacatgctgattgccgttacatgaaaggtacagcgccaggcgggcaggcagccagccacagaaaagggagaggggctcaggaggaagtggctagacctgtcgctaggcaccaggggaggcggggaaggagggcagaggcagtagagttcactgtgagagctcaacaaggagtagctgctgccaaacatctacattcatttagccgcatttcacagacacaggcttggggaggttaagtaacttgctaacagacataaagttgccaagtagtccagtcaggattcgatgcagctgcagtgccctattaggtgcgagtccgctcagatgggg

SEQ ID NO: 712757 - DNA, 1565 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcaagagagaataatatggctggagcccaaaaaagagctcttgaacatgaaaatatgtaccataaaatacatgtcggca

SEQ ID NO: 712758 - DNA, 2334 bp, Homo sapiens
  misc_feature (122)..(122): n is a, c, g, or t
  misc_feature (2132)..(2132): n is a, c, g, or t
  misc_feature (2153)..(2153): n is a, c, g, or t
  misc_feature (2156)..(2156): n is a, c, g, or t
  misc_feature (2158)..(2158): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtcctcctgcctggccacgcacctctccacagggcggcctggggtctggagatgggcgctgggcccacgggacgcagatggggccacgctctgcccgtggctggcccacgttcctggtctgcagtgctgcctcctccccagcacccctggggcacagagggcagggtcacagctgggaagaggcggggggtagaaaccaaggctggcagaagtgtagccgggctccctgataaatgctggaggaccccagggcacctgcacttactgtaccctctctgagagcatttgtatgatctcatgtctcagctctggaggctggaggtcccagaaaaccaaggtatggtagattcagtctctggtgagtacccagttcctggcttctagatggcgccttctccctgtgtgtcctcagatgatggatgaggccagggtgctctctggagtcctttctgtaagggcactgatcccatccatgaggcctcatgactcccaaagacccccactttccaacgccatcacttgggagaggggcgttttcagcgtgaatcttggggaanctgaaacagggtgacacctgngtncntctcactctgtagctcccgaaggccactccagcccccattccaacatgaacagtggaagtggtcggggtccccaaattggcagctgtggttccccggggttcacccgtgagaaatccaccccaagggggtcccccccgcgagggaccaaaagcttccttcaagcttttttttggtc

SEQ ID NO: 712759 - DNA, 167 bp, Homo sapiens
caggagatgcctaatcttttagagtatttatgctggatgacagttattgctctattgcgattgcagtaaatttctgcagcttagatgattcatcacaaaaatgtggctgttaatctcaatgaggtgccattaatttcctacccctgaaggattgttgtgctgggcgc

SEQ ID NO: 712760 - DNA, 1906 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacacaccttagaaagaaataaaaaaaatgggcggccctctagtttaattttatctggtccacttccccttggggggggtcaaataaaattgggtgggcgtttgaaattaaccgcctttgaatgagaaaaccctggcctaactaaaattagttgttttgaaacccatttttttttggccggtttggcttataaaagagggggcccgaccggattttctattcaaaaaggtgggcatccctgaatggggaaagtaaacggtggcattttttttttcgttcggtaatcctttttgcaacaatcagtttatttttcaacgccgatgggcccgaatcgggcctttttcttt

SEQ ID NO: 712761 - DNA, 2767 bp, Homo sapiens
  misc_feature (122)..(122): n is a, c, g, or t
  misc_feature (2565)..(2565): n is a, c, g, or t
  misc_feature (2586)..(2586): n is a, c, g, or t
  misc_feature (2589)..(2589): n is a, c, g, or t
  misc_feature (2591)..(2591): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcgcctggtcctgtctactagctcaaacaggtttcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttacttcagcgctagcccctgttttgcacagccgagtactggcgagtatgttctatgttgggcctcctgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtcctcctgcctggccacgcacctctccacagggcggcctggggtctggagatgggcgctgggcccacgggacgcagatggggccacgctctgcccgtggctggcccacgttcctggtctgcagtgctgcctcctccccagcacccctggggcacagagggcagggtcacagctgggaagaggcggggggtagaaaccaaggctggcagaagtgtagccgggctccctgataaatgctggaggaccccagggcacctgcacttactgtaccctctctgagagcatttgtatgatctcatgtctcagctctggaggctggaggtcccagaaaaccaaggtatggtagattcagtctctggtgagtacccagttcctggcttctagatggcgccttctccctgtgtgtcctcagatgatggatgaggccagggtgctctctggagtcctttctgtaagggcactgatcccatccatgaggcctcatgactcccaaagacccccactttccaacgccatcacttgggagaggggcgttttcagcgtgaatcttggggaanctgaaacagggtgacacctgngtncntctcactctgtagctcccgaaggccactccagcccccattccaacatgaacagtggaagtggtcggggtccccaaattggcagctgtggttccccggggttcacccgtgagaaatccaccccaagggggtcccccccgcgagggaccaaaagcttccttcaagcttttttttggtc

SEQ ID NO: 712762 - DNA, 163 bp, Homo sapiens
acacggcagtgaatcgagctcggtaccatctcgtgacttggcgattatttgctatgcatgaagatggatagtaatatgggtcaaggcacgcctccatagatttgttcacgggactggtatcgcgagcaaattgtgtcacgcgatataggaacatatcatttcg

SEQ ID NO: 712763 - DNA, 716 bp, Homo sapiens
  misc_feature (229)..(229): n is a, c, g, or t
  misc_feature (243)..(243): n is a, c, g, or t
  misc_feature (246)..(246): n is a, c, g, or t
ttacctgtgtagatagtattaattagatggttgcagctattaattcatcataaagataaaatgaagaaactctccctttttttaaacaaaaaaaattatttctagataataggctagtagttatttctgcagaaacaacgtatggaactgaaaagccacctatttttattttagactaatttaaaccactttggaatggattctaggaaacatcttaagcttgtgtgtngcctgtggtggttngtngggggtgttttcggtcttcggtttcgatttcctggtatttgtcaatctgggggatcctccccgtccgtcggtccggttgggtttcggtttcatacttttctgggcattgtctatggcagttcacacgtggtcatactttgtgctttcagatagggacatcaggttataatcatggtttcttcctctaaattgctctttgggctttacattcaggtccaggattcttcagggtttctcccaaaaataggattctgtgtcagtgtttgccttgctgagtaagtcaccctttctggctccaaatttcgtgggtgggccatctgtggccagcttctggtggccaattgggcttttccgaaagccatggtccaccttatttctttatattgccaggaccatttccactttatgacccgcgggggactttctcagattttcccaggcatttctttaatttgggccccccaggggga

SEQ ID NO: 712764 - DNA, 676 bp, Homo sapiens
  misc_feature (48)..(48): n is a, c, g, or t
  misc_feature (630)..(630): n is a, c, g, or t
taattttgtatttttagtagagaaggggtttctccacgttggtcaggntggtctggaactcccgatctcaggtgatccacctgcctcccaaagtgctgggattacaggcgtgagccaccacgcccaggctctgacattcttgaatatccctatcaacccctctcacccacccaaagcctgctgctcaaagcagctctaagcagaagagatggagaaacattcagactgggtggagcatggcccaggctgtgttgctgcccacttctgtctagatgggcagttcttgacttccccgcctgacgctgctgagcagccacagtcccgactgcattctggcttgtaccctttactatagtgccagccacagagagcagccatgcagcatttttaagtagccaaggaaaggcccgttctcacagcagtgcttggggaatcttcagacttggtattaggaaccatagcaatgagacttgttacaagcttgcaaaacaaaatgggatttttctgtgtggtccaacaaggatctagacagaaagtctgcttgattttgttttgccttgttggcttcataaacccacgtagcagaagcactttgtgaatcaaaaatggaagcattgttctttgatactngaggaatgcctttcctgaatggctactgtgggtgggaattgcctct

SEQ ID NO: 712765 - DNA, 320 bp, Homo sapiens
agatatgatgtcagtgtatatctgggataataagcaccgactctactgagagtctacttatgcgaagcactgtattctaagcacttgacacggtctcacatgacatcttggcaatgacccagacatgaactgttattcccactatttttatacagaataatcaaagctgtggagccagaggttaggtaacctgttcaaaactgacacaactattatatgactaggtcatagcttatagcctgattcatctgacttcaaagcctacattcactactagtatgctatacaggtgacatcttaatctggggcccaagcctgct

SEQ ID NO: 712766 - DNA, 126 bp, Homo sapiens
ctagaggatcccgtctcacatacttcaaacagtgtctggagtgatagactatatgtgtgacgtgggcatgtattgaatagggtgggaatcttttccccagttagaaaaacagatttaaataaacta

SEQ ID NO: 712767 - DNA, 305 bp, Homo sapiens
  misc_feature (222)..(222): n is a, c, g, or t
  misc_feature (268)..(268): n is a, c, g, or t
ggaaagcaggtctcattatgttgcccaggctggtcttgaactcctggccttaagaaatcctgccgcctcagcctcccaaagtatacttttatatagtaactgattcagtgctcacatcaatcctacaacgtagatactattatcatcttcattttatggatgaggacactgagacactaaatctgactaccaaaaaaaaaaaaagcagggtcaggcacagtngctcacgtctataatctcaacactttggaaggctgaggtgggcagnttgcttgagtccaagagttcaagaccagcctgggaca

SEQ ID NO: 712768 - DNA, 413 bp, Homo sapiens
ctgaagccagatcttccccaccacacatgcatctcccctgggctcagctcaagtgtcacctcctaaaaggctcccctatttttctttgacagcacctcagattcctgcacaaggcttactgtgacatgcactattttatttgggggattactggcctgctctgcctgccaagacctgaagttccagctttgactggaaggcagggaccttcttgttcccaatgtctccacagcaatcagcgcaaggcctagtacatagcagggatgtaaaatatgctgcttaaatgggccaagcacagtggctcacacttgtaatcccaacacttcgggaggccaaggcgggcaaatcacgatgtcaggagtttgagaccagcctggcaaacacagtgaaaccccgtctccactaaaaataca

SEQ ID NO: 712769 - DNA, 210 bp, Homo sapiens
tatcacgttgcagtgaggtcaccctctaagatcacacgatcaaaagggacaagcatcaatgcacgcagcaatgcagctcagaacgcttagccgtagaccacacaccccacgggtaaacagacagtgagttacacctttagacaactaacacgaacagtttaactcaagactatacataaccccagggattggctcaatattcgatgccag

SEQ ID NO: 712770 - DNA, 458 bp, Homo sapiens
  misc_feature (397)..(397): n is a, c, g, or t
  misc_feature (458)..(458): n is a, c, g, or t
ggttttcgccatgttggccaggctggtctcaaactcctgacctcaggtgatgtgtctgtctcggcctcccaaagtgctgggattataggcatgagctaccgcgcctggctacaaaagcacttgttaccccataaacttatacaatttctttagcagccgcgatctcttgaggagggcagagcctttgtgacctaatcacctctgaaaggccctgcctgtcaacactgttgcatcagggattaaatttatcttttgagatggagtttcactcttgttgcctgggctggagtgcaatggtgcagtctcagcacactgcagcctccgcctcccgggttcaaggaattctcctgcctcagccttccaagtagctgggattacaggcatccaccaccacgcncaagcttttggattttttagtagagctggggtttcactgtgtttgcccgctggtctcctcn

SEQ ID NO: 712771 - DNA, 806 bp, Homo sapiens
  misc_feature (33)..(33): n is a, c, g, or t
  misc_feature (41)..(42): n is a, c, g, or t
  misc_feature (47)..(47): n is a, c, g, or t
  misc_feature (55)..(55): n is a, c, g, or t
ctgttggtcgacccatcgatatcattcgtaagnattcgaannccttnagcaaaancccggcggcgtgggctatagcacccccggatccgacgagctgtaggaaatccttatgagcgcacgaccattttcaacctgtagcgcagggtcatcgtcataagggcaacggcgtgcaacgcggcctggtgggctagatcatcaagcgctttgagcagaagggattccgtctcgtggccatgaagttcctacgggcctttgaagaacacctgaagcagcactacattgacctgaaagaccgaccattcttccctgggctggtgaagtacatgaactcagggccgcttgcggccatggtctgggaggagcagaacgcggagaagacaggccgagtgattgcttggggagaccaatccagcatattcaaagccaggcaccattcgaggggacttctgcattcaggttggcaggaacatcattcatggcagtgattcagtaaaaagtgctgagaaatcagcctattggttaagcctgaagaactggttgactacaagtcttgtgctcatgactgggtctattaataagacgtggacacaacagccggttccttcagcacggtcgtggagtgtccctggacacagctcttcattccattgacttattggcaacaggattgaacatttcttcatagaagcatattcgcccattaaagtttttaggtagcgcggaataacatattcaaataatacttgagggtgggctcccggtctcaggtacgtttcaccctcttctcctattggggtcccctttct

SEQ ID NO: 712772 - DNA, 162 bp, Homo sapiens
gttcttccacttaggcctcaattccttccttttcaggggcagccttagttccatggccctgaaacacacacattttcccctttctttccagaagccactggcccccatagcacccagtgattctttttacaagtggaggactagggtggtttccaaaggttt

SEQ ID NO: 712773 - DNA, 3376 bp, Homo sapiens
gtgtcagagaggctaaatgacttgccaagatagtagagctgacttcagagaatttcctttattaagaatgctttggatacatcatcttattttgttctttcaacaatcctgtaaggtaggagcattagctacatttttccagctggggaaactaaggcttggagaagttagttaacttctccaaagtcagacagcttgtattcacagccaagctgggatataggacaacaaagcctgtactcttaaattacaggctaagttaacacctattatagaggcatgttgtctaacaagaaagacattgtcattaacatggagtatgtctagataatacacaaatacacatgcacacacaccctgcaccttaagagaattagaatcgcaaagcacttttatatagcttagaagtgagagtttgggaaagttattctcagaggtaatggtggaaagcaatcagatagattggagagtttttgaaaacacctaattacaatccagcaggtgtatacccctaggcaccttcagcaggtaaaatggtatctggggcctgattgaatatttctttcactaggtgttcctttctgtctacattgtgcttctgtgagctgagagatttaataacagatgctctgggatgattcctaagcaaaagaattgtcttttgtcactgtagatgcattttccgaccttgtgttcaccatgaatatatcataagagaaatgatcgcctgacacacaagcaatgggaagtgtaacctggggttgggtttcacttgattgtaattacagaatctcagcttcattaacatacgtttttatacatgaaactttttttctcatagtagcccttatttgaaatgaacacctttcagcttcaaggccacaacaattatgttcaggttgaagagcagtttgtttctacttatgtgagagtaaacaaaacaagttattgtctctgttttccttccccatttgtgtttggttctgtgtttgctgcacggcacaccaatactaaatacttctcatttgtcctaaagtgagcattggatgaaatggctctatgtataatatgggtttgtattctgttgtctcaaagcagttacttagtgttttgaatccatgtcgatttaatgatcttattcattcaataagatatgagaggaaggaaggcaaacatgtcccctgcctgtatgtggcttatagtctggcagaggggtaaggcaggatattttgtctatcttgttcactgctatgcccagtgcgtgcctgggacttagtgctcaataaatacttgttgaatgagtgtatgcacaataaaatagattaagagctatgaaagaaggattactagaggaccatggaaatgtacagtgctggactgatttcctgcagggaagggaataaagagttgaggcagatgctctcagaaagagaattcccacagcatggcacaataaaatatggcccccattgtcacgtaaatgagagtatagatcctacttccacatttgccaggcctgaaagtgttgacaggttattcctcccaagcctcaggtttctcaattgtgaaatagaaaattatgcatatgatgctcttgttagtgaccagcacatgatggacagtcaatacctgtagctactgttgactgcaaagaacctgttgtggtctcactgtgcagaattatgttattcctttcaaatgaaacttgcagtagattcagtgttttaacagaatcgtgatggaagtcaataattgaatgcatcaaatgggggaaaaaaagcacaacctctcaactcgagatattttaaggtgtgactgtttttttttaaatgtttctgttacatgcatctaaatgactggtgtcttcttaagaagagcagaattttctattatgctgtgccacttctgtcttttgatttgggggaagttgctagatctcccagaggttcagtttccaataccataaaatggaaagaataaaagtaaatatataaaggcattaacttctatatcttagtgagtttttactaggcctgtgtctgcctaggatcttcttttttgattcatctattcaccaaatatttagtggcctctggtgatatgcaatgcattgtgccagtcaaatgatgagatatctgcttggaggagcaaaagatagggtggtgggcagagacggacttatgcaaattattccaatgaagggtagtaagtgctatggtagagggagatacgaatgctatgagcatattactaatagccaaagcaatcctaagcaaaaagaacaaggaggtatcacattacccaacttcaaactatactacaatgttgcagtaactggtacaacatggtacgggtacaaaaacagatgtatagaccaatggaacagaatacagaacacagaaataaagctgcacacctacaaccatctgatcttcaacaaagcagacaaaaataagccctggagaaaatgactgcctattcaatagatggtgctggggtagctggcaaacctcatgcagagggataaaactgaactcctacttctcaccatatacaaaaattaacccaagatgaattaaagacttaaatttaggacctcaaactgtaaaaatcttataagaaaacttaggaaatagcattctggatatcaatcttgggaaagaatttacgactaagttctcaaaagcaattgtagcaaaaacaaaaattgacaagtgggactcaattaaactaaagagcttctgcacagcaaaagaaaatatcaatagagtaaacagataacctacaaaaggggataaagtattcacaaactatgaatctgaggaaggtctaatatccagaatctatcaggaacttaattcaataagcaaaaccaaaatgaccccgtttaaaagtgggaaaaggacatgaacagacacttctcaaaagaagacatacaaattgtcaacaaatatatgaaaaaaatgctcaatatcactaatcgtcagaaaaatgtgaatcaaaatcacaataagctaccatctcacaccagtcagaatggctattattaaaaagtcaaagacaacaggtgctggtgagtctgtggagaacacttatacactcttggtgggaaaatgaatttgttcagccacagtggaatgctgtttggcaatttctcaaagaactaaaaacagaactaccattcaacccaacaatcccattactaggtatagacccaaaggaagataaattgttccatgaaaaagacacatgcacttgtatgttcattgcagcactattcataatagcaaagacatataatcaacataggtacccatcaagaatggattggacaaagaaaatttggtacatacacaccatggaatactacacagcc

SEQ ID NO: 712774 - DNA, 213 bp, Homo sapiens
ctttaggtaagttcacttagaagcttgtaaaacaaaaagtaattaattcttttacaagtttccattgaggtgtgatatacatccggcaaagtgcaccggtcttagatctacaggctcagtgaagcttcagaaatgcatgcatgcttttcgccatgactcagatcaagatacggaagagcccagcactccacgatgctccatcatgcccctttg

SEQ ID NO: 712775 - DNA, 101 bp, Homo sapiens
aaactgttatcttttcagtatttaataccggtagttcagttagtaactttttcatatatagcatgtgcctgtatgcagttgaactatataaagttcattgc

SEQ ID NO: 712776 - DNA, 167 bp, Homo sapiens
cactatgccctgtacctttgtgtccgcctaaggatttggtaccccatatgtattgtgaaatgcgtataatacctgggaagaaaatgaggctcaaagagaggtgaactgactagctcaaggaccactagtaccagatcctagactcctgcgaggacttgtgagacccc

SEQ ID NO: 712777 - DNA, 1095 bp, Homo sapiens
gttttttgtttgtctcttgtttgttggtttttatgttttttttgtttattatggcaaaggaggcaggacggagctgtccgcgcagtgagacgaggcaggagcaggagggacagcaagaacaaaagaaaggaggcgtatgcgataatatgtgtgggccaaagcgctcatattctgtccgtccttggggttatacagagtgttctactttttgccgccgtctctctacaaaccacgggggtcctgcacgacgggagcacacccccctactcggcttctttgggggaaaaacaccttgtgtgaaaacgccccgtgtgatgtgtaaagtgtccagagcgccccctgtgaagggcgcccccgggcgaaagagaaggcgtctccggagtgaaacccatgagccccagcgttgtccggataggagggaataaaaggctgtcgctcccttcgttccttgagagggaagatgggtgaatgggacccggcccctggcttctgacccccagtcccacgacccctttgcttcacctgcgcccagatacccttgtgttggaagaaattaagccccagtactcccatgaggacaccctctctggtgcactgccataattttgggaacaccttgataaaagaccgcggtccccgtgggactcagagtattgcttccctggagaactctactcagaccttcatgagctgccattgttatccctgggaaagttcccacgactggacacaactggaggaagaaaagcctttgcccgagtcctacctttttgggaccccaccataccactctccatttttggaatttgggtcttccgaggcccagacttgccctttctccgctgagtcccagattggccacggtggactaccgagtcaaacacaccatgccggaaactggtccctgccagcgaggagacccccaacagcgtggtttcgagagtacattttccctgggagggggccctcccgcatagtgggccaaaccttccatcagggccagattttcaaatgaaactcttttgccctcacctagctgcctgcacctgccctttcagggagaatgggggtcacttaaaggaaactgaacccttg

SEQ ID NO: 712778 - DNA, 285 bp, Homo sapiens
cggacacttagctgaagtatatcagctgaaggagctttgggctgagactatgggtttattagatatagaattaagtcatctgcaaaggagacgtaggttgacttcccgtcttcctatttagaatacccgtttatttctctctcgttacctgaactgccctggccagtgacttccaggtactatcgttgtaataggacgtggtggagagacagcgattctgtgtcgttgtgtcacgttttcacaaggggaatgtttccacgcttttgagttatggtggatcgctcg

SEQ ID NO: 712779 - DNA, 381 bp, Homo sapiens
gaacagccccagtgccctgggggaggggagggagtgaggggcagtggtgcccttcctgcaaaaaaaacatgcaacagtagcgctggcgccatttgcaggagctggcgggctggccttttggaccctggcttttcccccctgtaacgcctgttaccccccaactgttgtgggttcctgccaggctttaaaaaaatgatttgaattttttcccccctttgggtttattttggtgggttaatttggggtttcttttttcccttttggggggtattcaaagtgggctgggcccctgggcgagacccaactacctttgttggcattttttttatacccggaaccccgcggctttagccccttagcgggttaatttaattaagttga

SEQ ID NO: 712780 - DNA, 306 bp, Homo sapiens
cgaaaaattccttagctaccgtttggctttttttaatgccgatcaaaaccaagcaggtaagctacaaacgcgaattgaccgtggcattggctcactcacccgtctggtacaaatcttttttatcgatattttgccactttttagcagtgccattgtggcactggggttgatgtactatgccaacttctacgtcggtttggtggcgaccagtattatcccgatttacttttggctgaccttccaacaagctaagaaactgggcggatggcggcgcaacctacgtgatggccgtgaaaaaaagagcca

SEQ ID NO: 712781 - DNA, 938 bp, Homo sapiens
  misc_feature (68)..(68): n is a, c, g, or t
  misc_feature (71)..(71): n is a, c, g, or t
  misc_feature (79)..(79): n is a, c, g, or t
  misc_feature (107)..(107): n is a, c, g, or t
  misc_feature (171)..(171): n is a, c, g, or t
  misc_feature (176)..(176): n is a, c, g, or t
  misc_feature (185)..(185): n is a, c, g, or t
  misc_feature (199)..(199): n is a, c, g, or t
  misc_feature (211)..(211): n is a, c, g, or t
  misc_feature (244)..(244): n is a, c, g, or t
  misc_feature (253)..(253): n is a, c, g, or t
  misc_feature (263)..(263): n is a, c, g, or t
  misc_feature (272)..(272): n is a, c, g, or t
  misc_feature (282)..(282): n is a, c, g, or t
  misc_feature (306)..(306): n is a, c, g, or t
  misc_feature (314)..(314): n is a, c, g, or t
  misc_feature (322)..(322): n is a, c, g, or t
  misc_feature (338)..(338): n is a, c, g, or t
  misc_feature (352)..(354): n is a, c, g, or t
  misc_feature (361)..(361): n is a, c, g, or t
  misc_feature (383)..(383): n is a, c, g, or t
  misc_feature (390)..(390): n is a, c, g, or t
  misc_feature (396)..(398): n is a, c, g, or t
  misc_feature (400)..(400): n is a, c, g, or t
  misc_feature (411)..(411): n is a, c, g, or t
  misc_feature (414)..(414): n is a, c, g, or t
  misc_feature (426)..(427): n is a, c, g, or t
  misc_feature (456)..(456): n is a, c, g, or t
  misc_feature (482)..(482): n is a, c, g, or t
  misc_feature (517)..(517): n is a, c, g, or t
  misc_feature (541)..(541): n is a, c, g, or t
  misc_feature (546)..(546): n is a, c, g, or t
  misc_feature (573)..(573): n is a, c, g, or t
  misc_feature (595)..(595): n is a, c, g, or t
  misc_feature (597)..(597): n is a, c, g, or t
  misc_feature (630)..(630): n is a, c, g, or t
  misc_feature (640)..(642): n is a, c, g, or t
  misc_feature (647)..(648): n is a, c, g, or t
  misc_feature (657)..(658): n is a, c, g, or t
  misc_feature (691)..(691): n is a, c, g, or t
  misc_feature (709)..(713): n is a, c, g, or t
  misc_feature (716)..(717): n is a, c, g, or t
  misc_feature (720)..(720): n is a, c, g, or t
  misc_feature (725)..(725): n is a, c, g, or t
  misc_feature (767)..(767): n is a, c, g, or t
  misc_feature (806)..(806): n is a, c, g, or t
  misc_feature (827)..(829): n is a, c, g, or t
  misc_feature (845)..(845): n is a, c, g, or t
  misc_feature (861)..(861): n is a, c, g, or t
  misc_feature (864)..(864): n is a, c, g, or t
  misc_feature (895)..(895): n is a, c, g, or t
cgccgcgctcccgcgctccgttccgcccaggccgcgcccagctggaatgccgagatcgccgcccggcnacngcgcacangacgccccgcccgcccgccgcgactgtncatgggccccgggacacggggccgccgctgacacgcgcggcctcgccgccggccccgccgcccnccccnccccccccncgcccccctccccncccaccccccancgcagtcccccgcccacccccacccggggcgcnatcccctcnccccggccgnccgccgggnacgccacccngcacaccactcgcccatcccccgncccatcancgcctccntggtctccgccaaggnccaccgccaccccnnnctcaccngaccccggacctgcacaacgcngtcctcngccacnnncngcgccaacgcntcnaacgcacctccnncgcgggcgggagaagcgggccctttcgtnggaggcaagccagaacggctagcgcngtgcagcactttgcgcgaaccaccccaaactacanagtaccgggccgctccgcagaganagcanagcgcgcaaaggcccaggcgagctggnagcccgggcctcctagctcccngngattaggcgcccccgcaggccaccgcccgaagnctttaccccnnnggcgnntgggctcgnntcgcgccttaccgcgagcaagcccccgctgggngccgagttcgacggcctnnnnnaanncanacccnagcgctcgcctctggacggcctggaacccggcgaggctgccntcttcccaccgcccgcggcgcccgaggactgcgcgctgnggcccttccgcgcgccctacnnnccaccgagttgtcgcnggacccggcggttgcnacngggctccctggcggaagcgctcaggaccgcncccccgccgcgcgctcgctggcctgtctacggcacctgggcac

SEQ ID NO: 712782 - DNA, 729 bp, Homo sapiens
agcggaggatggcttgaatccaggagttggaggctgcagtgagccatgatcatgccacactaccctccagcctaggtgacagagtctagacctatctcaaaaaaacaaacgaacaagggccaggagcggtggctcacgcctgtgatcctcggcctcccagagtgctgggattgcgggcgtgagccactgcagccatggccgatacgtagttttacgaaaatattaactgtgcatgcttgatctctgtagtcttccattttttcatcgaacattgggtgttccagcaaatgacaccgaatgccacagtacaacagtcgtgctgctcagctcgtatagggagacagaatcaaactcagcatcgcactctcaagcaacagcggaatgcatggcgactgatgtaagtcactggaggctggatgtgtatcctgtagcatacatgttcacttcatagaacaaagtgattatgatcctgagtaggtaaaacttggtctacctggagttgtcttggcaaggcattagtgtacagtggattcttactatggaagtagttatgtgctgtcaattcatcatgagtactggatgagcgaataactaggaacattggctcactacggagaacatacagggatgagggtcccctataagcctcctgggtctcacttgtcagtcaacctggactcagtacataacccttagtgtgaaccatgtggttaactaggttaagggacc

SEQ ID NO: 712783 - DNA, 667 bp, Homo sapiens
ccaggatgtgagccagggactttctggaagtgtttgttctggccccacccgaccccaggcagtccccagctgtctgcacagtcggatggggagggggcttgcacagagttggagccagaggagagagctggctcatcctctacggctggatggggaaacctaacagaccacattgttacccgtcctcatctctccatccaggcgctcatagggtaactcttacccatctcatgcacttctctgaaccacattgacccactctgcactacttcccattctcctacccccatttgtcactgaagccctacaatcatggctgttgaaggaggaatgaaatgtgtgaacttcttgctctacatactactactagtcttttgcgcctgtgctaacgccactgattaccagtacttttctgatgcacaccttagtcctgattcataccataattcaattcgctaccactctctctctcttgcaatacctatatctacataaatatctttctcttacttcaggcttttcccaactctactttaccttctaatctaaatattcgcaattattctgttttatctccttatacatttatcatatcataatttacttacaactttcactcacacattcgtaatatcccttcaacacctcactccttctatctacacat

SEQ ID NO: 712784 - DNA, 140 bp, Homo sapiens
actgcatagtttttagaccttccttccctgatcttatacggccatttgatccttgatagtttaggtgagaactctttaaaatacattctctgtgggtccgacgcaatttataaaaattatgttctcaagaaggcaaaaaa

SEQ ID NO: 712785 - DNA, 2086 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaagaaaaaaaaaaaaaaaaaaaaaaaaaaaaaaaaaaaaaaaaaaaaaaaaaaaaaaaaaaaaaaaaacggctgtgagcgcgcgccgcgcgccgcggcgcccctgagaaaacgcttccaaaaccactgggggggagagcgggggcacacaaagagagaacagagcaaaagggggcccaaggggtgcccaaggaaaaacaggggaacaaaaacaacgcagcgcgggggcagcctacccccacacaaaagaaaagagcgcgcggcgagaccacaaggacggcgtatgaacaacaacaccacaccgaggcgacctgagagacaccacaagagagggcacaaaacacaacggagaaccactaggaggaccgagaaaaaaacaaaacaacccccagagccggtggaaacaaagaaaaaaagacaaaagaagagacaacacgaaaaaaaaacagcgaaacacacacgcacaaacaaggaacaggagccacgcaggaacgaccagcacagcgccgcacggggcaccccgaccaggcggcaagacaagcggacaacgagagcggcaggaacgagcggcaaagacagacgggggggagacgaggcggagaggagccgagccgaccgaggcacggagccgaagaacgccgaaggtgaggagagagggaagagaacgaagagaggggaagaagacggcgagggagaagcaggaggaacaaagaaagaaggcgcgaaaggacgaggaaaaaaggagagacagagaaggcgacggcaagggacagcaggaagcc

SEQ ID NO: 712786 - DNA, 128 bp, Homo sapiens
tgacaacacacactactgacaggaataaaaacatcatacagcgactttggaaaaccgtatggcaacttcttaaaaagttaaattaaattaggctgggcgcagtggaatcactcatcagatccaggaat

SEQ ID NO: 712787 - DNA, 2771 bp, Homo sapiens
  misc_feature (122)..(122): n is a, c, g, or t
  misc_feature (2569)..(2569): n is a, c, g, or t
  misc_feature (2590)..(2590): n is a, c, g, or t
  misc_feature (2593)..(2593): n is a, c, g, or t
  misc_feature (2595)..(2595): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgcctggtcctgtctactagctcaaacaggtttcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttacttcagcgctagcccctgttttgcacagccgagtactggcgagtatgttctatgttgggcctcctgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtcctcctgcctggccacgcacctctccacagggcggcctggggtctggagatgggcgctgggcccacgggacgcagatggggccacgctctgcccgtggctggcccacgttcctggtctgcagtgctgcctcctccccagcacccctggggcacagagggcagggtcacagctgggaagaggcggggggtagaaaccaaggctggcagaagtgtagccgggctccctgataaatgctggaggaccccagggcacctgcacttactgtaccctctctgagagcatttgtatgatctcatgtctcagctctggaggctggaggtcccagaaaaccaaggtatggtagattcagtctctggtgagtacccagttcctggcttctagatggcgccttctccctgtgtgtcctcagatgatggatgaggccagggtgctctctggagtcctttctgtaagggcactgatcccatccatgaggcctcatgactcccaaagacccccactttccaacgccatcacttgggagaggggcgttttcagcgtgaatcttggggaanctgaaacagggtgacacctgngtncntctcactctgtagctcccgaaggccactccagcccccattccaacatgaacagtggaagtggtcggggtccccaaattggcagctgtggttccccggggttcacccgtgagaaatccaccccaagggggtcccccccgcgagggaccaaaagcttccttcaagcttttttttggtc

SEQ ID NO: 712788 - DNA, 224 bp, Homo sapiens
aaaatcaggctgtattgagagggaagtaatgtgggaactgaaaagtgtgtcaagggcttgaaacaagcaaaagttcagctcctttgctgtcattgctgtgggctgtatctcctcattcttgcccagtcttttcatctacaggctgtgctactatgcatcacacatgtcacgtaagcattagaaatacctgaactaaggggctgactgtcgaggtaccgacgctc

SEQ ID NO: 712789 - DNA, 2789 bp, Homo sapiens
  misc_feature (122)..(122): n is a, c, g, or t
  misc_feature (2587)..(2587): n is a, c, g, or t
  misc_feature (2608)..(2608): n is a, c, g, or t
  misc_feature (2611)..(2611): n is a, c, g, or t
  misc_feature (2613)..(2613): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcggctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttacttcagcgctagcccctgttttgcacagccgagtactggcgagtatgttctatgttgggcctcctgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtcctcctgcctggccacgcacctctccacagggcggcctggggtctggagatgggcgctgggcccacgggacgcagatggggccacgctctgcccgtggctggcccacgttcctggtctgcagtgctgcctcctccccagcacccctggggcacagagggcagggtcacagctgggaagaggcggggggtagaaaccaaggctggcagaagtgtagccgggctccctgataaatgctggaggaccccagggcacctgcacttactgtaccctctctgagagcatttgtatgatctcatgtctcagctctggaggctggaggtcccagaaaaccaaggtatggtagattcagtctctggtgagtacccagttcctggcttctagatggcgccttctccctgtgtgtcctcagatgatggatgaggccagggtgctctctggagtcctttctgtaagggcactgatcccatccatgaggcctcatgactcccaaagacccccactttccaacgccatcacttgggagaggggcgttttcagcgtgaatcttggggaanctgaaacagggtgacacctgngtncntctcactctgtagctcccgaaggccactccagcccccattccaacatgaacagtggaagtggtcggggtccccaaattggcagctgtggttccccggggttcacccgtgagaaatccaccccaagggggtcccccccgcgagggaccaaaagcttccttcaagcttttttttggtc

SEQ ID NO: 712790 - DNA, 2334 bp, Homo sapiens
  misc_feature (122)..(122): n is a, c, g, or t
  misc_feature (2132)..(2132): n is a, c, g, or t
  misc_feature (2153)..(2153): n is a, c, g, or t
  misc_feature (2156)..(2156): n is a, c, g, or t
  misc_feature (2158)..(2158): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcggctggtcctgtacgacgagctcaagaaggtgatctaagggccgcggccctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtcctcctgcctggccacgcacctctccacagggcggcctggggtctggagatgggcgctgggcccacgggacgcagatggggccacgctctgcccgtggctggcccacgttcctggtctgcagtgctgcctcctccccagcacccctggggcacagagggcagggtcacagctgggaagaggcggggggtagaaaccaaggctggcagaagtgtagccgggctccctgataaatgctggaggaccccagggcacctgcacttactgtaccctctctgagagcatttgtatgatctcatgtctcagctctggaggctggaggtcccagaaaaccaaggtatggtagattcagtctctggtgagtacccagttcctggcttctagatggcgccttctccctgtgtgtcctcagatgatggatgaggccagggtgctctctggagtcctttctgtaagggcactgatcccatccatgaggcctcatgactcccaaagacccccactttccaacgccatcacttgggagaggggcgttttcagcgtgaatcttggggaanctgaaacagggtgacacctgngtncntctcactctgtagctcccgaaggccactccagcccccattccaacatgaacagtggaagtggtcggggtccccaaattggcagctgtggttccccggggttcacccgtgagaaatccaccccaagggggtcccccccgcgagggaccaaaagcttccttcaagcttttttttggtc

SEQ ID NO: 712791 - DNA, 2851 bp, Homo sapiens
  misc_feature (122)..(122): n is a, c, g, or t
  misc_feature (1045)..(1045): n is a, c, g, or t
  misc_feature (2649)..(2649): n is a, c, g, or t
  misc_feature (2670)..(2670): n is a, c, g, or t
  misc_feature (2673)..(2673): n is a, c, g, or t
  misc_feature (2675)..(2675): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggaggtactcgggggggcggggacccttgctgccgggaagggaaccaagctccttgccctgggcccgtgggaggncaggaaccatcaaaggaggcacttccagggcgtgtgagacaagcaagtgtgtccgaaagtaacctggctgtgtggaaggattttcctgaacgatgggcttctgatctttttggggtttcatggtccgggcggcagtttctaaatccccgcctcctagaacctctgttgcacccacaccctcgatcctgccttctctgcatggaccccggggtggagatgggggacacccagggcggggcctgaagtcctgtgtccagccctccctgagacagtggcttaggaggagagcttaaactaagagaacctcagatatccctcctgtaatcagaactgtggctcaggcgtctggggtgttatttctgtgaaacgtctttgtgggtgcaggtggcgtccgtgtcttgaagagcttggcggcgaggccctcactgtctccctgtcgttgcagctgacatcatgtacacgggcaccgtcgactgtaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtcctcctgcctggccacgcacctctccacagggcggcctggggtctggagatgggcgctgggcccacgggacgcagatggggccacgctctgcccgtggctggcccacgttcctggtctgcagtgctgcctcctccccagcacccctggggcacagagggcagggtcacagctgggaagaggcggggggtagaaaccaaggctggcagaagtgtagccgggctccctgataaatgctggaggaccccagggcacctgcacttactgtaccctctctgagagcatttgtatgatctcatgtctcagctctggaggctggaggtcccagaaaaccaaggtatggtagattcagtctctggtgagtacccagttcctggcttctagatggcgccttctccctgtgtgtcctcagatgatggatgaggccagggtgctctctggagtcctttctgtaagggcactgatcccatccatgaggcctcatgactcccaaagacccccactttccaacgccatcacttgggagaggggcgttttcagcgtgaatcttggggaanctgaaacagggtgacacctgngtncntctcactctgtagctcccgaaggccactccagcccccattccaacatgaacagtggaagtggtcggggtccccaaattggcagctgtggttccccggggttcacccgtgagaaatccaccccaagggggtcccccccgcgagggaccaaaagcttccttcaagcttttttttggtc

SEQ ID NO: 712792 - DNA, 252 bp, Homo sapiens
  misc_feature (212)..(212): n is a, c, g, or t
caggatcccaactcaagtgcgagctgcgatgcctcgagctggcatcgagactatggatcgagcacgtgtaccacggaacagcaaattcaggacaaagtggctacctttcgactcatgttgctggacaaggatgtgaaccctgggggccaggaggacaccccatggtcagaggccagcgcgtcacggtagactcaccagttagcaggtgtgtnccgtacgctcgaagttcgtaactcctgggtcttacgctct

SEQ ID NO: 712793 - DNA, 1205 bp, Homo sapiens
  misc_feature (122)..(122): n is a, c, g, or t
  misc_feature (1135)..(1135): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgaggggggcaaggccttcttcaaggtgcgtggtccaacgtcctgcgggcatggggcctcggcgccgaaagccaagggtaagggggccccaccaccgggacaaacaanccgggcgaccaaacagtccgatcggcggcgaaggacaccgtcgggccgcccaacctccccaccctccggg

SEQ ID NO: 712794 - DNA, 2776 bp, Homo sapiens
  misc_feature (122)..(122): n is a, c, g, or t
  misc_feature (2574)..(2574): n is a, c, g, or t
  misc_feature (2595)..(2595): n is a, c, g, or t
  misc_feature (2598)..(2598): n is a, c, g, or t
  misc_feature (2600)..(2600): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcgcctggtcctgtctactagctcaaacaggtttcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttacttcagcgctagcccctgttttgcacagccgagtactggcgagtatgttctatgttgggcctcctgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaaaaaaaaaaagaatcacgttttcccatttgtacttcagcgctagcccctgttttgcacagccgagtactggcgagtatgttctatgttgggcctcctgctgcaaaacaataaacagaggacgcagaggtcctcctgcctggccacgcacctctccacagggcggcctggggtctggagatgggcgctgggcccacgggacgcagatggggccacgctctgcccgtggctggcccacgttcctggtctgcagtgctgcctcctccccagcacccctggggcacagagggcagggtcacagctgggaagaggcggggggtagaaaccaaggctggcagaagtgtagccgggctccctgataaatgctggaggaccccagggcacctgcacttactgtaccctctctgagagcatttgtatgatctcatgtctcagctctggaggctggaggtcccagaaaaccaaggtatggtagattcagtctctggtgagtacccagttcctggcttctagatggcgccttctccctgtgtgtcctcagatgatggatgaggccagggtgctctctggagtcctttctgtaagggcactgatcccatccatgaggcctcatgactcccaaagacccccactttccaacgccatcacttgggagaggggcgttttcagcgtgaatcttggggaanctgaaacagggtgacacctgngtncntctcactctgtagctcccgaaggccactccagcccccattccaacatgaacagtggaagtggtcggggtccccaaattggcagctgtggttccccggggttcacccgtgagaaatccaccccaagggggtcccccccgcgagggaccaaaagcttccttcaagcttttttttggtc

SEQ ID NO: 712795 - DNA, 2314 bp, Homo sapiens
  misc_feature (122)..(122): n is a, c, g, or t
  misc_feature (2112)..(2112): n is a, c, g, or t
  misc_feature (2133)..(2133): n is a, c, g, or t
  misc_feature (2136)..(2136): n is a, c, g, or t
  misc_feature (2138)..(2138): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcgcctggtcctgtctactagctcaaacaggtttcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagcaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtcctcctgcctggccacgcacctctccacagggcggcctggggtctggagatgggcgctgggcccacgggacgcagatggggccacgctctgcccgtggctggcccacgttcctggtctgcagtgctgcctcctccccagcacccctggggcacagagggcagggtcacagctgggaagaggcggggggtagaaaccaaggctggcagaagtgtagccgggctccctgataaatgctggaggaccccagggcacctgcacttactgtaccctctctgagagcatttgtatgatctcatgtctcagctctggaggctggaggtcccagaaaaccaaggtatggtagattcagtctctggtgagtacccagttcctggcttctagatggcgccttctccctgtgtgtcctcagatgatggatgaggccagggtgctctctggagtcctttctgtaagggcactgatcccatccatgaggcctcatgactcccaaagacccccactttccaacgccatcacttgggagaggggcgttttcagcgtgaatcttggggaanctgaaacagggtgacacctgngtncntctcactctgtagctcccgaaggccactccagcccccattccaacatgaacagtggaagtggtcggggtccccaaattggcagctgtggttccccggggttcacccgtgagaaatccaccccaagggggtcccccccgcgagggaccaaaagcttccttcaagcttttttttggtc

SEQ ID NO: 712796 - DNA, 335 bp, Homo sapiens
gccgttacagcatggccttgtaaagcctataaactctccttacaattcccccatttgacctgtcctagaaccagacaagccttacaagttagttcaggatctgcgccttatcaaccaaatggttgggcctatccacccggtggtgccaaacccatatactctcctatcctcaatacctccctcaacaacccattattctgttctggatctcaaacatgctttctttactattccttcgcacccttcatcccagcctctcttcactttcactgggactgaccctgacacccatcaggctcagcaattgaccggggctgtactgccacaagccagtg

SEQ ID NO: 712797 - DNA, 2323 bp, Homo sapiens
  misc_feature (122)..(122): n is a, c, g, or t
  misc_feature (2121)..(2121): n is a, c, g, or t
  misc_feature (2142)..(2142): n is a, c, g, or t
  misc_feature (2145)..(2145): n is a, c, g, or t
  misc_feature (2147)..(2147): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcgcctggtcctgtctactagctcaaacaggtttcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttagtttgagagcggagaggaatcagcgttttccgcatgttgtagcttcagcgctagcccctgttttgcacagccgagtactggcgagtatgttctatgttgggcctcctgctgcaaaacaataaacagaggacgcagaggtcctcctgcctggccacgcacctctccacagggcggcctggggtctggagatgggcgctgggcccacgggacgcagatggggccacgctctgcccgtggctggcccacgttcctggtctgcagtgctgcctcctccccagcacccctggggcacagagggcagggtcacagctgggaagaggcggggggtagaaaccaaggctggcagaagtgtagccgggctccctgataaatgctggaggaccccagggcacctgcacttactgtaccctctctgagagcatttgtatgatctcatgtctcagctctggaggctggaggtcccagaaaaccaaggtatggtagattcagtctctggtgagtacccagttcctggcttctagatggcgccttctccctgtgtgtcctcagatgatggatgaggccagggtgctctctggagtcctttctgtaagggcactgatcccatccatgaggcctcatgactcccaaagacccccactttccaacgccatcacttgggagaggggcgttttcagcgtgaatcttggggaanctgaaacagggtgacacctgngtncntctcactctgtagctcccgaaggccactccagcccccattccaacatgaacagtggaagtggtcggggtccccaaattggcagctgtggttccccggggttcacccgtgagaaatccaccccaagggggtcccccccgcgagggaccaaaagcttccttcaagcttttttttggtc

SEQ ID NO: 712798 - DNA, 246 bp, Homo sapiens
acgatacccttcggggtatcataaactcccttcccctactcatcgcactaatttatactcacaacaccctacgctcacggggggtgctactatgtctccataatcatttgtttttggctcccacatgtgagtgagaacatatatgtctttctgtgtccagattatttcatttaaaataatatccacccatattcttgcaaataataggatttcattctttttatggctgaataatatttcattgtg

SEQ ID NO: 712799 - DNA, 2082 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcggctggtcctgtacgacgagctcaagaaggtgatctaagggccgcggccctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaagaaaaaaaaaaaaaaaaaaaaaaaaaaaaaaaaaaaaaaaaaaaaaaaaaaaaaaaaaaaaaaaaacggctgtgagcgcgcgccgcgcgccgcggcgcccctgagaaaacgcttccaaaaccactgggggggagagcgggggcacacaaagagagaacagagcaaaagggggcccaaggggtgcccaaggaaaaacaggggaacaaaaacaacgcagcgcgggggcagcctacccccacacaaaagaaaagagcgcgcggcgagaccacaaggacggcgtatgaacaacaacaccacaccgaggcgacctgagagacaccacaagagagggcacaaaacacaacggagaaccactaggaggaccgagaaaaaaacaaaacaacccccagagccggtggaaacaaagaaaaaaagacaaaagaagagacaacacgaaaaaaaaacagcgaaacacacacgcacaaacaaggaacaggagccacgcaggaacgaccagcacagcgccgcacggggcaccccgaccaggcggcaagacaagcggacaacgagagcggcaggaacgagcggcaaagacagacgggggggagacgaggcggagaggagccgagccgaccgaggcacggagccgaagaacgccgaaggtgaggagagagggaagagaacgaagagaggggaagaagacggcgagggagaagcaggaggaacaaagaaagaaggcgcgaaaggacgaggaaaaaaggagagacagagaaggcgacggcaagggacagcaggaagcc

SEQ ID NO: 712800 - DNA, 327 bp, Homo sapiens
aagtcactcctctctcctcagcttcccaaatgttctgggattacaggtatgagccactgcatcctaccttaatttctttctttctttctttttcagagacagagtctcactttgttgcgccggctgtgctcaaactccaggccttaagcgatactcatgccttgcatctccaaagcacatgagcaacttcttaatcattcttaagagacagagtcgtgacatgcgcccaagctgatgtcaagctcatgttctcaaagagacactctcgccgtatcctctcgagcagctgtgactacactcgacagcaagagtaccagctgacgcaac

SEQ ID NO: 712801 - DNA, 295 bp, Homo sapiens
tgcagggcaacagctactctgcgcatcttacgagctcttacttctcgctgctggttctgttctctcccagccagtaatctttgccccattttgctacttaagattctcctgagcccggaaggctcgcctggcccgtagagccctgtagaccggaccagcctctgtgatgcagccagtgcctcagtgtagaagctccacacactcaccccctcgtggtacaggcactccacgttagcatttacatctgttattgctattgtggagtgcctgtacctcagggggtgagtgtgtgtag

SEQ ID NO: 712802 - DNA, 902 bp, Homo sapiens
gggtggcggcggcggggacccttggggtctgggacgcgacgggggggaagttgaacggccccttccaagctttcggagtcggtactgtgctctcccgcaggggccgcggaagaacgatccccatttaccaggcggacccccagtgttaccccaaatgtggcctggtttttatccacccattcaacaaggggaagaccccaacaacatttgggggcaaaacccttccttttaaatctccacaagttctttaagaagaggacgccggaaaagggttcgcataatttggcggcgtgggccataccaaaaagtggtccccccaaaacccccttttttggaggcacaagaggcttacatctcaaatccagggattgtggaaagaaccaaaacgcgccgggagaacttaagacatgccccccagaggagaagggccttttaaaacccaaggcgggccaatacacagccgggagacctctcattccaaggtcggaagtcgtgggcacccttgtcgtttggaaagggaaaaagcagctatacgcgggggggtggggcgccaattaacagagtaggacataatgacaaggggcagagcgggaatttggcggcgttaaggcgggggccccaagcagagggggggcgcctccgtagctcgcgggggccctggtgttagcagcccctacgaggttacccatattaacctctggtgttggcccttaggacaccctctattccggggttttccaggaggggtgtacaccacacacacaccccaggagtgaggaaaagaagggcgagagcccggagtcaccacaaaaggcacatttgtgtgccctccgtgccttttttggtgggcgcacaagccccttttaagcacttggtggaaccacacgagagtggttagtccc

SEQ ID NO: 712803 - DNA, 181 bp, Homo sapiens
catagacatcctgaggtgctgggcctagtgttataccctgcgtgagatacactgagcctgtctagcgtagtatggcagaggaccaaatctcatgacacctagcttgtggagaccaggccagcaggagatggaaccttccagaagtgtgcagctgtggtggtgccttctgaagaagagcaga

SEQ ID NO: 712804 - DNA, 162 bp, Homo sapiens
  misc_feature (49)..(49): n is a, c, g, or t
  misc_feature (56)..(56): n is a, c, g, or t
  misc_feature (107)..(107): n is a, c, g, or t
  misc_feature (116)..(116): n is a, c, g, or t
  misc_feature (133)..(133): n is a, c, g, or t
atggatcaaactacctctataatgaagactgttctcaaaaacgcgaggnaatgtgngacgacactgacctatcagacaagagggcatgcccccctggccacctttgncgctgtttntgcaacgttcgcagtgntactctgcgtgaaccggtagactgcttgg

SEQ ID NO: 712805 - DNA, 1126 bp, Homo sapiens
  misc_feature (540)..(540): n is a, c, g, or t
  misc_feature (1123)..(1123): n is a, c, g, or t
gagaatcgcttgaacccgggatgcttgaggttgcagtgagccaagattgcaccattgcactctagcctgggtgtcaaaagcgaagctccatcacaaaaaaaaaaaaaaaaaaaatgatttataattttcccgggcgaaaaaagaggtctcttgtttcaaaaagaaaaaaaaaaaaaaaaaaaaaaaggggtttggggggggggggggctccgcgcccgccccccacacgtgcgcggcgtccgccgcaacatgtggggctgcccccgcgggcgtgcggccgcccctattttgggttccggcgagctttctaccccacagggtggttgccagaacacgccctgttgatttcccagaatctgggggtgcggctgcggccctaacagactcgcggcgtgtccccgagtcctccccgcctgggtccccgcggggggacaattcagtaccccccgggctttggacgacactatttattcacccccgaagatggtgcccccttggttaggcggcgccccacttcttctagccacagggtggcgcccnataggagagagtagacaccctttcctcatccccacataaaggcccctgtgtggagcacccactacacagccaccttcggccctttggggtttgaccaacacgcacaaacgaccgccgggggctccgacaccggggctccggcccatcgtgttgtgggcggcgcccctctgcccgtgggtgcttgtggggacccccctctggcacatatagagcgaaaccctgccgcgcagctcgcgccggccccccaactggcccccccctggtgtcgcccacagtccccccccctttatttcgccacccctttggtcatgctgggaccctgccttggcgtcgttcgttaccccgcccatacccctactgggtctctcccttaaattcccctttagtggggactccagattttggtcctcccccagatttgggcccctcctcgaggtaaagccgcgccggggccacttgtcccctgggcggggcgcggtccccgcagtacaaccccgcggcgcgaaaaaaggggggcccccaggcggttctgggggccggcccctccgcacccgctcctgccccctcccccctccctcaccangag

SEQ ID NO: 712806 - DNA, 153 bp, Homo sapiens
tactgatccgagctgagtctgcaatctacatcacagctcacggcaatgccagatcgttaacccactgagcaagggcggggatcgaacccacaacctcatggttcctagtcgattccttgaccactgcaccacgacgggaactccagttggggg

SEQ ID NO: 712807 - DNA, 610 bp, Homo sapiens
atagaattatagtagacagtgaagtatctaaacccaggaatcagattgaggcaccatgtgcatcgccttgagaattaataggctgcatttctgggttctcctttgtttgttttttttttggcccaactgagtctttctgtgaaccttttacatggaacttcttattctctaaaatcatgaagttacttgaaaatattcttggattgggaaaaacctggatgtagggccgtatgaaaaaatcattcgaaatcagatttaggggtataaggtgggataggaatgttttagaacagaagaatgtacaggcagataactaattggtcacatccaagaagtataaaacgtgctactttttccctagaacaagggacagctcattttttaggcagcctaaaccagtacagattttcttacctcctccaagtgcagattcttggtgaccttatcgattgtgtcaaaaactatttcttggggccctatgcattgccagagtgatctctaaagaacaggcaagttcaccacatttttttctgcgaggaaactaacttcccactccgtgataaacaattctctttacacacattcggataactacattttaacgacagaa

SEQ ID NO: 712808 - DNA, 130 bp, Homo sapiens
agcaccagcggcgcatcacagccttcagcagagagtttgccattctctgtccttgtcctcgctgtccagtttgatgtccagattactctatcagttttgctgtcacctccttacatgatacacgagtggt

SEQ ID NO: 712809 - DNA, 1703 bp, Homo sapiens
  misc_feature (1634)..(1634): n is a, c, g, or t
tgggggaaaaagccaggtgactttatttggctctggggggcaggggggctcagggagctctgggtgggggcggggtccgtttcctcttcaccatcacagggtcttctgggctggccgcgggatgggcgctgggccctgggggatgggctgcacaggtgcgacaggggtggggaggcggaacctgtgtggttcttggggagatctcggtggtggtctgtggaagtgcgtgcgtggaggggtgtggggggcgagagagacaatttcgtggagtgagaagtggtgggctccgacaccattagggagggggcgggacagagcgctatcatcgcgggcgtgggggcgcgggaaatctctcgcgcgcatatagagtgagaccacacgacagcggaaacaccacccatgtgtggcgcgccgcgaggcagtggcgcgggactctcacaagcgcgcccaaagagagctcgagagggcggggggaagaaaatctcgagcgcacccggtgtgagaatacgcgaggagagaggagagatgtgcgggggagcccttcatacaagggtactagggagggggccctcaagggagcgcgagggaagagagcactgtcgcgatataaatcaccactctgtgtgagctccagggagaaacagcgtgtgggagcgaccaaaggtctccacccgatcgagttggaaccaccgatattcaccgatgtggtgtcaagaaaagttgtcggccgcgaaaccagtatggggggcgggagggtgggttctccccccgcttccgcggacgaaggagcgggggcatgtaataaaacacagaccaaaagaagggacgaacccccccagaagcttaataaacaaacaatatgagggaggaaaggatctatctcaaacctagtttcaacctgtgtggaaacagcggcgcagtctaggagaggacgatagaaagacccgtaaagacgccccgcaaaaaaaacccacacagcagtcccacacgcatgtataacataacgcctaggaaaaaagaaaccatgatgatgtgccgacaaaaacccactatttttgaacaccccaacaaacaataaacgcgagaatcaaggggggggaaatacagcaacaagctgtgggagaaccccggtgggggcgccgaacgcaagaagaattatagtagaacaccccgcacgagggggtgagcacacagaagtagttgacgccaaacactaacttaattaataaacgccaacgagcagagaatataaatagtaagtagacaacgggggcgtggtaaaaaacccccgctaaaaaagcagagttcagttggaagacagaaggagaagctaaccccaggccaaacaaacaacacgccgtcgcaggggaggaagaccaacagccagtcataataagaaccccccgagtaacaacagagcagcagctattctacaaaggagataatagagaggagcaccaccgtgttattatttgagaccactgggggtagaacaatttatcagagagaggagaagagcaaacaacgtaggtgaggtagtaggacgaagatgaagataggagaacagtcgagtatagaaggcaggaatagagcacctaagactaatagtggaatgaaggcagagacgaactggnatgaacgcagaagtaagagctagcgaagaatatattaccgatggaagtgacgaagcatgcagagctaag

SEQ ID NO: 712810 - DNA, 1177 bp, Homo sapiens
  misc_feature (73)..(73): n is a, c, g, or t
  misc_feature (340)..(340): n is a, c, g, or t
  misc_feature (480)..(480): n is a, c, g, or t
  misc_feature (528)..(528): n is a, c, g, or t
  misc_feature (551)..(551): n is a, c, g, or t
  misc_feature (583)..(583): n is a, c, g, or t
  misc_feature (590)..(590): n is a, c, g, or t
  misc_feature (600)..(600): n is a, c, g, or t
  misc_feature (611)..(611): n is a, c, g, or t
  misc_feature (614)..(615): n is a, c, g, or t
  misc_feature (623)..(623): n is a, c, g, or t
  misc_feature (663)..(663): n is a, c, g, or t
  misc_feature (667)..(667): n is a, c, g, or t
  misc_feature (670)..(670): n is a, c, g, or t
  misc_feature (674)..(674): n is a, c, g, or t
  misc_feature (684)..(684): n is a, c, g, or t
  misc_feature (686)..(686): n is a, c, g, or t
ggacgccgttacccgtggggagcgttccgccatttttgaaaattaattgggaaggtactggttttaagtgtanttgccgacgcaatggcagcctttgcagtggaatcctcaggggcccgcgttaggatctgaaccaatgatgctgggttcacccacatctccaaagccaggagttaatgcccagttcttacctggatttttaactgggggatttgccagctccggtgactccacaacctcgatcaattagtggcccttcagtaggagtaatggaaatgagatcacctttacttgcaggtgggtcaccaccacaaccagttgtaccagctcataccgatanaagtggcgctccaccagttagaagtatatatgatgacatttctagcccaggacttggatcaacacctttaacttcaagaagacagccaaacatttcagtaatgcagagtcctcttgttgggagttacatctactcctggnaacaggggcaaagtatgtttagtcccagcaaagtatccggtcagccancgaaagacgacattatctcctgnccagttggatccttgttatactcaaggagatnctttganttcgaagatnacctcgatgantcnntgggtgantgtattgggttcctcaagcatctgtcttcctacatattantacnatntgcncagatgggantntctcaccatgtgatggtggtacatacaggaaaaaagggggcgtatatcgtgatcaaacttaaactgtggggcggagaaaggctctaagcagatggggggaatttggggaatcccccatgattggggttgaccctgttttgggccacgtggtttgggagcgtgaagatgtgttatcaattcacttaacttttaacaccatcaaatatggggtcccaccactgtgattgtataggttttttgagggaaaggcaaaaataaattggtccagatggacttttggggtgtctaacaaaggtggtcaaagagcaaggggggccggaaaacgtcagaaggttaattaaacgtagacagtggcgaagtgattaaaaacaggtgtgtcgggcattgttatgcacatcgtcagttgtcttgaatcacttgtcagttttttgatattgaaataagaacaagagagaggagaaaggcagagagagaaaaaagaaaagaagatg

SEQ ID NO: 712811 - DNA, 133 bp, Homo sapiens
acgaccctattacctaaatttattatgctgtggctctggcataggcctggtggctacagctcctattcgactcctagcctgggaacctccatatgcctgcgggaggcggcccaagaaattaccaaacaaaaaa

SEQ ID NO: 712812 - DNA, 290 bp, Homo sapiens
ctcctttcccctccccttttttcctcccctttgccctttgtttccttgttttgccccggcgtgggcctgggccttctccgccccccccttctagttgggggcttgtcgttgttctgccggctcccgccccgcctgtgtggaaggggggcccccgggcccttggggggccggtttctcccctcccgctggggcggccggggcgggcgagaaaggtggtgctcccgtggtggccctggggggcccttcgtttcccctccgttgctgctgttttaaaggtttcctttttgcta

SEQ ID NO: 712813 - DNA, 635 bp, Homo sapiens
tgtggctggggaagagtggaactcaatgacgatgctaaatgagaagaatgcaacttgtagttaagaccagtcggtgggacaatgcactgacagccctgtggtcttgggtgtgaattccaccttccctcctgtcatggtgctgagaggcagcgatggacggagaggacagcggcatctctaggctcttctgagagggacagagaaagaatagcaaatgttgcctaaaagcataaatgagtatcacctggagaaaattagtgcattcccgtctatggaaacacgtctctgtgagtttgcatatcatttggcgttggagccctggctcgatgcctcatggatctttctccccaaggagggccgtcttgaggggtccgagcctcaggccaaggaacccctgatgcagactctggaatccctggcccaaaggcgctgtatgggcccatctggggctgaggacaagcagatacatcatgacaactgcagaaatgtatccttctgaggaccacttagcatatgccgcagcgggtgtggcccaaccctcactcacctggggacgccgttcttccggacagtagacagcctgcctgtgccgcgagatgtcctgggggcccctgctctccctgaaagatgctgag

SEQ ID NO: 712814 - DNA, 241 bp, Homo sapiens
agtcatgtaggccactggagggcagcaagggatttatatggggacgtaggccgattccgggtgtgtaggtttctctttgggaggcttatactcatgaatctatgtctgaagctttcgagggcagactgccaagtcctggcgaaatagtagatggcaagttagtgggtttattatttttatacgggatttggcggaaacccgtatgattttgatacgccacatggagcaagtttcagcaaaa

SEQ ID NO: 712815 - DNA, 218 bp, Homo sapiens
tctagaggatcccttcgatgctgggctctagcggcggcagtccgctgcccagtcttggggggaggctgtccacagagagctttggaacagagtgaccccaggagaccatcctgttggcctgtgggctccccgtgacgtgcgtatccgtgtgcctgttgctctccttccgtgtcctggtgtgcccaccctgtgacggcaggatgtggcaaggctgggtg

SEQ ID NO: 712816 - DNA, 129 bp, Homo sapiens
  misc_feature (86)..(86): n is a, c, g, or t
  misc_feature (122)..(122): n is a, c, g, or t
tgtgtagaaaaaacttcatacgtttttctacagtgatttgtatgaaaggtaacatcaaatcaaggaatagcattcagtaaagtcangtagtgttcagtaagatgatgtaattaaatttgtanctaggga

SEQ ID NO: 712817 - DNA, 1052 bp, Homo sapiens
  misc_feature (149)..(149): n is a, c, g, or t
  misc_feature (175)..(175): n is a, c, g, or t
  misc_feature (186)..(186): n is a, c, g, or t
ccctagactgtcaggtattatccagtgcaggccaaagcccttctctcctcaactgtcagctcctatcacgacgaagaacggacaagagactccaccagcggaagcatcctgaatcttaacctggatcgaagcaaagctgagatggattngaaggagctgagcgagtcggtccagnaacagtccacncctgttcctctcatctctcccaagcgccagatctcgtagcaggttccagctgaactcttgacaagcaccatacagagttgcaaagcacaacttaggcataaatgacacatctcggacacatgtctatacggccgatagagcacagcgattcggaggcatctgagcacgctcagcatagctagcgcatagctgagcgtatactcacgctgcatgcatgagccacgcacacgctcctccagcaccacgagcccagcacagaccacagcacgcgacacaccgccaagcgcctagatccacgcatgcgccaccacaacgcagccccaactccctgacactgcctccacccacacccccacagcccccaacacagcccaccttaatcacaacaccaccccaacgcatgcccacgcaccatctaacacaagacacgagaaaaacacttggcacacaacacacggccaccggcttccacacccaacggccccacaacggcaacacacaaagggccaacgaaacaaccccttgggcaacgtactcaacaccatcacaacaatgtgaacaccatacgtgccaccccacacaccccccccttaattcgcccccatttaaccgacacacgggacacccaatcataatatcaccctagaaaaaccacacagagcatcatcaaatataccccctttttccaaaccccctgtccaataccacccaccaaacattcaatccacgccagcacatttaccctaccccctttgcaacacacagcgcgagaaacccacaacactctaccttcaccacaccacacccatcaccaaaattatctcccccaccactaacaccacgcaaacctttccccaacatccatc

SEQ ID NO: 712818 - DNA, 146 bp, Homo sapiens
tggaccgatttgacgcgtctcctctttgctgattctgtgtttggcccaatgcagcctgtcctgcgtcttcttgtctgcgatgctgaaacctggcctacccagcaccacatagaagtccaggccgtagataccaatgcttgggtcat

SEQ ID NO: 712819 - DNA, 943 bp, Homo sapiens
ttggcttatatagaaaagaagctaaataatcatcttattttaaagctaacctaacatttgtcttttaatctagtcatttgatttgtgaatatgatatgtagtagtcccaaagaatagaaaatccaacaatctggcaagtacttaacagtgtgtgttattttttactgttgttcctttttttctttttctgttacatatatcccagtcacttttttttttttttttttttttggaaaatgggatgtctttgcttgtttgttgcgcccaggctgctgtgggcccaatctcggttctttggcaacctccacttccggggttcaaggtgattctcctgcctcagcctctcgagtacgctggggtttcacgggtgccaccaccaccgcccggttaatttttggtttttagtaagagatggggtgtttccccttgttggccaggctggtctcaattctcctgacctcaggtgatctgcctgtttcggcctcccaaagtacggggtttacgggcgtgagccacagccacccaccccgtggtcacgtttttaaagccactttcatatccagttttcattggctcacacctgtattcccagctacttaggaggccgacgcagaagggattggttgaggacagaagttcaagacagctgagaaggttgggaagactctggcttcctaaaattaaaaactttagaattgtaaaaacctccctttagggaagccttttttaatgaggacatatgtgggcacatatataggaaaaccagcccctggaaagttcaggacataaaaaggggcggccaagtgacacggggcgaaagtctcaatatcagagagtatgaggtgaaactgttcacaccgctttcattgtagacagatgtgtccagtttaagtgtaaccctcccggaaattagtgttgtaaaaaacggttacagtgacaaatc

SEQ ID NO: 712820 - DNA, 268 bp, Homo sapiens
ctagtttctgtatactctttctgaatacctagaagggttctacttgtcagtgaaacctcatgcacgccctggaacacacacaagataaagtctccaggccaacagtgatcaagactgcatttttctttttctttcatgtaagctttctatttttttttttttttcggagatgggtttccactcttggttacctttaaacggtccttccttgaagcttatccgggtctccgctcacaaagagggcagggagaccagggtagacgcgagg

SEQ ID NO: 712821 - DNA, 113 bp, Homo sapiens
tgctgggattacaggtgtgaggcaccgcacctagccaactgctgatttctttagggcatggtccccataaacttttcataaagtatcagtgagcccaacatgggggtaccgag

SEQ ID NO: 712822 - DNA, 657 bp, Homo sapiens
tattcaggagcctaagaccctcccagtagcccagtgtgcttcaccgcattaccgcaagccattgagcacatcacccaaagcagtggccaacatcgcggacccctgtgccttgtcacagatgggtgctggtcctcaggcgttgggtgacactgcgtggggtcgagtgggcgtcggatttctgccagtttctgctctgacagtccaaatgactggtcagaagcagttgtcacttcagtaagcagtcaagtgctcaagagacactggcaaccgttcagtggtacttaggtattcgaaatatacaactacagattctctgacagaaaccagcacggggtcttcaccttcattcaccccacaggcgacatgctgagggagaacagcatctcagttggtgattcccaaaccaagcctttgtgttcggtgtaggggtgcggggggtctgctttaatgttttcgaaacttgtccgactgttgggcttcgtattgggatgtccactgaggaggtactggcattttaggggcctgttgtaccgggacatcgcaagcttgtgaacgacccatcggatcttgtattcccatgtgcgttgcgtcctgaatagagtttgcgttccccacgggccccttggggccccccccggggtgcttttttgggggcca

SEQ ID NO: 712823 - DNA, 184 bp, Homo sapiens
ctcgaattgcgctggtacccccgactagcccgacaggcggctggcgggcgggggctgacccccacgcctcctcccggacggggcggctgccaggcggaggggctcctcacttctcagccggggtggctgctgggcggagccgctcctcacttcccagacagggtggctgtcgggctcgtcgggg

SEQ ID NO: 712824 - DNA, 285 bp, Homo sapiens
catctcatctagctttattttaaatcagtaactaaacaaccatattgattgttgtgaattgggaaaacccctgggaatattataaaaatcactgaattgtacattttaaatgggtgaattttatggtatgttaattatatatcaatagaacagaatttgtgtgtgtgtgtgtgtgtgtgtgtgtgtgtgtgtgtgtcactgtattagacaggattctccagagaataatgtttcttcactctctaaagacacagctccttacatgagctttggtggaggtaaaga

SEQ ID NO: 712825 - DNA, 1899 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcggctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttcttcagcgctagcccctgttttgcacagccgagtactggcgagtatgttctatgttgggcctcctgctgcaaaacaataaacagaggacgcagaggtcctcctgcctggccaaaaaaaaaaaaaaaaaaaaaaaaaacggggggtaaaggggggggggggaaaaaggagggtcactgaaggggccaagcgtcataccgggtcccgggacccaggtttccttgggaccagggggaactcctgcggggccccaaaagagggggcgaataattcagaaacgcgggtactgtagagttggcgagagacgacgagggaacaccaccaacaggagaatggggcagcgaacactccatcagcaccacacgcgccaatgaggacaaaaaacacacaacacgagcagaaccaaaccaacacagcagatcgaa

SEQ ID NO: 712826 - DNA, 2503 bp, Homo sapiens
  misc_feature (122)..(122): n is a, c, g, or t
  misc_feature (2015)..(2015): n is a, c, g, or t
  misc_feature (2126)..(2126): n is a, c, g, or t
  misc_feature (2301)..(2301): n is a, c, g, or t
  misc_feature (2320)..(2320): n is a, c, g, or t
  misc_feature (2322)..(2322): n is a, c, g, or t
  misc_feature (2430)..(2430): n is a, c, g, or t
  misc_feature (2471)..(2471): n is a, c, g, or t
  misc_feature (2494)..(2494): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcgcctggtcctgtctactagctcaaacaggtttcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttttataatatatattttttcaattacttgacattccccaactctatcatcgttaatccccttccccctctttcctttaacccttcctctcatcatctctttctccccccttctctctatccttcacttacattctcctcactccttttaccctaactcttcattctttctccacattcccctctacttctgtcaacatctactctcttcccccactatcttttctcactcccactcctctttctcccataccattcaccttctttcccccttcttcctcatcctttctcctcttccttctttacatctacttttcatctcccccacaatcttttcaataatctcctattctttattattcctccacctccttttatccacaatatctttaatcctttctttctctatactctctctatattctcactccaactacccattctctcttctatcttttatacttantatattatacctctcttcttctttataactaatatcccactcttccaattctccttctccttcacattactctctatccattttctcactcaacttctcttcctcttcatntatcatctcttcttctatttctcctctttattctctctctcatctctttttctacatcactcttctcattctatctctcacttctaatttcttataatctctttccctattcctctcatacttccacactatccgtctcatctatcatttatctctctctactctatctctattnctacctcacatatatactncnccttactccttctatctctctcttacctatcatatcttctcttctttcacttctctcatcctccctcctatctccctctccattcctctaacatatttcattccaccntcttatttactctcattacttctctctcttatcacctcgcntatatcactctcttatcccttcntataccccc

SEQ ID NO: 712827 - DNA, 150 bp, Homo sapiens
actatgttgatttatcctcgtgttttacttcatgcatgcttcagtaccgctctgcagatgagccgatgaccaccttctacaagtgctgcaatgctcagtgtggacaccgctgtgagggattagaggccgaggatgtgccagtctgcccta

SEQ ID NO: 712828 - DNA, 1881 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcgcctggtcctgtctactagctcaaacaggtttcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttcttcagcgctagcccctgttttgcacagccgagtactggcgagtatgttctatgttgggcctcctgctgcaaaacaataaacagaggacgcagaaaaaaaaaaaacgacacgaagggcaaaaaaaaaaatgatgtggcgcgccgtggatccccggcgaaaaagacgtttctagaagaaccactctgcgtggggccgcgcggcgcccccgaacacggtcacaagtgaaaagtgggccacagagaggtgttcctaaaggaaaaccgcgggtcaatgaacagggtggcggggcattctccccccaatataaaaaagcgaccgggggggaacacacacgggtcgcgaaaaaaacccccgaggggagtcgggagggccacgaggggccccaacaaaagggggagccaagggagcccgaatacagtcgc

SEQ ID NO: 712829 - DNA, 1877 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcggctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttcttcagcgctagcccctgttttgcacagccgagtactggcgagtatgttctatgttgggcctcctgctgcaaaacaataaacagaggacgcagaggtcctcctgcctggccaaaaaaaaaaaaaaaaaaaaaaaaaaaaaaaaaaaaaaaaaaaaaaaaaaaaaaaaaaattaaaaaataaaaattttaaaaaaaatttaaatataatgtacgatattttttcttaattgtaatattatccaactccgggccaaatttggggctatattgccccatttccccctttgggggggcctagtcaaagctcagggggcgtggtttttcatcccggtggcgttgtgaacaacttggggtaccccccattgaccggtatggtgctcgctccttattccgagtgtggc

SEQ ID NO: 712830 - DNA, 1182 bp, Homo sapiens
gaattccggaagacacttgaaactgatacagttacaggtaagtctggtgagaagattgactactctacaacacctcgaattgatgaatggcgtgacaagggttatcgcttagttgaagatggtttcgctgaagcaggcacaccggtttatgatgataatgatgatgtcgaacaaatctttatcgttaaattggatcatgatactgcaccagttgggccaaatgatccacatgaaccagaaacaccaatcaatccaaacgatccaaatggaccaaagtggccagctaaggatagctacacaaaacaatatacgtcaacggttcattttgtagatgaaaacggtaataaactacacgattataacgttcaaacatcaaattggacacgaacattgattgtcgataaggctactggtgaaatcttgaatccagatgaagcatggcattctgatattgataagtattctgatgtcaaagttgatcctattaagggctactatactgaccgcaatagtgtaccaggtgaagtagcacaacaacaagatattgtgaatacggttgtttataagcaaattggtaagattgtaccggttgatccatcaggaaacccaattccagatgcaccaacaccacaatacagaaacaatcctaacgatccaactaaggttatcgtaacgaatacgccagaaattccaggtatgacaccagaagtaccaagtgttacaccagaaaatccaggtgaagatacaccaattgtttacaacaaggttgaaacaccaacaccaaagacagtagatgtgacaccagaaacgccgaaaacagtcgacgttacgtcagaaacaccaaaggcaacaccagttaaaactgcgcctcaagttgaaaaagttaaggcgccagaattaccacaaactggtgaaaagcaaaataaggcgttaactgccgtcggtgcatctattatgactggtctattaggaatccttgcctttgctaagaaaaagaaggatgacaaagaaatctagtcatttggtttaagaaagaagagtcgaaagactctttttttattggtgtgcgtgataataggttaattattttttggtaatatctcatgaaaaactatgcataattttaggtgcaaattagccaacgatatatcaatatttttatataatagttgcccggaattc

SEQ ID NO: 712831 - DNA, 1967 bp, Homo sapiens
  misc_feature (122)..(122): n is a, c, g, or t
  misc_feature (1967)..(1967): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcgcctggtcctgtctactagctcaaacaggtttcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagcaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtcctcctgcctggccaaaaaaaaaaaaaaaaaaaaaaaaaaaaaaaaagggggggggggtaaaaaattctccccgggggggcccaatttcggttccccgttttttttgtaaaagggggccccaaaaggggaggcgggtattaataaagaggaagagggcaggggggcgcggcgggttaacacaccggtggtgagcgggggagaaccggcgtgctgtggggtatcttgtgggagaggaggacccttattctcgtggggtggcggcgcctttgctcgggcaacttcccttaaagagaaatttaatagtcgaagggggaaacttttacactttcgcgtgtttgttggtgtaccccacggcggataattggtgcgcggtagaaaggttcgggtgcccgtgtattggtttatgaan

SEQ ID NO: 712832 - DNA, 127 bp, Homo sapiens
gagccttagaggttaacaaacagcgaaacgccgtcgaggttatcacgagagacagaaaacaacatgaacaggagcagtgctgaacatcgactggaaccatgtggtctggctgcagattggacccaga

SEQ ID NO: 712833 - DNA, 2412 bp, Homo sapiens
  misc_feature (122)..(122): n is a, c, g, or t
  misc_feature (1527)..(1527): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcgcctggtcctgtctactagctcaaacaggtttcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaaaaaaaaaaaaaaaaaaaaaaaaaaaaaaaaaaaaaaaaaaaaaaaaaaaaaaaaaaaaaaaaaaaaaaaaaaaaaaaaaaaggggggngcgcgcgcgcgctaaagaaatatctctcctctagagagggcgcccacaatataactctcacgcgacgcaccgacacttattcttataaagaaagaagagggcgcacccctatatatagagcaggccagatatatatatataatgcacagagcgccttagggcgcgcaggcgagtttatacacgcgagagggtggcgagagggtgcgtgagcagacaccaaccgcgtggagcacaggtggggggaactctcttgtgtgctggagagaggagagagaccctctcatctctatctccgtgggtggggagaggagagaaaaaaaaaaaatgtgtgtgagtgacgaaaacaactaccccccaaccgacaggcagcaggatatataatatacggcgcgcccactccgagggagaggggagaaacaatcacatagtatcaccaagagatctcatgacgagaggggcgcgtgctatagcacacagggcgagtgcttatgacacaccaccaactgacacgggcgcgactccgaactaatacgacacaaccgagcggcgcgcgccgcgaagggacggccgtctgtgagcgagcgacagacaagggagaggggtgttataactatctaatggacacaagagcactttctctctatactaccaccgggggggcaccttcactactgggctgctgacattaacgacgcgacggggcgggggagtagcgcggcgtccgcggacgggcggatgcaacgacgccaagacaaccaggaccgcgcgccgcacgacggcgcgagcacgacgagaagtgcgatggacggggcgagagggcgcacagcgcgcaccgacgccaccaccctccgaggcgagcccacccgaccgcccccccgagccacc

SEQ ID NO: 712834 - DNA, 1857 bp, Homo sapiens
  misc_feature (122)..(122): n is a, c, g, or t
  misc_feature (1546)..(1546): n is a, c, g, or t
  misc_feature (1549)..(1549): n is a, c, g, or t
  misc_feature (1623)..(1623): n is a, c, g, or t
  misc_feature (1656)..(1656): n is a, c, g, or t
  misc_feature (1661)..(1661): n is a, c, g, or t
  misc_feature (1665)..(1665): n is a, c, g, or t
  misc_feature (1668)..(1668): n is a, c, g, or t
  misc_feature (1670)..(1670): n is a, c, g, or t
  misc_feature (1687)..(1689): n is a, c, g, or t
  misc_feature (1692)..(1692): n is a, c, g, or t
  misc_feature (1699)..(1699): n is a, c, g, or t
  misc_feature (1704)..(1704): n is a, c, g, or t
  misc_feature (1709)..(1710): n is a, c, g, or t
  misc_feature (1716)..(1718): n is a, c, g, or t
  misc_feature (1722)..(1722): n is a, c, g, or t
  misc_feature (1724)..(1724): n is a, c, g, or t
  misc_feature (1730)..(1730): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcgcctggtcctgtctactagctcaaacaggtttcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagcaagtcgtgttctaagtatttatttaaaacaaaagaatcacgttttcccatttgtacaaacaactccaaccaaaaaataaaaaaatgtgggccgctttggccaagtcgactttagactcgggcaggtttttccatcgcgccntgnggccgaatttggggttaattgggccaattccccttatggggggcggattaacaattaatgggccggggtttaanaacgtgcggactgggaaaaccctggggttcccnaattnaatngcntngaaaaaatccccttttnnncanttggggnaatancaaannggcccnnncggntngccttnccaaaaagtggccaagcctgattgccaaagggaaatggaaggggtaaaaatttggtaaaaattcgggttaaattttggtaaaacggttaatttttaaccaatgcccgaattcgaaaaatcctttttg

SEQ ID NO: 712835 - DNA, 268 bp, Homo sapiens
gtacagcatgtctcttcctaaccctaaacgaagaaaacagcagcagctttaaaaatagctataggttgctaatctgacactaaatttaatcacagaactaagagcaagcctaatactctactctgtcacagactgggcactgaggtaaatgctttacaaatatacacaataaacattataaccccgtaacaatcctacagggatggacacaaacactcagaaaattaagtagcatgtaaggtcatctagctcgacaacattgtgatta

SEQ ID NO: 712836 - DNA, 1884 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcgcctggtcctgtctactagctcaaacaggtttcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagcaagtcgtgttctaagtatttatttaaaacaaaagaatcacgttttcccatttgtaaaaaaaaaaaaaaaaaaaaaaaaaaaaaaaaaaaattgtgggggggccggggccccgggaagagagctttttgaaacacacatcctggtgtgtgggcggcgcgggggccccagatgaggtaaggggaaacagggggaccaaaggggtgttccctagaggagaaaccggggacacgcgacacaagagggggggggatatcctaccacaacaataaaaaaagcggccgcgggggggggaaaaaaaacgcgagacggcgtcttatggagaaaaagaaaacatcgccagagacagggagggtcatccaggggggggccaaataagcacgagggggcagacacaacatccaccgggggaggagacacacgaagggaggatgacggcgaaattaccagaaaattagagcgccgccggcagcgcgggggca

SEQ ID NO: 712837 - DNA, 1814 bp, Homo sapiens
  misc_feature (122)..(122): n is a, c, g, or t
  misc_feature (1496)..(1496): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcgcctggtcctgtctactagctcaaacaggtttcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagcaagtcgtgttctaagtatttatttaaaacaaaagaatcacgttttcccatttgtaaaaaaaaaaaaaaaaaaaaaaaaaaaaaaggggggngcgcgcgcccggggccccgggagaaactttagagaacccccggggggggggcgcggggggcccaaagagagggaaagaggaaaacaggggcacaaagagggtgtcccaagagggaacaccggggccaagagaaaaaggggggaggattcccccaccaattaaaaaggcccgggggggaaacgcgcggagggttcgggagaaaaatccccgagaggggggagacgagaggggaccaaaaggagggggatctataaaaagggggagtcccagagggagaaccgcaatttcccaattaagggccccgcgcggggggggaac

SEQ ID NO: 712838 - DNA, 1861 bp, Homo sapiens
  misc_feature (122)..(122): n is a, c, g, or t
  misc_feature (1550)..(1550): n is a, c, g, or t
  misc_feature (1553)..(1553): n is a, c, g, or t
  misc_feature (1627)..(1627): n is a, c, g, or t
  misc_feature (1660)..(1660): n is a, c, g, or t
  misc_feature (1665)..(1665): n is a, c, g, or t
  misc_feature (1669)..(1669): n is a, c, g, or t
  misc_feature (1672)..(1672): n is a, c, g, or t
  misc_feature (1674)..(1674): n is a, c, g, or t
  misc_feature (1691)..(1693): n is a, c, g, or t
  misc_feature (1696)..(1696): n is a, c, g, or t
  misc_feature (1703)..(1703): n is a, c, g, or t
  misc_feature (1708)..(1708): n is a, c, g, or t
  misc_feature (1713)..(1714): n is a, c, g, or t
  misc_feature (1720)..(1722): n is a, c, g, or t
  misc_feature (1726)..(1726): n is a, c, g, or t
  misc_feature (1728)..(1728): n is a, c, g, or t
  misc_feature (1734)..(1734): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcgcctggtcctgtctactagctcaaacaggtttcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacntgnggccgaatttggggttaattgggccaattccccttatggggggcggattaacaattaatgggccggggtttaanaacgtgcggactgggaaaaccctggggttcccnaattnaatngcntngaaaaaatccccttttnnncanttggggnaatancaaannggcccnnncggntngccttnccaaaaagtggccaagcctgattgccaaagggaaatggaaggggtaaaaatttggtaaaaattcgggttaaattttggtaaaacggttaatttttaaccaatgcccgaattcgaaaaatcctttttg

SEQ ID NO: 712839 - DNA, 1054 bp, Homo sapiens
tataagggttatatgcccgagagggccactctgtgggttgtgcgcgcgagaaatggtgcagcggcgcaagctgcatgggggtgcctcgtcgccactgtattgaacttgttggtagtaaaggcggccccatgatcacgggaagagggagtgtaccccggcgatgttgtgtgtcaccacattgtatgtatatgggagacacgtcgccgcgtcgtggttgtgtaagaatggaggaatggggagaggggtgtaccaaatgggggtgggggccgcaccatcagagagtggatgatggtgctccccacaaagtggacgccgtatagaggcaactccccaagggagagccgtgggcgcacagaacgccacacggagaaataggtgcgcggcacacaagcgcgctgtgccaacagggggtactacatggagaggagagccgcacaggcacacagggtgcttgtctcgtcacaaagtggtcgcgcgcaggggggctaacacgctggagagagggagagcccacactggttttgcgcccctcggagagagacacacgtgtgtgtctaaaccgtgggggtacaacgctcgtgacacacacagatgtgagaggggtgttagtgcccacgcgatgtctctctccgcgtgtgatattaacactctttcgatatcgtgtgcacacacacgcgtagagatgtgttggacacaggtgcacacgacgctgttagcgcccggttagaccgcgttcccagagagaactgtgccaaggagaccttcgggcaactgaaagagttctgtgaagaggtgtgagacgcactctgcgagaactccacaagaaggggtaaactgtcaccagagatacctcaccagcaccggtgaggtgctgtgcccacactggtgccggcaccaagtgaagccgtagagctggggctgggtccagccaacccgaattcccagtttagaggcggatttggtcgtggacgtggtcagcccaccactccagtataaattggagaggattctttgtgccattgaatataacttaccagccctaagaaaccgttaa

SEQ ID NO: 712840 - DNA, 414 bp, Homo sapiens
  misc_feature (369)..(369): n is a, c, g, or t
atatccacatccattgccttgatagcatcatccacagcctccaagaaatgagccttccattcccgtaggactcggctctgattctgtgcgatgaatctcaggaccctgatcttgctgcactcatggcgggctcgcaggccccagagacattcatactcggggggttgctgttggggatcttcttgtattccaggtacttctgcttcacaaagtcatctgtgatgagcttcctcagatcgccgaggaatgggtgcctcaccccagggcgcagtcccatcttgcgtagtgcctcccagaggacagcctcgctggcacggttgccattcatgaagatgacgcccagaatcaccaagaggagactcagcctgngagtgtccttggtttttccaaggaggcgagctgaggagtcccgtg

SEQ ID NO: 712841 - DNA, 560 bp, Homo sapiens
caaaaaagccttgcatctggttccggcagggggatggtaaagagcgccccgagctgggggggtcaaaagagggtgattccaggggagggggaaaaccaattcccctaccccgttttgggggaggggtgcccgaacccccctgggggatggggcaacaccgttttttaatattgaacccgcaagggtgggggactccccatgggggatattgccccctttaacctgggtggtcctgaccaaaaatttggggggggcggtggccccggtggctttttataaacccaactttttttggaatcccccccaaaaaaattttacccccaagggggtccttttggtttttttttggccaccagggcgaggggccggccaaattccggttttttttttcccaaagggttgggaccgggataatttggcaaagaaaaaaggtacttttttttttttgggggtccccccaaacccattcaaagggtttttggtttttttttttccccattcccatttccaaagggttccaggggggtttaataaataaacttcccccctttttttggtta

SEQ ID NO: 712842 - DNA, 304 bp, Homo sapiens
  misc_feature (263)..(263): n is a, c, g, or t
ctgtagtccagctactcaggaggctgaggcagaatggcgtgaacccgggaggcgtagtttgcagtgagccgagatcgcgccactgcattccagccttgtcaacagagcaagactccgtctcaaaaaaaaaaaagaagagtggcctggagcctccttcactttctccacctagacccacttgacagtgggtgacatatttgggttttggctgacccatttaggagtaacttgagatcatgacatcgcgacttcatatcttcggngaaaaatagtgtgtgccagccacgaattgtcggggtaccga

SEQ ID NO: 712843 - DNA, 869 bp, Homo sapiens
ggtcccggctgcgggggtaggaggtccgcgggcagcctccgggtaagccaagcgccgcgcagtgctgagttcccgcacgccgcagagccagggaggatcggcaccgagatcagccgcaagatccggtagtggcgatgtaaggggaaattacaagaattaggagcttatgttgatgaagaacttctctgattacattatggtgatggtggcgcaagaaggaaaagtcaggagcaaatgacagaggatcttgtgcctgatttctagggaacaacacaattcggattcagccgtcatggactatcagtggtgtattcagatagaacttgcgctctgttacaactgaaccctctagtctgaagtcttgctgataccaacatctttgatagtaacgtgccttcaaacaagagcaatttcagtcggtggagatgagaggaggcatgaagctgcagtgccatccacttgccatgtccgtagcgcgagaccgtgaatcaaagagattccagagtttctacaagttcgcaggagtcaaaaaagccacaaagtgtcagacagacttacgatgatggagctgcaatccgactaatgtcaacagtgaaacctttgagggagccagcagcctctgacagatgtgatgatatgaagccagaaccagatgatctcattgaggaagacctcacttgtgtgcaggagaattcccttatctcagagacaaacctacggtggacacttacatatgggtcttctcggccttctatggaaatgtatcgacactgaaggtagaagatgcgaagaggaggtcattaaacaggtgcatttcaagagagaagatagataatgtggaaagaggatggatgcgaagaggggaaagg

SEQ ID NO: 712844 - DNA, 133 bp, Homo sapiens
ttacctagattagactctcaaatcaatggctgtagataacgggatcgactttacctcacaagccaaaaccaagagagctctgacttactgaacatccttcatgaccacatacaaataggtctaaatgcaatca

SEQ ID NO: 712845 - DNA, 220 bp, Homo sapiens
gtgaatctcacagatagtgaagagactaacatgaacatctcagtacacagaccccctgccatgactgtgaaaaagaacccagagaggaacgaaagggccccaagaaagggactgctgctctgggcaaagcaacagacaggtgtccattactggcttcttccagaggaaataaactgccatctctggtagatcagagacttggagtggtcaagggagaaga

SEQ ID NO: 712846 - DNA, 292 bp, Homo sapiens
aggaaactaaaatgtattgaatgtctgctctgtgtcaggtaatttgccaggcatttttcatgttattgcctttatttaacccctcaaaactcaacttgcagcgttaggtttaaacaatttgcccaagtttcaaaagcgtggagctggcaccgtgttgcctgactccaaagcccggtgtgtgcttcccatttaaggcacacttccctgtgcccagaagccaggcgcagcttcagatgtgcctcctcgggctcggcgttgtgaggaagggacgaggttacagaaagggcttttg

SEQ ID NO: 712847 - DNA, 1279 bp, Homo sapiens
tcttcccataaaaatgggttcccactgtgctgcccaggttgctctccaatcccgttgggcgtcaagcaatcctcctgcctctgcctcccaaagcgctgggattacagttgagaagccactgtcctctgcactgaggaggctccttaacctggcggaacatcaggcaggtcttgccaggccaggtttcagaacttaacggaaagctggtctggatgtagtgcttgtagagaagcttctgaaaaatggggcacactccgtggtcacgttggcatgcattcctccgtgtcctaagtgtttcattagacaagttctcgtgacaggtgactgtaaaagtgctagaccactacgtgctaaaactgctttgccacgacactaagagacgactagtgataaccatctccgagagataataacagcgacgtgtcactggtgcgcacccacaggggcacagccaaaccagacaaccactaaaagaacaaatctcgaacaacagaagactcacgaagggcaaaacgggacactatagccgccaaggacaaccagtaaaaggaccgcagaaagaaataccacagtgagccccaacgtttacaatacacagcacagcgaaacgagacaacttcgcagtacaaatacccgaggatcagcgacaacaataatacacgcaccctagatggcaaaccgaccaccaaagcgacaccaaggataaaaaatcaaaagaggggcaaacacaggggcacaacaacgagcagagcgagtagatacaaacccccgtgctagaaaaggcgacactattacaaccgctggcggagcaaaggaacgacaaccaaggagcaacacacggtagcgacaccccccctccaagacgagactgaactaccagcacgaaaaacgggggcgaaaaaaacatcgaggcggaaacagcaggggcgacacacccaccaacggaccatgcccaccacacaaaagactagccaagaatgaagaaagggcgaaaacacagggcatgcaccagcgcgggcaaccaacacaggaccagaaagtcgcaaaccacctgcagacacccaaactacgtataggcgccacacaacaggagatgcgtagggcagacaactcagagaaaacaccacgcacgctaagagcgactcactaacaacagacgtgaccaagccaactcacccagctcggacagccatcacacagagtcactcacaccgtggaaaagacaatagccggtgaggagaaagcacacacaggcgagttggaacaatgcacgcacgaa

SEQ ID NO: 712848 - DNA, 133 bp, Homo sapiens
aagaccatctgagtgacttaatgtaggcaaggtcccgggactatgtgcagacttcttctgggcttacccatgcacgggcgtccctgagagcccagggcagctttcagatagtgtcctccccaggagcagggaa

SEQ ID NO: 712849 - DNA, 336 bp, Homo sapiens
tgagaatgcactcttttttaaatgacgtgacgcacactcacgaccctaccggacgacacctctcgactgacacgccagagcttacgttaatcttgactacactggagtgcacgtcaggtagtctatacgtataattattggtcgaggggcagggaccagtggaggcagtatagattttgacggaagccaaacaggacagcctgatgaattcacgatttccagcatatatacatcttcaccaatcccaccaccttgctccagcctgtcatatcactgtgtctacatcaaccaaaacaacacaaaaaaacccccagggcccacctctctgccctttct

SEQ ID NO: 712850 - DNA, 331 bp, Homo sapiens
ccgtgtcatccccttgtgtctctcccagacttacagtaaaggggggggcttgcccgacaatcttgtggacacacactcgggcaagtccttggcactgctcggtgcagcatcctggcctggctcggtgaggcacagagggaagcccaagtacactccccgatgtgagtgaatcctggtataactcttgagcacaggcttgtgccaggtgccgtcacaccctttctcaccttcagtagcatacattaacccgggaagtgactgctgctctcaccagggcgagggaggtaacacacttaacccaaggaccacccacccacagcttagttagtgg

SEQ ID NO: 712851 - DNA, 237 bp, Homo sapiens
accccgctggccaactggcagccataggtacaggtaacaggtgcaggctttcttaagtaccctgcctccactctatagcccagctgctgcgtggagtccaggaccttagacccaggatgagcaaaatggatcccaccacggttgtccatggaccagttgccatgggtgacccctagagttcttcagaccctgtgtctagatacgtgcatacatgtagccattgggccaggcgggggc

SEQ ID NO: 712852 - DNA, 218 bp, Homo sapiens
cgcaaactgccctgtgccatgcaggcacatcagctgcccgcgatccaggcagaccagccccaccgcgcccgcgtgctggtcgccagccgacgcccgtatcggcacggcacggcccaggaggtcctcgcgtgtatagccgacatcgtcggcttcctggcgcacaggccggaagaagatcgcgcggaaactccagcgcgtcgatccagtccaggtaatag

SEQ ID NO: 712853 - DNA, 651 bp, Homo sapiens
  misc_feature (418)..(418): n is a, c, g, or t
tcgggggttcaagatgtcgaagcgaggacgtggggggtcctcgttgggtgcgaaattccggatttcctgtgggtcttccggtaggagctgtaatcaatggtgctgacaacacaggagccaaaaaccggtgtatatcatctccgttgaaggggactcaagggacggctgaacagacttcccgctgcgtgggtggtgggctgacagtggtgatggccacagtcaagaagggcaaaccagagctcagaaaaagggtacatccagcagggggtcattcgacaagcgaagagctcataccgtagacaaagaatgggcggtgtctcattacactgttgggaagcataagtgcaggagctcataggtggaacaataagaggcgagacagtgacagaggctctcgggcccatctacgggggaccangtagccaacaggcaggtggtgccagcactgggtgggcccccgggaatggccaatcccaacgtggctgggccaggcaatgtggccaatggaattctcccagaggaatatatgtggctacaaacaaacacaacaacaacagggggcgcgcgcgccccagaaagatactcccccggagagggggggccacaaggcgattaggcggtacccgaggctttacggggatccaacagggg

SEQ ID NO: 712854 - DNA, 173 bp, Homo sapiens
ccccctctatcatgcaagaatggccatcatcaaaaaatcaaaaagcagtagatagattttagtgtgcatgtggtgaacagggaacacttttttttttttgggaaaacggtttggctcttgttcccccaggtggaattgtttgggcccactctcagttcttggaaccctcggcc

SEQ ID NO: 712855 - DNA, 110 bp, Homo sapiens
tgctccagagaaatttcatgaaaggaagagtccatccaggcagcaaactgtctcacggtcttatttcaggagaatcgcttgaacccctcaggcaaaggttgcagtgagcc

SEQ ID NO: 712856 - DNA, 133 bp, Homo sapiens
tgagctcgcaccgctaaaatattttaaaatggtgtctttattagtacaacggcattttcattaggtaacaaaattacctgtcattgcaatacttccttcttatctgtagtccctgtagttctgactgtgaatg

SEQ ID NO: 712857 - DNA, 1037 bp, Homo sapiens
gttgcttctgggactcctgttacccgcaaaggattggaccggcggtgtcgaggagcctgaacctggtaggagactgagttgagaatgcgttatgggatcgatgcatcctgaccgttgacctgtctatgtgagagggctacgagaccaatctttcggaacgtaggtgagttgtgctcctactaatgtacaaacatggcgtctatagagtgtcagtgctgcctacgcctagtgcacgccttattcatctctccagcgttgaaagaggaggatggcgaacacatccctgtctctcaatccaagggcctgtggaatccgcctgcagtctaggttggatgaccccgaaatgcatgacgatgcctcccctgacttagcgtgaagaactaaatgcgtatctaggtggggatcatatgaattcttgtatatgtgaccgtccaacatcacaggcgaatacgcagcatggaagattcaggagatcaccaggtgaagttctctatctcggctactatcaatcagccttcgactgggatgatgaacacagccaacggtctccaggcagcatcgtcttaaacgctaccaaagccagacctatgggcaatgggtccaagtgcgacttagtgggaggccccgggatggtcgaggtcggttcctctgtgaacgagggtgcaggtttctctggggacgtaccatcgatcgcggtggaccagcctttgtctgctctgattgttgctgaccattttgactcctcgggtttggcctgcacccggttctagcagggcccgaacaagggtctgcaccgagggccaacctcatgataccaataccgttaggccacgtaatatatgccatggtccgacgtacacccgacacacccttttggtaaacaccgatcagacgacgaagatcaacgcccccgagtcggcgatcaactggtgaggccaacaatggagggtattgacacgctatataggtctgcatgtgcaaccaccacacacgccgtaatatctggatggcaccacgccgcgcactgtccgtaacat

SEQ ID NO: 712858 - DNA, 569 bp, Homo sapiens
  misc_feature (40)..(40): n is a, c, g, or t
  misc_feature (45)..(45): n is a, c, g, or t
  misc_feature (104)..(104): n is a, c, g, or t
  misc_feature (223)..(223): n is a, c, g, or t
tttgaacgaggatacgagacccgattcctgtgcaaccacntcganggaatggaagaaagcaggagttgagcagctacggctcagcacagtcgacatgactgggntcccaaccttggccaatctccacaaaggagtccagtttgctctcaagtaccaggcactgggccagtgtgtctatgtgcattgtaaggctggtcgatcccagaaagttccacaatggtgncagcctaatctgattcaggtacacaactggagcccagaggaggctatagaagcgatcgccaaaatccggtcacacatctccatcaggcccagccagctggaagttctcaaagagttccacaaggagatcactgcaagggcagcaaagaattaactactgattatctctcatgctgacttaagagtctgaagactgtggataacaaagaacttggatctccctgagatatagtaacaagtttacaggacaaagcagcttaacccgaccacactgcaaatgtgctgactggtagataatgtgtctcctttgccttccttcctgaaataacacttggatggctacagag

SEQ ID NO: 712859 - DNA, 933 bp, Homo sapiens
tgttcttccgcccgcgtccgccgtcgcgtttctctgccggtcgcactggaagaagagatcgcgcgcgctggtcattgacaagtggctccggcatgtgcgaagctggttgtgcgtggggacgacgctccccgatgccgtgtttccgttcctatctgttcgggcgcccctagacacccaggtcagtctaatggtgtgggctagtgggccataaagagtactcctacagttgggcgatctgagggcgcagagctaagcggtgtgcataacctggacccgtgtaaggtacccgcattgagctactggacatacgtctactcacactgtgagaccgaagcattgtggatgcacatgaatactgggcgattgcagcgaccttttctaggcgaaagctgaaggctttgacccgctgctggggcccccgtggagggataggccaagctccatagttggcctagcctagaagccagaaaggggccacccccctgtgaaccctcctaatgagcccaagcgttagagacgaaagaaaggattgatcctacaacagatcttacatgattatcacgaccgtacctcgattcgaaaagacacccccccctggggtgcctatttggttaccatgttgtggctccgtttcccactaggctcgaggttagcatttggtctcgcagatccataccagagccattcaatagaggagctcggcatccaaacgttaggtcgactttttgtataagatagggaacttccattggcgttggaactctggtggggtccacgccactagcgaacaaatagtgtggtcccatattcctataacagaaaagaggggctaacgggcacactataccaccgcccaaagtggacccgaattccttgagcaggttctattggaacccatttgtgcactttgtgacctttgaaaccccttaaaac

SEQ ID NO: 712860 - DNA, 796 bp, Homo sapiens
  misc_feature (472)..(472): n is a, c, g, or t
tagcatagtggccatgacagagtaaggcacttcagtaaatcaatggccatttatctcatctataaggcagtgacaagtagaattttcacaccagggttgtaccagaaagtagagcggcctgcctggcagcaccaccactcacatccagcgccgcgcaatacacccagagctagtgccacggcccgcgcagacaaggcgccagtgcaactcgatatctcgaccccacaaccgcattggcaggcagcgccgatgagcgccgtgagaagcgactcccctttgtgtcacacctatcagcggacgtttggaagagcccacacgaccctgtgcggcaccaaacaccacaacggtgtcgccacgcaattgggtgtagggcccctcccccacaaaacaccacacacaatcacaattacaccaccacacaactcaagacgccctgggcctcccttgggccgcccctccacatctgcggggncacaacgagacctatacacaacggggccccccgcccacaaaaaacacatttgacgctcgctcaccgccccgctgttcataggcgggctgcaggagcggtgcggtggagccagacacggcaccgaccgacactctatgagcgagggcgccggcccggcgcgaccccgggaagcacgcgcgaggacgggtgacgcgccgccgaagcaggagccggctcacgccccggctcgtcgcgagagtgtacgacacgaccggcagggcgggcgcttgccgtaggaggacacaacacagacaggggggatataaacaacgcgccaagaacgaa

SEQ ID NO: 712861 - DNA, 521 bp, Homo sapiens
  misc_feature (15)..(16): n is a, c, g, or t
tcactgggaagtttnntggcaatccttggtattatggcaaagtcaccaggcaccaggcagaaatggcattaaatgaaagagggcatgaaggagacttcctcattcgtgacagtgaatcttcgccaaatgatttctcagtatcactaaaagcacaagggaaaaacaagcattttaaagtccagctgaaagagactgtttactgcattgggcagcggaaattcagcaccatggaggaacttgtagaacattacaaaaaggcaccgatctttacaagtgagcaaggagaaaaattatatctcgtcaagcatttgtcttgatagtgctcgtcagcagtgactgttccacagctttaactggtcatgtaactggagactgagaaagtgctgggccaattgtacttgcttggaaagtgctgtttctaactatatgagaattgactataatacatgagtatttttgttataactcagcccatacgtatatctacatatgcagtgcatctctatgaagagttcttatcc

SEQ ID NO: 712862 - DNA, 627 bp, Homo sapiens
ggggagatggaggtagcagtgagcaagatagcaccactgcattccaacctgggtgatgaagtgtgactctccaaaaaaaaaaaagaaattataaatcccggccggtgctctacatagcctcaggggcatcatgggatagctcagagggcccttgattctggcagggcaaataaggccagaatgagaaattaccatcttctactaagagaaaaccaagagaaaaatttttatgctaggatgccttaatgaccacttaatttttaaatacttaagtttattgggtctctacccgggtggctaactggctggacagtgggccactctctttttggggggatggagggggcctacataactaagttgggccttaccccatatctttggtccaaacataataccatcttttggcttctccggaactttagatctccataacacatgtacggtagaatggtgagggaaaagcatggatgagaatttatgggcagtccagatggtgtgtccccaccttaggctctttataagtgggttagggtttcctccaaaaagggatttcaccagtgggaattattagtgtaccagggggcccgatactttcttcctctctgcttgtgatcccagcgtaac

SEQ ID NO: 712863 - DNA, 129 bp, Homo sapiens
aaccctgtcttatgctatgtgttgcagccaacgcttatttctttgatttgaaggctgtaattcttacgcgagtctcagtaacttttgcaagagcagccatgacaggtgcccgccatctctctagccaga

SEQ ID NO: 712864 - DNA, 959 bp, Homo sapiens
  misc_feature (27)..(27): n is a, c, g, or t
  misc_feature (245)..(245): n is a, c, g, or t
gagaaagagagatagagctactactancgtaggcgattatactcacgtgcaagggtatatgcttcctattgggctcactacggtctgtcattacgcgcttgttatacccccaccaggggttttctttatagcgccctctcggggggttctctggcgtgtagtcctctcttgcatgtgatcagcgcccctttgggtctatggccctcgttaatgtctttcggaaacgttattaacgtctctccccnttgagacaggattgtctggtcttcgtctagcaccacacgtgctgtctggacgcgaaacccttggggcggcccttcacggacagtatgtagtggacagttgtgcaccatacagagtggtccgcaatcctacaaaggccctcaaatggtagtgtcccaaatggaattggcataacgggagtgacccccaaattcttgggtagatcacccccctggttacgtgggaattgttatctttgtccgccgaaatggagcgtgatacccttttttgaccagcaataatgcggttacaagggggagcaccaactgctcaatgttctcttgttgtattgaatataatggggccacacaaccgccgttggtgaggagacacacattggtgacaacaccatgctgggaaataatggaggaaggaagggcaacaatacacgcgaaaaaggtggtgaagcgttctctggaaagaacacagcagccaatggcgctgtggaagatgtctaacaagtaagaaccacagagaagcgcccccagcggggggcggaaaccaatctaacccggcgcgaccgcgggggggtcaacgtgccctgatacccccgcccccttcgcgggagaccggtgcgcggccgccccggggttctccgcgaggcttcctgggtataagcagaccccgcgcgtcccacaaagcgggaacccttcttttagtaaaaaaaccacataaca

SEQ ID NO: 712865 - DNA, 594 bp, Homo sapiens
gggggccttttcaggcccgaggaccgggctggcacgagggctgcacctgctgaagaaccagcttcgggccctggctgtgctggcccatactcaggcagctggagctcatcgacctcagtcagccatcccttccactgtgactgccagtgtgcttccgctgcccaggtggcttactgggctgaacctgcgggtgggggccactgcgccacccctcccaatgcccgtggacagacgggtgaaggcgtgcagctgcgtgtctcttgagaagactgcccgggcggggctgcagaaaggccaaggggacaccagcctccaggcccaggccaggagaagccctcatcaaaggaacgacagtgtggagcagataaggtggggaaggagaagggtcgtctctgagcacgtgatgcaggctgtgtcctgcgcttgatcccagcccggtggctcttactctgcgaccaggaacaggctccgacgagatcgtgtcctggcacccatgagggtcgtacctccagcaggggcttctggacccctggctgaggggtcgcgtcttagtgggcgggatactttgcccttgaataaaatggattcaaaccc

SEQ ID NO: 712866 - DNA, 356 bp, Homo sapiens
  misc_feature (2)..(2): n is a, c, g, or t
cngcacatatactacactcacaataatacctgtaagggaggtttttcaatctcttctttgtatatatatatattgttttttgagaaggagatttgctcttgctgcccaggctggagtacagtggtgtgatctcggctcactgcaacctctgcctcccgggtccaagcgattctcctgcttcagcctcccaagtggatgggattctgggtgtgcaccaccacacccagctaatttgtgtatttttaggagagggggggtttctccatgttggccagactggcgtagaacttgtgaactccagtgacctgcccaccttggtctcccagagcgctgggattacagttgtgagccaccgc

SEQ ID NO: 712867 - DNA, 307 bp, Homo sapiens
cgagatgaatggctgggagaccccctggcttgtgcacatggccaaaaacagaggggcaaccccccttattgaacgcccctgaagggatacggcggccttattcccctgagcatcttgtattacaggtgtctgtcacgccatctagatacttatcagttggattcttccccaaggaagcaagcatatcatgcaaatcttccttgccgatgaaaccatctctgttctgaccaaccatgttgaaggcctctttgaactccagaggcggtcacacggcacacaaacaaaaaccagtgtgttaaaagggaag

SEQ ID NO: 712868 - DNA, 851 bp, Homo sapiens
  misc_feature (23)..(23): n is a, c, g, or t
  misc_feature (27)..(27): n is a, c, g, or t
  misc_feature (35)..(36): n is a, c, g, or t
  misc_feature (47)..(47): n is a, c, g, or t
  misc_feature (51)..(51): n is a, c, g, or t
  misc_feature (61)..(61): n is a, c, g, or t
  misc_feature (104)..(104): n is a, c, g, or t
  misc_feature (120)..(120): n is a, c, g, or t
  misc_feature (125)..(125): n is a, c, g, or t
  misc_feature (128)..(128): n is a, c, g, or t
  misc_feature (149)..(149): n is a, c, g, or t
  misc_feature (153)..(153): n is a, c, g, or t
  misc_feature (158)..(159): n is a, c, g, or t
  misc_feature (164)..(165): n is a, c, g, or t
  misc_feature (169)..(169): n is a, c, g, or t
  misc_feature (173)..(173): n is a, c, g, or t
  misc_feature (181)..(182): n is a, c, g, or t
  misc_feature (185)..(185): n is a, c, g, or t
  misc_feature (189)..(189): n is a, c, g, or t
  misc_feature (191)..(191): n is a, c, g, or t
  misc_feature (199)..(200): n is a, c, g, or t
  misc_feature (207)..(207): n is a, c, g, or t
  misc_feature (211)..(211): n is a, c, g, or t
  misc_feature (214)..(214): n is a, c, g, or t
  misc_feature (216)..(216): n is a, c, g, or t
  misc_feature (218)..(219): n is a, c, g, or t
  misc_feature (224)..(224): n is a, c, g, or t
  misc_feature (230)..(230): n is a, c, g, or t
  misc_feature (240)..(240): n is a, c, g, or t
  misc_feature (242)..(242): n is a, c, g, or t
  misc_feature (244)..(244): n is a, c, g, or t
  misc_feature (255)..(255): n is a, c, g, or t
  misc_feature (260)..(260): n is a, c, g, or t
  misc_feature (268)..(268): n is a, c, g, or t
  misc_feature (281)..(282): n is a, c, g, or t
  misc_feature (286)..(286): n is a, c, g, or t
  misc_feature (293)..(293): n is a, c, g, or t
  misc_feature (296)..(296): n is a, c, g, or t
  misc_feature (300)..(300): n is a, c, g, or t
  misc_feature (305)..(305): n is a, c, g, or t
  misc_feature (310)..(310): n is a, c, g, or t
  misc_feature (312)..(314): n is a, c, g, or t
  misc_feature (319)..(319): n is a, c, g, or t
  misc_feature (324)..(325): n is a, c, g, or t
  misc_feature (328)..(329): n is a, c, g, or t
  misc_feature (332)..(332): n is a, c, g, or t
  misc_feature (337)..(337): n is a, c, g, or t
  misc_feature (341)..(342): n is a, c, g, or t
  misc_feature (349)..(349): n is a, c, g, or t
  misc_feature (358)..(358): n is a, c, g, or t
  misc_feature (368)..(368): n is a, c, g, or t
  misc_feature (370)..(371): n is a, c, g, or t
  misc_feature (395)..(395): n is a, c, g, or t
  misc_feature (410)..(411): n is a, c, g, or t
  misc_feature (418)..(418): n is a, c, g, or t
  misc_feature (435)..(435): n is a, c, g, or t
  misc_feature (446)..(446): n is a, c, g, or t
  misc_feature (449)..(449): n is a, c, g, or t
  misc_feature (453)..(453): n is a, c, g, or t
  misc_feature (461)..(461): n is a, c, g, or t
  misc_feature (465)..(465): n is a, c, g, or t
  misc_feature (489)..(489): n is a, c, g, or t
  misc_feature (492)..(492): n is a, c, g, or t
  misc_feature (644)..(644): n is a, c, g, or t
  misc_feature (650)..(653): n is a, c, g, or t
  misc_feature (655)..(657): n is a, c, g, or t
  misc_feature (659)..(660): n is a, c, g, or t
  misc_feature (667)..(667): n is a, c, g, or t
  misc_feature (669)..(670): n is a, c, g, or t
  misc_feature (672)..(673): n is a, c, g, or t
  misc_feature (675)..(675): n is a, c, g, or t
  misc_feature (677)..(677): n is a, c, g, or t
  misc_feature (820)..(820): n is a, c, g, or t
gcaacccaagcttccctggagtnggcnccacggannaaacggcaggnggcngaatgcagcngctccaaggcccgggcaggcaaacagtggctgccgcatggganaatggccactcctgtntacangcnaataggcacgcaagcaaacanaaanggcannaaaanngaanaacnaaacgcannaantagnancaactacnnggacaanaccnacnancnnggtcnaaagcnggaaggtggncncnacacgcacggngaagnggcaaaanggcaaagcgtagnnaacnaaaaaanatnctcnaagcncgaanannnctccnaaaannaannaancaacngaannaaacacncccaaaaancaagccttgnanngggcgtaaaaaaacaacaagaacnaaaacaggccaaaannatctccnaaaaaaggcacccaagnacgcagtcacnccnaaantaaaactntctnccatacaacacaaggacacgaacnganccagaaagccaacggtctccacggcttcatgaattggcctcataatctgctaacggtgagctgaggagagagccgacgttctagggcccttctctggagtgaagggtccccatctccaccccctgacagctttgcggtggggtttcccttangacaannnnannntnnaaaaaanannannantntctctgtccgaggtgacggaggagggcgtccgcttccgctccccctacgacggcaatgagaccctgctgagcccggagaaatccgtgcagatccagaatgcgctgggctcggacatcatcatgcagctggacgacgtggttancagtactgtgactgggccacgtgtggaggag

SEQ ID NO: 712869 - DNA, 2421 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcgcctggtcctgtctactagctcaaacaggtttcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtggaaggaaaccgtggcgtccttgcgtggggccaatggttgagacattcaagacttgaaacttaaagtcaaaagcttggaagaaccaagtcggggtctaaggatttaattaaaaccaaaggattaaggttttccaattggactttaagggttggcttcagcgctagcccctgttttgcacagccgagtactggcgagtatgttctatgttgggcctcctgctgcaaaacaataaacagaggacgcagaggtcctcctgcctggccacgcacctctccacagggcggcctggggtctggagatgggcgctgggcccacgggacgcagatggggccacgctctgcccgtggctggcccacgttcctggtctgcagtgctgcctcctccccagcacccctggggcacagagggcagggtcacagctgggaagaggcggggggtagaaaccaaggctggcagaagtgtagccgggctccctgataaatgctggaggaccccagggcaccttgaaaaaaaaaaatctctccccctcacaccacttatctaaaataatcctcaacacccgaattgggttaattggcaattcgcctaaaggggagcgtttaacattcattggccgcggtttaaaacgtgggtctgggaaaacctggtgttccaactttaaccctttgggaaatcccctttctcacatgtggtaaaatcaaaagagcccacctgtcgcttttcaaaagtggcgaccctaatggcaaagaacttggaggggtaatatttttaaaatcggctaaacttgtgttaaaccgttttttttaaacaaggcccaattggaaacctcttaatacaatcctccgaaaggtctgggtttccccttacaacaggtccttataagaagcgcgtcccactagaggcaaacacctttataggcggccctcattgggcacccctcaagaatctttggccccgcggcccaagatttatatacctatagaggccccttataatcttctgtagacccctccttcaacatgccgtactcaagctccctgttctcctcttccatcctcgcctacacacctccgttatatctctactcttgctcacgccct

SEQ ID NO: 712870 - DNA, 1447 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcggctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagacgcgtcaaatcgtaaacctctagg

SEQ ID NO: 712871 - DNA, 1904 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcgcctggtcctgtctactagctcaaacaggtttcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtcctcctgcctggccaaaaaaaaaaaaaaaaaaaaaaaaaaaaacatttttgggggcggcgcttggcgccccgaaaaacttttttaaaaaccttttgtttggggcgccgggggccccatctaaggttagtctgaacaactgggccatagctctggttcccagaggagagacacgtgggcctgaagcataagggcggtgggtgttcctcaccaattaaaaaaaacccgcgggggacaacccagaggctttttgaaccaatcccaggagggattccccgaggggcataaagggggtcttacacaagggattccaaggaagtcgatttcaattaacgcgctcgtgtgagc

SEQ ID NO: 712872 - DNA, 629 bp, Homo sapiens
tccagaggatttatatgcgatggatatgaccctccaaaggtataccacctgtaccagctgagaagaagtatgccatacgggtgctgtctctctttgatggaattcgctacagggctcctggtgctagaaggacttgggatacaggtggaccgatacattgcctcggaaggtgtgtgaggactccatcacggtgggcatggtacggcaccaggggaagatcatagtacgtacggggacttccgcagcgtcaacacagaagcatattcaggagtggggcccaattcgatctggtgattgggggcagtccctggaaatgacctctccaatcgtaaacactgctctgcagggtctctactagggcactggcccgctctactaagagttctaccgcctcctgcatgatcggcgtcccaaaggagggagattgtcgccccttcttctggctctttgcgaatttggtggccttgggcgttagtgacaagagggacatctcgcggattctcgagtccaaccctttgatgatagatgccaaagaagtgtcagctgcacacaggccccgctactaatgaggaaccttatcggtattaaaccgccgttggatccatggtattataacctgagtgcatgat

SEQ ID NO: 712873 - DNA, 2012 bp, Homo sapiens
  misc_feature (122)..(122): n is a, c, g, or t
  misc_feature (1490)..(1490): n is a, c, g, or t
  misc_feature (2012)..(2012): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcgcctggtcctgtctactagctcaaacaggtttcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaaaaaaaaaaaaaaaaaaaaaaaaaaaaaaaaaaaaaaaaaaaaaaggggggngcgcgcgcgcccccctttaattttcccctgtgtggcccccaatttttagcatctcatccccagttttttttgctcacaggggggccccctatataagggggggtcgtatttaaacaacatagacaacatgaggcccgaggtttaacacctcctttctttgtgtgggaaacatctcgtactactcttagtcgaacactttgtggagaaagggaagcccttatatcacctcggtgagggggggggacgaaacaatattttggtggagagaagaattcaccctacaagaagacgaatttttaaagaggccatcattaggggggataattatattacaaatttttattacagcgttgtgttattatttgtgggtttttacaccactcgacacgcctgagtaaatttattttgggaggtagtcttaaaagagaattttgttgtcgatcactcgagagatattagatcttagttactagagacttttttttatatcaccgggggagattatttttttataaaaagggn

SEQ ID NO: 712874 - DNA, 1858 bp, Homo sapiens
  misc_feature (122)..(122): n is a, c, g, or t
  misc_feature (1576)..(1576): n is a, c, g, or t
  misc_feature (1579)..(1579): n is a, c, g, or t
  misc_feature (1653)..(1653): n is a, c, g, or t
  misc_feature (1686)..(1686): n is a, c, g, or t
  misc_feature (1691)..(1691): n is a, c, g, or t
  misc_feature (1695)..(1695): n is a, c, g, or t
  misc_feature (1698)..(1698): n is a, c, g, or t
  misc_feature (1700)..(1700): n is a, c, g, or t
  misc_feature (1717)..(1719): n is a, c, g, or t
  misc_feature (1722)..(1722): n is a, c, g, or t
  misc_feature (1729)..(1729): n is a, c, g, or t
  misc_feature (1734)..(1734): n is a, c, g, or t
  misc_feature (1739)..(1740): n is a, c, g, or t
  misc_feature (1746)..(1748): n is a, c, g, or t
  misc_feature (1752)..(1752): n is a, c, g, or t
  misc_feature (1754)..(1754): n is a, c, g, or t
  misc_feature (1760)..(1760): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcgcctggtcctgtctactagctcaaacaggtttcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaaaaaaaaaaaaaaaaaaaaaaaaaaaaaaaaaaaaaaaaaaaaaaaaaccccggattaaaaaaaaaaaaaaaaaaaaaaaatccttgtggggccgcttgggcccattcaattttaaatttgaccaatcttttgcntgnggccgaatttggggttaattgggccaattccccttatggggggcggattaacaattaatgggccggggtttaanaacgtgcggactgggaaaaccctggggttcccnaattnaatngcntngaaaaaatccccttttnnncanttggggnaatancaaannggcccnnncggntngccttnccaaaattttcccaccctgaagggcaatggaaatttaagcctaattttttggtaaaaaccgggtaaatttttttaaactttttttttaccggcctggc

SEQ ID NO: 712875 - DNA, 190 bp, Homo sapiens
gaatgaacctgccatgattgtcccagaaagataaaatatgccagcatattgcagactacccatccttctgcatataataactagaatactaacagaggccaagctaagacccaaaccagacagctactaagacagctaaagagccccctctattagcaaatagtcgcagtttataggagagcccaaccag

SEQ ID NO: 712876 - DNA, 204 bp, Homo sapiens
gatcggtcttcctcgtgcagatggggcatccagtggcccgggtgggggagggtccagttcctctcagtcagtgggaagaagtgccccgggcagtcgatgtccgggtggctggtgggaagccacacggatcccttcatggagggaatatgtcaatggccaacagagctcgtccaacagaacggcgctacaggcacgtgtgtccaa

SEQ ID NO: 712877 - DNA, 1570 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcggctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttcttcagcgctagcccctgttttgcacagccgagtactggcgagtatgttctatgttgggcctcctgctgcaaaacaataaacagaggacgcaga

SEQ ID NO: 712878 - DNA, 1357 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttgggaggaagatcttcagagatgagggaggccttcttcaagggtgcgtggtccaacgtcctgcggggcatggggggcgccttcgcctggtcctgtctactagctcaaacaggtttcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccggactgtgagtcgtcgactgggtgtcctctagagtcaacactcaggaacagcgtg

SEQ ID NO: 712879 - DNA, 314 bp, Homo sapiens
gaggcatatataaacaagttgcctgtacttactatgtatgtcagatacacagatacattgtgttacagttgcctacagtatcagtacagtaacgttgccttcaagttaaaagcacaaggttacttacaccatatagcctaggtgtggaggaggctccaccacctgttttttaggtccatgtaggtacacatggtgttcacaggaaaaactggcttgaacaggcatttctcagaacacattcctgtggttaagccatggtttgactattatttcaaaattcgaaaaaccccccaggttggaaaaaatctgggtct

SEQ ID NO: 712880 - DNA, 1381 bp, Homo sapiens
  misc_feature (122)..(122): n is a, c, g, or t
  misc_feature (1170)..(1170): n is a, c, g, or t
  misc_feature (1236)..(1236): n is a, c, g, or t
  misc_feature (1240)..(1240): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggctcctccaacacaacacacaccagggaanccaagagaacccgtagaatctccaacgtgggacatcaacctcgagaaatccaggtgctttccccancgancgctgtaaaggcgggaggctcaaaagggcttggtccccacggcccggccggttgacacggggagggaacgggccgggcccggccaccagagcacaacagttgggacgcggtttttaaaaaaagggcgaacgggggcacgta

SEQ ID NO: 712881 - DNA, 2059 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgtaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaacaaccgggtggggcgcgcgcgcgcgcgcgcggcgcccgcagaaagagctttacaaacaccccgcgggtggggcgcgcgcgcggggcgccaaaggagagaaagaagaaagtgtggaaaagagggtgtacccataggagaacaccgggggaaataaaataaggggggggagggtatccccacacaaattaaaaaacgccgggggggagaaacacgagagggtggtcttagggagaaaaacacccagaggagggaggccacgggaggagcacaaaaggaggggcacataacacaggggggagcaccaaaggaggccccaaagacaacaaaaaaaaaggcccgcgggtgcgagggggggggaggaaccgacgcacgcagcgcaacaaagcgcagcacaacccataccacaaaacaccacacaacaaccacacgaacaagaagggcacgaaacacaagcaaaagaccagacaccaagcgcgaaccgtacg

SEQ ID NO: 712882 - DNA, 2786 bp, Homo sapiens
  misc_feature (122)..(122): n is a, c, g, or t
  misc_feature (2584)..(2584): n is a, c, g, or t
  misc_feature (2605)..(2605): n is a, c, g, or t
  misc_feature (2608)..(2608): n is a, c, g, or t
  misc_feature (2610)..(2610): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgtaggaagatcttcagagatgaggggggcaaggccttcttcaagggtgcgtggtccaacgtcctgcggggcatggggggcgccttcggctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttacttcagcgctagcccctgttttgcacagccgagtactggcgagtatgttctatgttgggcctcctgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtcctcctgcctggccacgcacctctccacagggcggcctggggtctggagatgggcgctgggcccacgggacgcagatggggccacgctctgcccgtggctggcccacgttcctggtctgcagtgctgcctcctccccagcacccctggggcacagagggcagggtcacagctgggaagaggcggggggtagaaaccaaggctggcagaagtgtagccgggctccctgataaatgctggaggaccccagggcacctgcacttactgtaccctctctgagagcatttgtatgatctcatgtctcagctctggaggctggaggtcccagaaaaccaaggtatggtagattcagtctctggtgagtacccagttcctggcttctagatggcgccttctccctgtgtgtcctcagatgatggatgaggccagggtgctctctggagtcctttctgtaagggcactgatcccatccatgaggcctcatgactcccaaagacccccactttccaacgccatcacttgggagaggggcgttttcagcgtgaatcttggggaanctgaaacagggtgacacctgngtncntctcactctgtagctcccgaaggccactccagcccccattccaacatgaacagtggaagtggtcggggtccccaaattggcagctgtggttccccggggttcacccgtgagaaatccaccccaagggggtcccccccgcgagggaccaaaagcttccttcaagcttttttttggtc

SEQ ID NO: 712883 - DNA, 159 bp, Homo sapiens
cattgtcacccaggctgtagtacagtggcacaatcacagctcactgcggccttgattcctgggcccaagcaatcctcccacctcagcctcccaagaagtgctgggattacagacaggaacctctctgcctggctgggtttcttttattgggtaccgagc

SEQ ID NO: 712884 - DNA, 383 bp, Homo sapiens
aattgattattaggatatattcccctgaaggattctttttttaaaaaaatgtgaaatgtcatcttggacttacccctttcatgaaaagggatttcctgcttttgtactgcatgggtggcagttgtgaggaaaagcccgtccaatgaccttttttcaaaagaaatgcagtggtcccttcagttgagagtggctttttaataccccaaggtcccctagaagaattccactgtttcaagaatcaagggacccccatatatctcgccattcccaactttgtttgaggggctcgttatcccgctcttgggagccccccctgccatgtaaaatggaagaaaatgcaaagaaacccaatgtgccgagtgaataaagggttgtcatttcca

SEQ ID NO: 712885 - DNA, 355 bp, Homo sapiens
gtgcaggctctctagcggggaggcggggagggaagctctctttcttctgggaggggacaaagcttcaggcagggagctgccagcggagcggggcatggaatcgggggacctcatggaggtctggggctgacaccccactcccggttggacggcccagccgggactgggggagaatgactttccctttgttggccccagtaggggctagcataagcggaggtagaacttatctttaagcggcagcaaaatcagggagtgactttggtcccctctcgtgtggaccctggtaaagagccgtaaaccactgggtgacgtaggtgggtgtggttgcccggggtggcctgtggctccgccc

SEQ ID NO: 712886 - DNA, 377 bp, Homo sapiens
cagaagactttataacaatactcactgcacaaaattgttaaagggtggggttatgctgtgatattatttttcctcatataatgtcccacttgtactgttctagaactccttacagtttccacggtaaatttgttttcaaaatgccgaattgtgaaactcttgctgggcttcacgtttcttattatcctttcatagtttctctgtgttgctgtttgtaagtttccttgtgatgacacattctatcatctaagaaacccaggttatccctgttttcaatgcgatccgtaatcaccttgtgctcattaatcacattggactgatgcatatcggttccagccttgatgttcgtctgtatctccagtaggtttctgggtggc

SEQ ID NO: 712887 - DNA, 481 bp, Homo sapiens
atatccactatactttaatttaatctcgaaacagactaaatataaaagattttagctttaaataagcccttagacctcgtgattgctcaaaccttttcatattcaaatggcctgacagagagcaaagaagtctcacctcagtgataataagatgctcagaatgtgtttgctgtaattgcataacacaatgcactgtgttgtaaaaccttctcaagaaaccagatataattatatttaatacatactattttaatataatataattacattaggaataaacaataatgtacattatattataatcgccaatcatggcactaaagactagagatgaaacattcactttgaggaggtttgctttctttatgcttaatgaaaacactgacagaactactatagaataactgattgtaaaccaataaaatcctcgctgaaaaacaccacctacaattaaaatttgatcagagagttaaactcacca

SEQ ID NO: 712888 - DNA, 120 bp, Homo sapiens
  misc_feature (49)..(49): n is a, c, g, or t
gggcttccagctccccatcctttttgttccctcccacacacctgaccgntgttttcctccagcatccccttttgatgggttcttccaccttttcccaggattctcctcatccaaacccac

SEQ ID NO: 712889 - DNA, 201 bp, Homo sapiens
acgactcgagccggtaccataaatgcaggagaaatgcttatgtatccagccggacaaacgggctctgatgttgttagaatggggcatgcacatatatgggtttacgctgttcctcttccatctctcattgtggcagatatcactaatcaatgatggcactcatttctagcaagtccatgaggcctcaaaatcttgtcaaaa

SEQ ID NO: 712890 - DNA, 901 bp, Homo sapiens
gcgaacaaggatgctcctgtccctcctacagctgtaagccacagcgaaggctttaagagagccatactgaaggcacgctgttgaacaggtgtccactgccatcctccagaagaagatccgcgagcgtcacccaccttccggcggtcgagagacactgcgactccggagacagcccaaagtatcctcggtaacgagctgcgtcccaggagaaacaagcttgaccactatgctatcatctagtttccgctgaccacgtgagtctgccatgaagaagatagaagacaactagacacgacttgctgattacacttgtgtgcatgtctagagagccaatcataccaccacattaaactggctgtcaagaagctgtatgacattgatgttggccaaggttgcaacgaccctgattcgcgcactgatggagaagcaatgaacgggatatgttcgactggctcctgattgacgatgcctctcgtgactgttggccataccaagaattgcgatcatctatagactgagtccagctgcctaattctgagatatatatatatgtatctatctatacagcttgatccaggcaccttttggatcttcatgccctgtgttctgcccgctacggacccccatctctgtgacttcctgggagactcacttcctagcatgaggcaagtgaagcttgatcaagaagatgggtgaccaccgtgaccactctccagaggctgagtgagccggaaggctgcgcttgaacgaggtatctcattaccacagggcatcactctccagcacgactaagagccttcttgagcccatctgacttctgaaggggcccctttgcaagtacatagggcctcatgcctaagcctacctccctccagacaataagcaagcttcttcactaacc

SEQ ID NO: 712891 - DNA, 760 bp, Homo sapiens
  misc_feature (2)..(2): n is a, c, g, or t
  misc_feature (40)..(41): n is a, c, g, or t
  misc_feature (561)..(561): n is a, c, g, or t
anttaagaaagcggggtctaatatatagtgtatacattcnnagttttctttttttcttttataggtaagcataaactcccatgggggcagaaaatattactgaaaattctttgtatgtgtgtctgtgcttcaatacaatttggttgggctggggtttttttgtttgtgggggtttttaacatgaatacatgaggtgtgatatctgggcttcacgtgtaacagtatgagctcagcagtgactggtagagggagtgctgtttcttctaccatgtgtcttccccagagtccagttaatactccttgtatagtgctcaggagtggcctatcggtctgctttccctacctgtgtccctttcatctctctccagtgctctccctgaagggaagagtatgaattgtgaccctgggctcagataaaggaactgccccacgaacttaaggtctatgcccaattatcatcttttcaccccttccctagagacaaacacattgtcatgatctagactataaaatcaacaatggaagactgataatccatttattctttttttctttttgggntaaaggatttggatcagatgtaagaccaaacatgtaatattttgtatcatcaaatgcagccaagggcagtggttacttctgaatcccaacactttggaggccaaggaaacgttcacctggagtcagagtttagaccagctggcaactggtgaacccctttttcttgatctgttacccgtgtggtggcctgccttgggcc

SEQ ID NO: 712892 - DNA, 183 bp, Homo sapiens
cctccgctactcagtgaggcaaggcaggcagattgctcaggtcgagagttcaatgaccagcctggccaacatggagaaaccccgtctctactaaaaacacaaaattagccgggcattgtggcacgtgctgtactcccagctactagggaggctgaggcaggagaatctcttgaaaccggaagg

SEQ ID NO: 712893 - DNA, 1395 bp, Homo sapiens
  misc_feature (87)..(87): n is a, c, g, or t
ggagttcctccttgctctcgcccctactctttctggtgttagatcgagcaaccctctaaacagcagtttagagtggtcaaaaacaanacaaaaaacaaaccaaaacggctcgcgaagccaacaaaagggcatgaaattttcttacggggaaatcctcctggttatcccgttaacggatcgtccggatcccttaagaagctcctttcgggagaaagctttttagatctccttaaagagggacgaacactcgatgatcaccgcgggaagaacaagcgcgcggatggaataaagcgaggatcgctggcggcgatgagacgtaggagagacgagctggagcttggcgcttaatgaatttggggcgtagaagcgtataaacaacgcacaagatggggttaacctcctgggggatattacactcacggcactgggaactaggcgacgcagaacacagggctcgcccaaatgggcaacgggggacctggtggttcgccaacggtccccaattagccctttgggcgggtaaagacacgtgcgcgaggcacacacggcgcaaggcatcatttgcaaccaggctctgcgcaaaacgcaacggcgtcgaacgcgccagacacatttggggcagcactaggtaagaaggtgaacgtctcacaaggtcaacaattcgacatgcggcgcgcgaggttaaagtactcagtgaaacacattcacaggacaatctacggttctgcgggcctacaacgcgcaagaggacaagcccttccaaggcattgcggcaacaagcaagctttttgcgcaagtctcgaacatgggtccacctctgggcacaccacatttctgtcgggagcacttacacaaacaaggggggacctcctaagcagtcacccctcgaggacaaagtgcaagctacactcgcgacaataacacgcacatgaggggcacagaagttcgggtagacacgagggcggagcataaccgtcgaaccagccagggaacacaattggtcataccggaggaccccactgctgtgcataaacagcaggcggcaggacatacaccagtggatgaccaacacagcagccacggctatcagggacaggggcgccagccggaggaaatctagacaatcagaaaacacacgttgttagcgacacgccaacgtgaccacacgtgcggtgcttagcaccagtatgaccaaacagaacataacactgtgaggcaggcctcacaaaagcacgccaaaagacagagtgacgactggggccgtccactaagattagacgggggaacacagcaccggggggcttagccgaaccgaacaaagaatcacacgatgtcagaccagatgtggaggcaccccacctgcggggaaacccgcggagggacacccgtggacaa

SEQ ID NO: 712894 - DNA, 642 bp, Homo sapiens
  misc_feature (71)..(71): n is a, c, g, or t
  misc_feature (358)..(358): n is a, c, g, or t
  misc_feature (370)..(370): n is a, c, g, or t
  misc_feature (400)..(400): n is a, c, g, or t
  misc_feature (409)..(409): n is a, c, g, or t
tgtggtagggttagaacttctgggagtacccattacattataacggtaatgaggaagccacgtttctggtnggagacgtgcctagagcagtggatctcaaactgtaacatgcttccaaatcactgaggctcccctattaaaccacaggtcactgggctgcattctgtgggtccagggctgggcctcggaatctgcatcttgacaagttcctgcatgctattgctggccagggaccacacattgccttagaaggtgcctaccagaggcttaactgggtgacctgcttcgactgttcaaaggggcatgccatgaactttagcattcactgtttaaacactgaacaaaaaccaggccccanacaactgaagantttttcattaaaaatgaagcttaggcttgnatccaaccnaagtaagcattttatttcctaaagttattttttagtccttgcaagtcatttttttaagaacaaaaatgcaaagacaattttttaaaagtgcgaacttagtctttgaagtgtaagaatgacttttgagaaaagtcatgtcaaatgtaaagtaacacaaatcaaactaagcctaagaaataatcaacttcacaataattaagagtagagaagcagaggaaatcaaaaaaaaaaaa

SEQ ID NO: 712895 - DNA, 151 bp, Homo sapiens
caggagcaggatcccagagtgaagtgagagcccagtgatctagatggcttctatcttcataagtcattgattcatcatgtgtagcctgagtgtagcgtagccagaacatcagcagagccctcaaatgttgcctcagattaaagtaaaggtt

SEQ ID NO: 712896 - DNA, 185 bp, Homo sapiens
ctcgtataggatcctcattttaagccgattaatatgattgtcgaacatgtactctagggcgatacgttgggatccaagctgtaccctgagtaattgggagcaaatcatttaattaagcctcctatgatagccaatacagttcctattgatgcgacatagtgtaagtcagctacaacgtattacgt

SEQ ID NO: 712897 - DNA, 362 bp, Homo sapiens
tatattatgaagtcttttaacagtctctctatatataaatacacagagtttggtatgatatttaaatacatcatctggccaggcatggtggctaacgcctgaaatcctagcactttgggaggccgagacgggcggatcacctgaggtgaggagttcaagaacagcctgcccaacatagtaaaactccgtctctaccaatatacaaaaattagccgggcatgatggtggtggcctgtaatcccagctacttgggaagctgaaacagaagaatcgcttgaacccaggagacggtggttacagtgagcaaagatcgagccactgcactccagcctgggcagctgaacaagactccgtctcaaaaa

SEQ ID NO: 712898 - DNA, 205 bp, Homo sapiens
taatcgagctcggtccaggtgtgtcgtctggtgtcagaggagtcaacttctcccatgattcagacaagtatgttagtacctaggtgggcagtgaaacctcctggaaatgtgatttctgtgattcagtacaccaactcactgagccgatccaattcatttgaaaggtctgagtcagtcgaacttgtggcttgcacacaggataaag

SEQ ID NO: 712899 - DNA, 281 bp, Homo sapiens
aggttaacaagcacagtgaaacgaagatccgtaatggtgaaggcaattacccgaagaccgatgtatgtcaaccgcagcacagggcgttgatcgagtccgatttcactgaaaaagtgtctgcccgtcgccaggcgtttggttcagcgcgggatcgccaagtgctttctatcagaagcatggtcgcaggcgggacaaatgccgccacgtccgccttcgtcttgcgctatgagccccagtgcatcgcgcggcacgatcctctattcggtgaagggttataaaaa

SEQ ID NO: 712900 - DNA, 501 bp, Homo sapiens
  misc_feature (44)..(44): n is a, c, g, or t
  misc_feature (142)..(142): n is a, c, g, or t
  misc_feature (350)..(350): n is a, c, g, or t
  misc_feature (393)..(393): n is a, c, g, or t
  misc_feature (485)..(485): n is a, c, g, or t
  misc_feature (487)..(487): n is a, c, g, or t
gcctgaatagccaatacaatattaaagaaaaacaaagggagaangcagacagacttgaagacagtatagctgggtgcagtggctcatgcctgtaatcccagcactttgggaagctgaggcaggaggttcgcttgagcccagnagtttaaggccagcctgggcaacacagtgagacctcatctctccaaaaaaaaaattagccaggtgtggtggtgcacacctgtagtcacagctactccgaggctgagacaggaggattgcctgagcccaagagattgaggctgcagtgagccatgatcaagttactgcactcaagcttgggcaacagaattagaccttgcctaaaaaangaaaaaaaaatagtatatgttccaatatatcaagacagtgtantattgaagccaaggcgagtgaatcacttggggtcagttagtttgagaccagcctggccaacatggtgaaaccctgtttctactaaaaatatnanaatcagctgggcgt

SEQ ID NO: 712901 - DNA, 522 bp, Homo sapiens
  misc_feature (4)..(4): n is a, c, g, or t
ctgntctgggcttagacggctgtcttgcgggttctgtggtgcctgggttctttctggaggcgccttagacagtgtgtcttgcgggttctgtggtacctgggttctgtctgggcaccttagacggctgtcttgcaggttctgtggtacctgggttctgtctgggcgccttagacggctgtcttcagggttctgtggtacctgggttctgtctgtgtgccttagacggctgtcttgtgggttctgtggtgcctgggttctgtctgggcaccttagacgactgtcttcagggttctgtggtacctcgcttctgtctgggcgccttagacggctgtcttcagggttctgtggtacctgggttctgtctgggcaccttagacggctgtcttcagggttctgtggtacctgggttctgtctgggggcaccttagatagctgtctccagggttctgtggtgcctgggttctgtctgggcgccttagacggctgtctatgtgggttctgtggtacctgggtcctgtctgg

SEQ ID NO: 712902 - DNA, 366 bp, Homo sapiens
  misc_feature (44)..(44): n is a, c, g, or t
cctgcctcagcctcccagattgctgggattacaggcgtgagcanccatgcccagcctaaattgtctgatttagtctgtgctcagcttgtttttcccaactgttgttgggaaaacatgttcccaacatgttgggaaggcatgttcatgataatatactgttgatattttaatttttaagttaaattcctataaataaatatgagaaatttgttaggatatttaaagcatcttctaacctttaaaaatatgtgcttttaaaaattattaggttgtagaattgggaaaaaatgcaatttgtcttatctttttctattagcatgtttccagtgtacagttcattcaaagggggggtagtgtggcaaaaca

SEQ ID NO: 712903 - DNA, 294 bp, Homo sapiens
  misc_feature (6)..(6): n is a, c, g, or t
tggggnggactctagagaatcccggacaaacggcaccacatggcagccaggacaatcgctcattctgcattgggagtctgcaagaagactctgggttcccttctttgacagagctgaggcagtaaaagcaaaagcagatgagtggcccaaaactgctccaaagaaagatgagaacagctcatgacctcatgccactgaagacagggacggagagagtgataattcagaccgtgttcctgtgcccagttctcaaaattacttcagccaagctatagaagcagccttcatgaaact

SEQ ID NO: 712904 - DNA, 94 bp, Homo sapiens
ggatttgctggtgcagtacaactaggcttaatagggacatgtcgcccacaattttaactaggaaaatataagtgccatttataaggaaaaaaaa

SEQ ID NO: 712905 - DNA, 522 bp, Homo sapiens
  misc_feature (35)..(35): n is a, c, g, or t
  misc_feature (46)..(46): n is a, c, g, or t
  misc_feature (174)..(174): n is a, c, g, or t
  misc_feature (213)..(213): n is a, c, g, or t
  misc_feature (223)..(223): n is a, c, g, or t
  misc_feature (288)..(288): n is a, c, g, or t
  misc_feature (309)..(309): n is a, c, g, or t
  misc_feature (358)..(358): n is a, c, g, or t
  misc_feature (475)..(475): n is a, c, g, or t
  misc_feature (490)..(490): n is a, c, g, or t
  misc_feature (500)..(500): n is a, c, g, or t
cgatcttatcccacagagtaacggacgcgccaagnctgtctacaanctgaggagctgagaagccagtggtgaatcactcttagtcccaaaacctccaaagtagggaagccgaccgtgaagcctccggtctgtgaccaaaggcccgagagcccctggaaaatcactggtgtaagnacaagagtccaaaagttggttaacttggagtctgatgtncgagggaagnaagcatccagcacgggagaaagatggaggccacaagactcagcaagtctgctttattctagctgnactggcaatggattagatagnccccacccacactgagggtgggtctgcttcacccagtccactgactcanatgttaatctccttggacaacacctttacagacacgcccagggacaatactttgcatccttcaatccaatctggttgacacttaatattaccatcagagggtggtcttggtgttgtngtcctgagcttgtgnaagtgggtgnctgtcacttcctgggccattct

SEQ ID NO: 712906 - DNA, 1166 bp, Homo sapiens
tgtggcagaaactggccttccatctctctcagacaccaagcttgcagatccaggcttttcttgggcacacagtgaggccacccatggctctggcagcaagtctcttgtcctggctccttctgcttgtcctggatacttgctcggttgctgtggcatggagtccacgccgtatcccatgtggcaacggcaatccctgtgtgccacaacgaaacttcccaggctgcgcacagccatactgcgaactccagaccaggttccgcccacagccaggccagcctccgcaacgcgtcactggctcacaacccaagacatgcacttgcaagggcagccctgcgcaaatcaattagcacccaccaaggcgggccagaggatggccccacagagacaccccaacggcttgacacgccagcgcctatgatacatggataggcccaacaggacaggccacccccgtattagtgcttaaggaacttctggttcccacagtggacactttggttaccgtatggctttatccacaagtgtgaccaaccaactcgagagtccaacccccctgtgcgcgcacaacggaacaacgacggagggacccccaacgaggcgcacacaacaggttcggccttcaccacaacaagcaaaatgcgcagaccaccataacacgaacagagccccattatgggcccacaccaagttacccagcccaagacgcaaccacttaggggacgccgcggggccgcagaatgtaaaaagcagaccaacaacaaccgggcgggcaacgtcacctccaagggacccgctgtaaacacgcccaccccgcaaaccaccgccgctcgtggagctgggcccgcatgatttaccaccccacggatgagacaaacgcgcccaaagagcccgacccaccggcgacaccacccgtgtaccaccgcatacccgtacacccacaagcccaaacctgttgcgccacgcatccgaggacccttggggccaccgccccactgatgcctgctgccaccacaccagcgatacgcgtaaaggtagcaccgcccacatgacttatccgtttgtcactagtgcccgcccgacactgccgaattagccccaacacgccatttgtgttcgctagtgatacacattccccaccacataatcaccagcgtggatactacctc

SEQ ID NO: 712907 - DNA, 487 bp, Homo sapiens
tagaggatccccgtaagcagcgcagccacatcaataaagaagaagataggaagcgagtttccagtatgagtgccggcgtgggggagctgggggtgagatttagtcttgtgtgtggaggtacggagtgagtgatccctcgagtcttattattcggtccgcctcggagtggtgggttgggttggatcgggggccagtggtttcgtggatgcgcgagtaaggggggtagcgtccagtttggaattttaggcgagttaaccgagttggcaggtcgaggcgatgagtggggagtgtccaggatgggttggatgggggattgctgtgaggtcggctatggtgtacctggtttaaggtagccgaggaaggttgatgtggtatttcgaaggtgggggagaggagtcgttgcgggtgggaagctgtagggatggaggtagtgtggaccggtcgagttataagggtttgctggcattgatgtgggttggcttgtaag

SEQ ID NO: 712908 - DNA, 124 bp, Homo sapiens
  misc_feature (47)..(47): n is a, c, g, or t
  misc_feature (86)..(86): n is a, c, g, or t
tgaatttcccccccgggtgggggtctttggccgaaggcgcaaaattnttcctgtgggcaaactggcaaagtccgtggcaaggtttntttttatagtatagtagtaatagtaataatgatatgat

SEQ ID NO: 712909 - DNA, 229 bp, Homo sapiens
  misc_feature (9)..(9): n is a, c, g, or t
  misc_feature (71)..(71): n is a, c, g, or t
aaggcccantaacccggaaggggaaaaacccaagatggttttcaccaagatccgagcccaggtaatcctcntaggtagctcttcattatttttttcatcctggttaagtatgtatgtatgtattttatttatttatttatttaatttttgagacagggtctcactctgtcacccagactggaatgcagcggtgcaatttcagctcactgcaacctccacctaccaggtc

SEQ ID NO: 712910 - DNA, 160 bp, Homo sapiens
agtcagtcagcttttatacccggaggatgggcagctaactctataccccattcacagagagataccgagactatggcccagaaagccctgcacctcaattcctgaatgctgccatcaatgatcagtgtcattgttgtcatggctatcctcctggtgggtc

SEQ ID NO: 712911 - DNA, 2772 bp, Homo sapiens
  misc_feature (122)..(122): n is a, c, g, or t
  misc_feature (977)..(977): n is a, c, g, or t
  misc_feature (992)..(992): n is a, c, g, or t
  misc_feature (1003)..(1003): n is a, c, g, or t
  misc_feature (1005)..(1005): n is a, c, g, or t
  misc_feature (1023)..(1023): n is a, c, g, or t
  misc_feature (1028)..(1028): n is a, c, g, or t
  misc_feature (1034)..(1035): n is a, c, g, or t
  misc_feature (1039)..(1039): n is a, c, g, or t
  misc_feature (1041)..(1042): n is a, c, g, or t
  misc_feature (1045)..(1048): n is a, c, g, or t
  misc_feature (1067)..(1068): n is a, c, g, or t
  misc_feature (1070)..(1070): n is a, c, g, or t
  misc_feature (1075)..(1075): n is a, c, g, or t
  misc_feature (1087)..(1087): n is a, c, g, or t
  misc_feature (1090)..(1090): n is a, c, g, or t
  misc_feature (1094)..(1094): n is a, c, g, or t
  misc_feature (1097)..(1097): n is a, c, g, or t
  misc_feature (1100)..(1100): n is a, c, g, or t
  misc_feature (1102)..(1105): n is a, c, g, or t
  misc_feature (1107)..(1108): n is a, c, g, or t
  misc_feature (2570)..(2570): n is a, c, g, or t
  misc_feature (2591)..(2591): n is a, c, g, or t
  misc_feature (2594)..(2594): n is a, c, g, or t
  misc_feature (2596)..(2596): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctnacatcatgtacacgngcaccctcaantnttgaaaaaaaataaaaanaaatnaccccnnaaancnnggnnnnaacccgcccgccgccaacnncnccccnccagcccccccnccntccnccnggncnnnnannaacacggaaaaaaagtgtcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttacttcagcgctagcccctgttttgcacagccgagtactggcgagtatgttctatgttgggcctcctgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtcctcctgcctggccacgcacctctccacagggcggcctggggtctggagatgggcgctgggcccacgggacgcagatggggccacgctctgcccgtggctggcccacgttcctggtctgcagtgctgcctcctccccagcacccctggggcacagagggcagggtcacagctgggaagaggcggggggtagaaaccaaggctggcagaagtgtagccgggctccctgataaatgctggaggaccccagggcacctgcacttactgtaccctctctgagagcatttgtatgatctcatgtctcagctctggaggctggaggtcccagaaaaccaaggtatggtagattcagtctctggtgagtacccagttcctggcttctagatggcgccttctccctgtgtgtcctcagatgatggatgaggccagggtgctctctggagtcctttctgtaagggcactgatcccatccatgaggcctcatgactcccaaagacccccactttccaacgccatcacttgggagaggggcgttttcagcgtgaatcttggggaanctgaaacagggtgacacctgngtncntctcactctgtagctcccgaaggccactccagcccccattccaacatgaacagtggaagtggtcggggtccccaaattggcagctgtggttccccggggttcacccgtgagaaatccaccccaagggggtcccccccgcgagggaccaaaagcttccttcaagcttttttttggtc

SEQ ID NO: 712912 - DNA, 2334 bp, Homo sapiens
  misc_feature (122)..(122): n is a, c, g, or t
  misc_feature (2132)..(2132): n is a, c, g, or t
  misc_feature (2153)..(2153): n is a, c, g, or t
  misc_feature (2156)..(2156): n is a, c, g, or t
  misc_feature (2158)..(2158): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcggctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttcttcagcgctagcccctgttttgcacagccgagtactggcgagtatgttctatgttgggcctcctgctgcaaaacaataaacagaggacgcagaggtcctcctgcctggccacgcacctctccacagggcggcctggggtctggagatgggcgctgggcccacgggacgcagatggggccacgctctgcccgtggctggcccacgttcctggtctgcagtgctgcctcctccccagcacccctggggcacagagggcagggtcacagctgggaagaggcggggggtagaaaccaaggctggcagaagtgtagccgggctccctgataaatgctggaggaccccagggcacctgcacttactgtaccctctctgagagcatttgtatgatctcatgtctcagctctggaggctggaggtcccagaaaaccaaggtatggtagattcagtctctggtgagtacccagttcctggcttctagatggcgccttctccctgtgtgtcctcagatgatggatgaggccagggtgctctctggagtcctttctgtaagggcactgatcccatccatgaggcctcatgactcccaaagacccccactttccaacgccatcacttgggagaggggcgttttcagcgtgaatcttggggaanctgaaacagggtgacacctgngtncntctcactctgtagctcccgaaggccactccagcccccattccaacatgaacagtggaagtggtcggggtccccaaattggcagctgtggttccccggggttcacccgtgagaaatccaccccaagggggtcccccccgcgagggaccaaaagcttccttcaagcttttttttggtc

SEQ ID NO: 712913 - DNA, 140 bp, Homo sapiens
ctttgacgcgtacggtcaagtactctaagtaccatgtgaagtttaagaattctcaaatatttaagataaaacaagtatgtgacaaggataacgatatgaataaaactaattcaaaatatatactggaggaaaataattca

SEQ ID NO: 712914 - DNA, 1373 bp, Homo sapiens
  misc_feature (122)..(122): n is a, c, g, or t
  misc_feature (1353)..(1353): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcggctggtcctgtacgacgagctcaagaaggtgatctaagggccgcggccctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacgaagggggatgacanaggatcctgctagagccagc

SEQ ID NO: 712915 - DNA, 157 bp, Homo sapiens; identical to SEQ ID NO: 480870

SEQ ID NO: 712916 - DNA, 177 bp, Homo sapiens
  misc_feature (13)..(13): n is a, c, g, or t
  misc_feature (71)..(71): n is a, c, g, or t
  misc_feature (154)..(154): n is a, c, g, or t
  misc_feature (158)..(158): n is a, c, g, or t
gccgggaacagtntggagagcttggctacatccatcctcctcaggcaggagcaggcttcctgagagagtcnaggtcgtacgagttttacgacttaggcgggctgcagattccttcctgggtgtttggtttaagccttgggtccagccctctctnagtnttccgggagttcgtgggtt

SEQ ID NO: 712917 - DNA, 699 bp, Homo sapiens
  misc_feature (306)..(306): n is a, c, g, or t
agaaataatttttttaaagaaaaggaaaagccttttaaaaaaacactcgaagaaaaggtttccaaggggacaaggtacctcgtaaagggggccaaaataaggcgtaacgcatgttaaaaccaaccacgaaaaaagctcccaaggtgggccggttaaggaataactggggaaacccacggcttttttcttcggccctcccaagcacaatccttccaaggtccactgtaatcacctccaaagcgtgaccctgtgcctgacaatgtagtcagatcctgttcaacaccctcttcttgaatgtgtgctgtntgggattcatagcattgacaaactccgtaagtcaaggacaagcaatatggttgtcaacgtatccgggtccatgtcctatgcctcacagcagaagtgcctgaacatctggaccgtgattctgggcatcttcatgaccattggattcatcctgttactggtattcggctctgtgacagtataccatattatgttgcagataacacaggaaagtcggggtcactagtacccgcctatagccaacaacctttgcaatccactgttcaatcctggccatgcacactgtggttgatgcccctgccccattggtcctgcccgtacatacagcagtttataccaacacagctgtcctcagtgtcattcaataaagtgcaggtgagtgtgaaaaaaaaaaaa

SEQ ID NO: 712918 - DNA, 122 bp, Homo sapiens
cttgacaacgcaccacggttttcggaaaacatatctctcttctaaattcgtaagatttgattcgaaatgaggtattttatgcagattggtaatacaacaacaaaggcaataattagtagacg

SEQ ID NO: 712919 - DNA, 1050 bp, Homo sapiens
  misc_feature (17)..(17): n is a, c, g, or t
  misc_feature (90)..(90): n is a, c, g, or t
  misc_feature (92)..(92): n is a, c, g, or t
  misc_feature (161)..(161): n is a, c, g, or t
  misc_feature (217)..(217): n is a, c, g, or t
  misc_feature (388)..(388): n is a, c, g, or t
  misc_feature (511)..(511): n is a, c, g, or t
  misc_feature (625)..(625): n is a, c, g, or t
  misc_feature (712)..(712): n is a, c, g, or t
  misc_feature (715)..(715): n is a, c, g, or t
  misc_feature (753)..(753): n is a, c, g, or t
  misc_feature (755)..(755): n is a, c, g, or t
  misc_feature (770)..(770): n is a, c, g, or t
  misc_feature (784)..(784): n is a, c, g, or t
  misc_feature (841)..(841): n is a, c, g, or t
  misc_feature (850)..(850): n is a, c, g, or t
  misc_feature (869)..(869): n is a, c, g, or t
  misc_feature (884)..(884): n is a, c, g, or t
  misc_feature (907)..(907): n is a, c, g, or t
  misc_feature (943)..(943): n is a, c, g, or t
  misc_feature (969)..(969): n is a, c, g, or t
  misc_feature (984)..(984): n is a, c, g, or t
  misc_feature (988)..(988): n is a, c, g, or t
  misc_feature (1045)..(1045): n is a, c, g, or t
gcagctaggcggcctgnagccgcccctgccagaccctcctctgcactcctctgcctaagtcacggcccaagccctggacacgtaggagtntnggcgggcaggggcaaggccaaggaaggggtggagtggtccaatgcagaagtaaaggtccaacccgactnccttactgagtttaggtgtgggggcccccctctcacccctccctccctgcacagcnctggctctccctggagttaggaggctgtttgtcccacaactgctgtggtctggaaggtgaacccatccccaggcaatggggaggccaggaagggccagaaccagaagagggcccagcggggccccagggctgcctgcaggtggtggcagggacccaggacaaaggagtccnggccccgagcccactcccatgtggcctggccccgcagcagccgcctcccatggaagagcagcccagccccgcacagcagcccacccgccacgcacgtttccgtaacgaaggccaaggcaaacngtgccaaaaaaactttgcctgtaagcaacaagagccaggaaagcaggaggagggcagccatgtggaggggcgtgtgggctcgcagcagggccgacagttcagggcccagcagcncagagacgtggagcaggacgccggcggcatgaagcagccggcacaggaagggccggtagttgccgaagcccacgcagcggcccagcnggnggcagttgtggtcccgacgcaggaagcagaagcggcangnagaacagttttcgcngcgtggcggcaccnggctttggcattggtagcagttagcccagccccggcccagaacgcggccggccagcntcacgccanggatgctgggatccgagcncaggaagagccccangttgcccagcaggttgagcagcnggaaggcggccagccccacgcaaaggcccgggccangggttccagcggcggcggcccgggancgagcccaacccgtnagcnagctccagggccacggcgcggcccaaagcgcggtgagcacgaaaagaactgcccggnccccg

SEQ ID NO: 712920 - DNA, 337 bp, Homo sapiens
cccagctacttaggaggctgatgcagggagaatcgcttgaacccaggaggcagaggtttcggtgagctgagattgtgtcgcactctagtcctgggcagacgagagccgagactccatcccaaaagaaaacaaaaagcgagtggtcgtttgtcaagttctggttcctgggtctttaagagtgattgggaggctggggcattgggtgggcttatgcctggtaatcccagcactttggggaggccaagggtgggcggatcatgtgaggccaggagttcgagaccatccgggcttaacattgattaaaccccgtttctagtaagaaattacaagaagatta

SEQ ID NO: 712921 - DNA, 503 bp, Homo sapiens
gctacatccacataagaaaacgccgcggcagtgtcaacacgaagtcgtttctagaaacaatatctcagatggagattcttgatagtcattactgtatacttagtcaacatgagtccaagcgaggctcgatatacaaatatcgcctcccggacactgtaattcagcagtataaacatttcctcacctgacagataactttgtttgccaaaaaagttgtttttaataaactataatcttttgaaaaacttcctttttgtattaagtttagaaagccccgttatttttcaacaaaggggggattttgtaccacagtaacaatgggtttagttttacgtcttacacttctggcacacaaataaaaacaaacaacattttgggtattgttaagaactgcttggtactttaccgatcacgacataaacaggtgtcaccttaaccacatattagccaactcttataaccagaagacgcatctctaaggatgatggggcactgagaatacc

SEQ ID NO: 712922 - DNA, 590 bp, Homo sapiens
cattgcagacgacgactgaagcacgagcctcattttatctcatctcaggagaatgtgcacttaatgatagtagcatatgcctcttagggttgtgagaattaagagcatttactggccatgtgatgaaactggtctcaggaaggcaacctcaaatgggacttatagtcaccagcaagtatgcgcttacagtgactaagcctgccttctacaaaagagttgccatcaaatcacagtttttacatggtttatagtaccagcactactgacatttgagcctgtcctgtactagtatcatcgaggattaaacaattataaaagcactgtatatagtgagggaaagattccacttttctccaaagtaactttatcctcttgattatcccatttcttctctcaatgggatctttgcttttggctttatatattcacaagccttccatgagaaagtaacaagaacaaaacatactcattttcctccagctatcttccagatttcctccacttcaaaatcaaattcagagagccttcaaatagtctgtttgcttccatttcttcagttcttaattcctgacatgctcaagcagtcctgt

SEQ ID NO: 712923 - DNA, 223 bp, Homo sapiens
tgccctagccccccgatatgcaccaaacttgttctccccgtcctggtccaggggtggggtttttaaaaactgacagcctttgccccaggcctgagtccttagcaagggttgggtaaggaggttttaagggaaaaggtccagtccttagcccttgaaaaacaaagcttttttgaccctgaatttggaggccccttgttttaaataataaatcgtgtttcccaga

SEQ ID NO: 712924 - DNA, 287 bp, Homo sapiens
gtttactgctgatacacatcagagcgcggatattcatagggtgaatgatattaccgaggataacctcagagtcttgcaggtgaatggcttggctcatgatgttcggcgatgacgatctgaagatcatgtagcagtactgcaatatgagcactgaattagcctggacatgctgcgctgatgaactatcatgccactgagacagacacacattgatacacctagtggcgacctcatgcacacttccaactgttctagaagcctatagtgcaatggctgactgctgtgcg

SEQ ID NO: 712925 - DNA, 387 bp, Homo sapiens
cttatccatgccctgcgcccagtcatcgaatggtcggacaacttatttgaattttttttgacgtcaaatatctgtagttcatgagtatcaaggaggcctcatgaaacgcaacgaccttttcactatcgagtaccagctgcacggcgagcccaagtccttcatcgtgcgcgcaccgcgcatggacaatgccgaggcttggcattgggccagttgtgacgctgatgtgccggtcatccccaaatttgggcaacacacgttcaagcgtgtgtccaaaccgatggcggagaaatacggcattacccaggtgcgctggagtggcgcggcacagattaaatgggcggagggcctcagaggatgaacagtcagactcttgtttacacaactaca

SEQ ID NO: 712926 - DNA, 288 bp, Homo sapiens
cggcacgaggtgatagtgtgcggcagactcaggagtaccagcggatcatggacatcaattcgcgaatggagcaggtgattgccacgtaccgcagcctgctcgtgggacaggaagatcttgacaacaatttgtctactcacaaggtcctttgaggcagcagcctgtgcggtctgtgctgtcaattggagggtgtcttctgggtcgagggatgggaaggaagggaccattacccccggctgttctcctgacctgccaataaaaatttatgcctcacgggaaaaaaaaaaa

SEQ ID NO: 712927 - DNA, 134 bp, Homo sapiens
aagaacaagcagtcaatcagtccatttcactttcactgtctgcagcatcagggtctctcacgcaccaggatagcagggtggcatgtcagctcatcatggcactcgcatttgcttcctggcaccttttcccagca

SEQ ID NO: 712928 - DNA, 912 bp, Homo sapiens
  misc_feature (199)..(199): n is a, c, g, or t
  misc_feature (211)..(211): n is a, c, g, or t
  misc_feature (260)..(260): n is a, c, g, or t
  misc_feature (265)..(265): n is a, c, g, or t
  misc_feature (280)..(280): n is a, c, g, or t
  misc_feature (288)..(288): n is a, c, g, or t
  misc_feature (299)..(299): n is a, c, g, or t
  misc_feature (312)..(312): n is a, c, g, or t
  misc_feature (321)..(322): n is a, c, g, or t
  misc_feature (324)..(324): n is a, c, g, or t
  misc_feature (327)..(328): n is a, c, g, or t
  misc_feature (332)..(332): n is a, c, g, or t
  misc_feature (334)..(334): n is a, c, g, or t
  misc_feature (338)..(338): n is a, c, g, or t
  misc_feature (345)..(346): n is a, c, g, or t
  misc_feature (354)..(354): n is a, c, g, or t
  misc_feature (356)..(356): n is a, c, g, or t
  misc_feature (362)..(362): n is a, c, g, or t
  misc_feature (367)..(367): n is a, c, g, or t
  misc_feature (370)..(370): n is a, c, g, or t
  misc_feature (378)..(380): n is a, c, g, or t
  misc_feature (385)..(385): n is a, c, g, or t
  misc_feature (387)..(387): n is a, c, g, or t
  misc_feature (393)..(393): n is a, c, g, or t
  misc_feature (396)..(396): n is a, c, g, or t
  misc_feature (401)..(402): n is a, c, g, or t
  misc_feature (405)..(405): n is a, c, g, or t
  misc_feature (420)..(420): n is a, c, g, or t
  misc_feature (429)..(429): n is a, c, g, or t
  misc_feature (432)..(432): n is a, c, g, or t
  misc_feature (434)..(434): n is a, c, g, or t
  misc_feature (438)..(438): n is a, c, g, or t
  misc_feature (444)..(444): n is a, c, g, or t
  misc_feature (452)..(453): n is a, c, g, or t
  misc_feature (455)..(456): n is a, c, g, or t
  misc_feature (460)..(460): n is a, c, g, or t
  misc_feature (466)..(466): n is a, c, g, or t
  misc_feature (471)..(471): n is a, c, g, or t
  misc_feature (474)..(474): n is a, c, g, or t
  misc_feature (476)..(477): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (498)..(498): n is a, c, g, or t
  misc_feature (506)..(506): n is a, c, g, or t
  misc_feature (511)..(512): n is a, c, g, or t
  misc_feature (517)..(518): n is a, c, g, or t
  misc_feature (520)..(520): n is a, c, g, or t
  misc_feature (523)..(523): n is a, c, g, or t
  misc_feature (525)..(526): n is a, c, g, or t
  misc_feature (534)..(534): n is a, c, g, or t
  misc_feature (547)..(547): n is a, c, g, or t
  misc_feature (554)..(554): n is a, c, g, or t
  misc_feature (562)..(562): n is a, c, g, or t
  misc_feature (571)..(571): n is a, c, g, or t
  misc_feature (607)..(607): n is a, c, g, or t
  misc_feature (611)..(611): n is a, c, g, or t
  misc_feature (614)..(614): n is a, c, g, or t
  misc_feature (617)..(617): n is a, c, g, or t
  misc_feature (621)..(621): n is a, c, g, or t
  misc_feature (624)..(624): n is a, c, g, or t
  misc_feature (632)..(632): n is a, c, g, or t
  misc_feature (643)..(643): n is a, c, g, or t
  misc_feature (648)..(648): n is a, c, g, or t
  misc_feature (652)..(652): n is a, c, g, or t
  misc_feature (698)..(698): n is a, c, g, or t
  misc_feature (702)..(702): n is a, c, g, or t
  misc_feature (704)..(704): n is a, c, g, or t
  misc_feature (709)..(709): n is a, c, g, or t
  misc_feature (714)..(714): n is a, c, g, or t
  misc_feature (717)..(717): n is a, c, g, or t
  misc_feature (732)..(732): n is a, c, g, or t
  misc_feature (740)..(740): n is a, c, g, or t
  misc_feature (742)..(742): n is a, c, g, or t
  misc_feature (752)..(752): n is a, c, g, or t
  misc_feature (755)..(755): n is a, c, g, or t
  misc_feature (759)..(759): n is a, c, g, or t
  misc_feature (770)..(770): n is a, c, g, or t
  misc_feature (773)..(773): n is a, c, g, or t
  misc_feature (777)..(778): n is a, c, g, or t
  misc_feature (804)..(806): n is a, c, g, or t
  misc_feature (809)..(809): n is a, c, g, or t
  misc_feature (814)..(814): n is a, c, g, or t
  misc_feature (817)..(817): n is a, c, g, or t
  misc_feature (852)..(852): n is a, c, g, or t
  misc_feature (890)..(890): n is a, c, g, or t
tcatatagtatatattttattagttagtttgtactaatacattctcatattacaaaggcaatttaatggaagaatcttccttttgatatttgaatcatctgaaataacacaaacagaacaatacattcaaagaaatctcatttgcataacaaaaagacaagttaaacaacaaaaaaatttttcctttctcacaggtggncattgaagtggncctaattcggttttccttttaaaagccccgcaaacaaaagtcgtttaanacctntttaaaatgaataanaaattggnttactaaactnctggtctccggcnccattttcnntnttnngtantntggntgccggnncttctttntntgtttnttctnttngtcttttnnnaggtncngttgcnccnttttnntcntgttcatcatgttcntcatcactngcnantttngttttnttgccctnngnntgtncttttnctttnccngnnccnggntgggcngctttattncactttcnttttnntttanntntangnncttttganttcgatttgtttngggattnttgttggncttctattnttttcttcagtgcttctttttccacctctccttctngtanttnccnagtnacntctttgtnccttaattgtnggttnccantatttgcatctttggcttacccaatgcttccttggctttttctttnaatngnattanccccnctnttgctcctctgacgngtctaatncnttttatttcnccntganttgagaaaagnatntgtnnatcttctctacaggtctgatcatctnnntcncccgnaantttcagcaagcatccaatcttttcttctagagatntcatttcagcatcttcttctaacttttgttttgcttcntgctcctgtttagctcttaatt

SEQ ID NO: 712929 - DNA, 254 bp, Homo sapiens
  misc_feature (6)..(6): n is a, c, g, or t
cgtcgnggtaccactacaaaaaaactttcaaggaacgtaaatttttcatgttagaattgtttaagacttttattgggtggaagataattaagtgaaattaaaccaaaacattgaaattttctgttggggaaattcacaaaaatgcttacaatgtgggttttaaaaaagcttcagttttgtggaaaagagggaagaaaaaggatactaatgatcttatccccattaagaagttttaattaggcaggaagcggtgg

SEQ ID NO: 712930 - DNA, 288 bp, Homo sapiens
gcgccaggaaaactcaagggggtttttctatcaagaaggacaattggggacctatcttctcttggtgaccggggtgttgccatatccaatcgagggggatttggagtgttttgtgagctgggatctttaaagtcctgcgcacctcattaaaggcgctcaaccttcccctagatgaaacggcgccattgcgtttggaagccacaccgaaaaacggggagggggggtgctccggattagcaggcccggttccagagaaaatatcaccacccaaggcgtctggccgggttc

SEQ ID NO: 712931 - DNA, 859 bp, Homo sapiens
gcctgcgtcccctttctgcccaaatgggttgatgtggctagcatatcaaagaacctgagcatatggcggcataggacagcagaagctatgcctctctccagactgcatgcatgtagtaagaatccatgcgtggccaaagagaagtcgggggattatgacataaatggtgctgggaaagaaacctcgtgcctagaatagctgtctccttctccatggatgctgacaaccggaaatccacgcatcgcagagagtaagcttctcttgcggattctttcctcctgtccttgacagagtaacacgttaatctggttgcttggtggtgttcagggactagatccctctcaggaaaggcacacatggtatgatgggctcttcccagagtctatgtgagtgctacataacttgcagctgatctcagctggagacatgcttcctacatgacggtgttagagcacagcctaatccagggcacacgaaagactagtaagaggcacgtgctgaaagatggaaggccgccctgattagatcaataaccaccagtgcatatgtattgacactgtctgtttgtccaccatgttcctaagtgtgtatgggagaatattggttatttaccctgcacagatacagtgctggaggcggttaggccatagcgtagttagggcgaacttaggttataaaaactaaaataaagtttctctactgttgagactagaagggaaaacaacaagggacacagacggcccaagcgaaaaaaccgggcgcacacacacacggggcgccgcaccaaggcggtaaacagcggggcccgccataggggggccgacaccacttggcaaaaaacggattagacggcccccaa

SEQ ID NO: 712932 - DNA, 91 bp, Homo sapiens
tccgctagaggatcctgttgctaggctggagtggggaaattggacagaaaagttatgtcaaaaccgttaagaataaatttttatgcttttt

SEQ ID NO: 712933 - DNA, 755 bp, Homo sapiens
acttgttgaggactatggaatggaattaacgaaaaggttcccttgagagtcctgcaacggatgtcttggttctacagaggaaggtgaaaaaaggtggaaagacttgaagaacagagttgttgaacataatattagaataatggccaagtattatactcggataacaatgaaaaggatggcacagcttctggatctatctgttgatgagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaagttaaaattggaagtcattaaaaaaagactgttataatggtgtatatgttggggttttttttctaagcttctttgtcttaaattttaaaatagtgaatatgtttgagactccctttgacctttcagttccccaagttcattgttaactttgcatttgcaattggtgcaaaaatacagatttctgtcgtctgaatacacaaaaagttgtgtcataacttacccagatatgtttttctatcatttgaaacctttttagctactgtttgttttcattcaactaacaaacatattccaataataaaagcagtatatacata

SEQ ID NO: 712934 - DNA, 282 bp, Homo sapiens
tctagccctctgaaagacgtccagtccggcgggcagcaataagacccactttgcggccagcaggggcatctctgcgtcttgcgggggctgcgccgcacgacggcagcccccgcaagacgggcagcccacgtcctcaggagcccaccccagtgtaggtccgggggaccctccagtgttcaacagactgcctgcaggggccacagaccatactatagacacagacccctgctcctgagacaccagccccaaggagaagcctccgactccgactatgcgggggct

SEQ ID NO: 712935 - DNA, 165 bp, Homo sapiens
tgtgtaaggtacagctagagaccctaaattaggacatcacgtgagcaggcaactagagacagtgcctcagtctagtagattattatacaaagctatactggatagagaaacacgaagatagttcctaatagccagtcaatactagcagagtatcacgtcctaaca

SEQ ID NO: 712936 - DNA, 680 bp, Homo sapiens
caggggccggcgaggaggggaggcggtaggtccagagggcgggccgccttaggagattacataatgggcccttcattatactcggataacaatgaaaaggatggcacagcttctggatctatctgttgatgagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaagttaaaattggaagtcattaaaaaaagactgttataatggtgtatatgttggggttttttttctaagcttctttgtcttaaattttaaaatagtgaatatgtttgagactccctttgacctttcagttccccaagttcattgttaactttgcatttgcaattggtgcaaaaatacagatttctgtcgtctgaatacacaaaaagttgtgtcataacttacccagatatgtttttctatcatttgaaacctttttagctactgtttgttttcattcaactaacaaacatattccaataataaaagcagtatatacata

SEQ ID NO: 712937 - DNA, 255 bp, Homo sapiens
tacgactcccggggttatgcatcctcccacatcagactcctgggtagctgggactacaggcatgtgtcagcacatctggctaattttcgtatctgtctgtagagatggggtttcgccggattgcccggactggtctcgatctcctgagttcaagtgatctgcccaccttccaaggtgctgggattataggtgtgagccactgtgcccggcctttcttctttttaaatgtagtggttgttgtcgtgggtggttcgc

SEQ ID NO: 712938 - DNA, 942 bp, Homo sapiens
  misc_feature (926)..(926): n is a, c, g, or t
acttgttgaggactatggaatggaattaacgaaaaggttcccttgagagtcctgcaacggatgtcttggttctacagaggaaggtgaaaaaaggtggaaagacttgaagaacagagttgttgaacataatattagaataatggccaagtattatactcggataacaatgaaaaggatggcacagcttctggatctatctgttgatgagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaagttaaaattggaagtcattaaaaaaagactgttataatggtgtatatgttggggttttttttctaagcttctttgtcttaaattttaaaatagtgaatatgtttgagactccctttgacctttcagttccccaagttcattgttaactttgcatttgcaattggtgcaaaaatacagatttctgtcgtctgaatacacaaaaagttgtgtcataacttacccagatatgtttttctatcatttgaaacctttttagctactgtttgttttcattcaactaacaaacatattccaataataaaagcagtatatacatatttcctttctacagttacctctgattctcaacattttgtggggtagtgatttggcaagtgttttttaaataaaacaaatctcattgtaaagttatcagtcatttagtagaatagaaaagcaacatagagcatacaagaacatttggggatagagttggtgatttgtgaagnaatttggtactttgga

SEQ ID NO: 712939 - DNA, 388 bp, Homo sapiens
  misc_feature (10)..(10): n is a, c, g, or t
tggtattcanaaccaaatgaaaagtcactttgttttcttaacaaaacttttgttgttaattgtttggccaatgaatttttaaaaacttgcacaaatagaaaagttggaaaaggataatatagactgtattaaatgtttttttttgttttaaaaactgcttggcagccccaggtgaagtattaaggattgtttggtattaaaaattgggttcaccgcatgcaccaaaagtgtgtaccctgtaagaatgaaaccagtgttttttgttttttttttagtttttattccggagcctcaaacaagcattaaaccttttgtgattatcatttcctttcctataattatttttgtagcactccacactgatttttggaaacttgccccttattta

SEQ ID NO: 712940 - DNA, 148 bp, Homo sapiens
acagcgtaggcgggggtaaaggcacggggcccctccctctccaggctacgcctggcgcactcgagtagccccttatactggcccgtctggcgcaaggtcagacgcgatcttctagacaactgttcataggccatgaatcttgagaact

SEQ ID NO: 712941 - DNA, 1097 bp, Homo sapiens
acttgttgaggactatggaatggaattaacgaaaaggttcccttgagagtcctgcaacggatgtcttggttctacagaggaaggtgaaaaaaggtggaaagacttgaagaacagagttgttgaacataatattagaataatggccaagtattatactcggataacaatgaaaaggatggcacagcttctggatctatctgttgatgagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaagttaaaattggaagtcattaaaaaaagactgttataatggtgtatatgttggggttttttttctaagcttctttgtcttaaattttaaaatagtgaatatgtttgagactccctttgacctttcagttccccaagttcattgttaactttgcatttgcaattggtgcaaaaatacagatttctgtcgtctgaatacacaaaaagttgtgtcataacttacccagatatgtttttctatcatttgaaacctttttagctactgtttgttttcattcaactaacaaacatattccaataataaaagcagtatatacataaaaaaaaaaagaaaaagaaaaaaaaaaaacatgttgtgtgggggggatttgggccttgagaaaagttttttgaaaacaaatgttggtaggggggcggggggaccaaaggagggataggggacacgggggcacaagcagggtgtccccagagagagaaccgcggggacagaaaaaaagggagtgagaattcagcaccagagtgaaaagaggcgccgcgggggcaacaggaagtcgttgcgagaacacataccgcagggggaccccgaggggcacaaagagggagatctatacagagaggacctcacaaagagagcgagattaaaattgaccgccgggggggct

SEQ ID NO: 712942 - DNA, 119 bp, Homo sapiens
  misc_feature (108)..(108): n is a, c, g, or t
gcgcatgcagtagacagacagaacgagagcgtcgcttggaggagccactgacagcagaaaagaataggagtactctgagagaagagctgtgttacctttgtacatctnagtacgtgcta

SEQ ID NO: 712943 - DNA, 219 bp, Homo sapiens
cgtctaactgtgcggttgatctccagtgctacatgggccgctggtttgtcatcgcgaatatcccgtactttggcgagcgcggcaccgtcggcagcttacgccgagtgttgctctgcggcccgacgtgccgttatcgacgactacctagtgtttaccgtacccgggcggtttcgactgcgcccttcaatgcgcatgcaagtttgtggacttcggtgcgta

SEQ ID NO: 712944 - DNA, 181 bp, Homo sapiens
gaggcgttctagagatcccccatcggctctaatccatctatcatctatctacctggctatctacccatccttctatttatctattatctatctatctatctatcatctatctctaatccatctatcatctatggcagtggttgcaaccaggcacaactgtacttcccacaggacccttgct

SEQ ID NO: 712945 - DNA, 158 bp, Homo sapiens
ccgcatagggtggggaggtgcttaacagcattttttttgagccttgaagcggattgagagagagcccacagaggtcttacccaacagccttaacaagccttgagggtcttgagggtacccgtaaccgcccaattcctgtttgctgtgtatgaataaag

SEQ ID NO: 712946 - DNA, 558 bp, Homo sapiens
  misc_feature (40)..(40): n is a, c, g, or t
  misc_feature (178)..(178): n is a, c, g, or t
  misc_feature (307)..(307): n is a, c, g, or t
  misc_feature (326)..(326): n is a, c, g, or t
caggggcaagagagtggccttcaccctgccggccccttcntgttggtggggtccaaggcaagggtgcgcctttccaccttttgggcaggagctcacaaaaaattgatgcccaactgcaagtgggtgtccaacctggcggtgccccctgcaggtgacaacgtcatttgttggagctacnataacaaactggtgtggtttgacctgggtctttcccccaaaccatacaggatgttgagaccccccaaaaagggtttggggggtgtggccttccccccccgggaccccctttttgggtcagggtcggacnacggcagtgttattgtttnccatgggatggtggacaatgaccttttgcaaaaccccttggtggtgcccgtcaaggtgcttaagggacacgttctgaccccagatttgggaggggtgggggtttttttcccccccccccaaccgtgggttttttccttggggggagagggggctgtccgcctttttccctaactgttttgcctgcctgggggtgggggggttgtgtttaagtcaacaaagccttttccctga

SEQ ID NO: 712947 - DNA, 1477 bp, Homo sapiens
  misc_feature (68)..(68): n is a, c, g, or t
  misc_feature (104)..(104): n is a, c, g, or t
  misc_feature (511)..(511): n is a, c, g, or t
  misc_feature (884)..(884): n is a, c, g, or t
  misc_feature (978)..(978): n is a, c, g, or t
  misc_feature (1069)..(1069): n is a, c, g, or t
  misc_feature (1174)..(1174): n is a, c, g, or t
ttcacccccttgagggctttttcacaacaaaatgtcttttctcgtagaggaggtttatataaagaatngtttcgcccgcacaagggtgttgccgccgccgggcnaccaaagttagtagtttgttggaccgacacacacatgtgttagaaggggggcccccaaccagcagaagaaggtgatgtttttccttgtatatattccatagaggtgccccagcagagcccaacattgtgcgaaaaggaagttttcgttgtttctcccccgcggttggggggggtggttcccaccacccccgggggaacaccccgcgggattttttggtaaggcaaccccacagcgggtgtgtttcccccgacgaagtgtgaaagccctttaacatttgtgttaaatttgggccttttttttgtcgccccctcccccccaaatggagaaaaatgtctccccaccgtcgacgtgtttgtggcgcacccagcggtcctctcacaaaaggacttggaagggggcgaacccntttgtgtgcccttctgcgcgccacaacatgggtggacgccttcccgccgtatgattaatagtgtgttaaaaagattctcgccacggagttatccacggagacacgcccgttgtgaaatggcccttgtttcaccccctcagataaactggggcttctctgtagagagggggagaatgtaccacacaatacaccttttgttttatagcccacgcgcgagaggaaattgcccacaaacacgcgtgccacatgtgtgccacacacaggcgcttttgtaagaaaaaagagataaaaagagaagagatgcccgcacaaaagggctcttccgcctcctttgccccacgctatagagattttccccgcgcgagaaaatttntcgcgagaaagagaagcccacacatctgtgtagtacaccaccatctgtcgtctaagatatatgggtccaactctctcttggttgtgggtctttnatatggctctatatttgccccctctctatatgtgttgtgtatatctctcgagaagagaatatatatatatgacccacgcccactcgagagngagaaaccacacaatcacattggtggtgagatttatatctgccacacacgcgtctgtctgtatagttaagatacccacgctcacctctttctcacacaaaatttnggagattttttatagataataataaactatagctgctatattcacaaatgtgaattctacccacatcgttttataatttatatggttcacaccccgctcttgttgagagactgaatttcttgcacaatgcactaagatatataaagcccaatatgagctcacctcacttttcttggggtcgtaattcctgagtttcacgaaagaaggagtcactaactgagaacacacacactaagaccacaataataaatcatgtgcttttaacatatttgagaataaaaaggactagccaattaaactcca

SEQ ID NO: 712948 - DNA, 146 bp, Homo sapiens
gaagaagtggagaggtgtgatgatcttgtgttttctctttcctttttcttgctgatttcatgcaaagggctggcattctgattgttcttttttcaggtttaatcctttttctaggtaaagtcttcaagcaaaaattaaaaaaaaaa

SEQ ID NO: 712949 - DNA, 731 bp, Homo sapiens
  misc_feature (537)..(537): n is a, c, g, or t
  misc_feature (562)..(562): n is a, c, g, or t
  misc_feature (567)..(567): n is a, c, g, or t
  misc_feature (575)..(575): n is a, c, g, or t
  misc_feature (580)..(580): n is a, c, g, or t
  misc_feature (584)..(584): n is a, c, g, or t
  misc_feature (593)..(593): n is a, c, g, or t
  misc_feature (611)..(611): n is a, c, g, or t
  misc_feature (622)..(622): n is a, c, g, or t
  misc_feature (637)..(637): n is a, c, g, or t
  misc_feature (643)..(643): n is a, c, g, or t
  misc_feature (674)..(674): n is a, c, g, or t
cgctggtagtccggcagcttcagatagtccgggcggaagttgtggccccattcggaaatacagtgcgcctcatccaccaccaacaaggaaatctgcacgctttgcaggaagttacggaagcgctcgttctttaagcgctccacggaaatcatcaaaatcttcaactcacccgaacgcgcgcgggtcatcacctcattggcatcttcacggctctgcgccgaatcgatactgccagcacaaatgccatggcgttgcaggaaacccaactggtcctgcatcagcgccaacagcggcgacaccaccagcgtcaggtgcggcaacagcaccgccgacagctgataacacaaagacttgcccgagccggtgggggaaaatagccgcagccgaaacgaacgggccagcaccgcgctgatcgcggcttcctgggcccaaaacgaaaactgttggataaccaaaaaaactgtttggaagggtgtttgttgcaataaagcctgtcactccatttgaaccgcctgaaaccaaattccaaaaaccttntaacccagcgaatcaagttaaaaanggtcnggggaatnaaacncttnccaaactgnattcccgaaaaaaaaccngccaagaaccncccaaaaatgcaaanagtacncgcctgattacaaacccccaacaaggattcntgaattttccatgccccgtttccttgctctcccaatccttctgctgatggtgtcacc

SEQ ID NO: 712950 - DNA, 152 bp, Homo sapiens
taccgtatcagcgtacgcaagtcggccaagtgttggatgatggcaggcgttcttcaaggcgatcatccctcaagcaatctgaatacaccgctgatgactgaaaattatgagccgacaccaagcgaggccttggtgtcggctcagaaacatcg

SEQ ID NO: 712951 - DNA, 558 bp, Homo sapiens
ctacatctcatggcaaagtgagcatatactgcagcctctctctttatctaactatggtacgctgctccatcaatgcaatacgccgccgtatgtgctgcaggacacgtggagtaacaagacgctgaatcttgggtgcttgggtcctaggtttcttaccttctttatttaagggctttcttacaacatactggcggacatcatcttctttatagagattgaaaagtttgcggattctgctaactcttttggggcccaggtcggcgaggcactgtagtatcagtcagtccaggaatatccttctctcctttttttactataaccaagttgagaacgctctagatttgcatccacaatgcaaccacgaagctgatgttctctttcagacccaaatattcgactagatgcttgaccctgcttccctcccagtctctgggacttctgggtatcgtttggcttgatcctgcgaatgtagtggggcgtacatttcatcagggtgctcactaggtcatcgctgtgacctgagattgggcttccggcaggagaaccgcgtcacaatcg

SEQ ID NO: 712952 - DNA, 107 bp, Homo sapiens
  misc_feature (10)..(10): n is a, c, g, or t
ggtcaccatngtgcggctgggctgtgtatctgtgtatcaacgggagcggctgctgaggtgaccacagccttctcctaatacaagcgtaagtatttaaaacctaaaaa

SEQ ID NO: 712953 - DNA, 920 bp, Homo sapiens
tccccttgcgtggctgggctgctcgggttagatcgtcagtgaaaagcctaaaggttagacttgtaatgaaaagaaaatagaagccatgtttctgaagacctgtattacaggtacttctgtcagttttgtaatgacatgacgtcctgaaacaactaccatgttttggttcttgaaagatccctgaatcgtgtgcacttactatgggcgagtgggtcacggaccctgtcttgagacaggtggacatggaaaaaatccagtcacaatatttcctctagcaactaatgagatgtggcgatcagtgggatatgtgaatgtttaccaacttgggtgatgtcatgtcaaaatgacaacatggcacagaatatcatgtattcctggccagtgcctcagagactgtggcatatcaatatgtgaaaaaggggtctcgaactttacttttggaagggacaaatagacctatggtgaatacatggataaaaataatgtgacgtgcgacaagcaacaacactcatagctgatactactgactatttctgaggtgaccagacgaacgcagaagcgcagtgaccggatgactctacttggggccatcacttgtgtacagcctcatttccacagtcatgtttactctttatgtgcctccaagggtgcccatgaactccgaagtactccatttacccgatgaacaaatagaaacaaaacgaacgacacacaccgttgcgcgaccccgcacccaatgcccacaacaagaaaggctaaaaacaccaacaactgtgcacaacggagccccgaaaagcccagcgcgcacacgacgccaaacgagagccaccaacggaacccggcacaaaaacaccgtcctagagaccaccacacagaaatcccagcgggcccaaatgacgcaagaaacacaccgagaacac

SEQ ID NO: 712954 - DNA, 155 bp, Homo sapiens
tttttttttttcaaatctaaaagttgcaatcttcttattctgccacaatccaaactgaatatatccttcatccactcgatccttctggttatcttactttggacatttgtcaactctttcttaaagattaaattaatgagtattcctgaagcagc

SEQ ID NO: 712955 - DNA, 304 bp, Homo sapiens
gcgtagtgaacagaaatcgcgccactcactccagcctgggcaatagagccaggtccttagaccctgtctcaaggggaataaagaaagaaagaaatagagaaacaatataaaagtgtataggctaagaaagaatggttcatgcctgataattgcagcactttgggagactggggcaggaggattgcttgagccgagacgtacaagaccagcctgggtgacagagcgagactctgtctccaagaaaaaacaaagaagcagttggatcagccgacaaaatgtgggtcccctgtgttttacaaggggg

SEQ ID NO: 712956 - DNA, 143 bp, Homo sapiens
acggccgtgtattactgtactagagaccatattgtagtagtaccagctgctacgacacctacgtattatgattacgtttgggggagttatcgttactactactactactacatggacgtctggggcaaagggaccacggtcac

SEQ ID NO: 712957 - DNA, 245 bp, Homo sapiens
  misc_feature (113)..(113): n is a, c, g, or t
  misc_feature (201)..(201): n is a, c, g, or t
agctgatgtcatccccttcgtctctgagtagtaggactacaggcacacactactgtgccagtaacttattttatttttatggagatggggtcttgctttgttgcccaggctgntcgtgaactcctggcttcaagcagtcctcctgcctcagcctcctaaagtgctgagggctttaagtggtttcacatttgaacgcctganagttgctaacgacttacggttgtttctttatatctcggtttcaa

SEQ ID NO: 712958 - DNA, 1277 bp, Homo sapiens
gcacagtttcgccatggccctggggccccaaggaagcacttaaagcagtgattagcagcgccgaaggcattggatgcttggacaacaaggtaatcggtggtgtatttggcacctgcgttgcgcatacgaacaggtccccaaccaaggctgagggaatgctacttgcctcgtgagtcgctcattaccatcagggaatatgactgcaaggtactgtcgttgcacgtaggaggactgacggtaataggaacgatatagtactgcaaacgtattgcagttcgaaaattccgtataggccaagggatttcgacgctggtatgatccactagtacctcctgctaggcattctagtggaatgatcattcgagcaatcagtagaacaccaggtgaactatatccagcgcatggttctatgtacgacccaaggagcgcagcaacttccgcatggttcacctgaatcgacaggctgcgcaagaaggccacacagtacgacaggttgtagcacaaaagtagagagaaaccgattgaccttggtgggcgatgcttgcccacggggaattcccctttcaccatgagttggactcccaaaggatttgcattcgtgaaagaaaaatcctgttaaacaacacgcaatgcgtcgttgattccagatgggtcccaaatccgcattgagtccggtgggcccatgaattccgcattctttaaccggcgcaatccttgggggacaggcaatcacaaatcctagagcctatatagggcccaatagtgaacggactcaaggagaggcaacagagtgtgtgtctagctcactaacgatcggaagtatggccccgagtacgtacaaaaaaggtgccgataacggccgcttcgcgcccgctagcagtccaatccacatcgcggcttcataggaacccattgggcgttgggggtcaccgtgggaacgcattgcactcgccggtaagctaaatgccttgcaaattgcgacattgaactccacattcggagggtagacagaaagggaatgtggtgttaccaaggagaattagtcacatacatataccaaaaaggaggtcacgggaaggctgggagaaaaggagattcggattgtctggccagagataattacaacaggtgggaaggaaatatgcactgcatgtgctaaccgaagagggggcaaacattggggaagcattttcgaagagccaagggacaagagattgggccttaacggaacgggagaattacattaaccgataggttcatttgtgtgagacgcaaaa

SEQ ID NO: 712959 - DNA, 192 bp, Homo sapiens
gggaaaaaaaaaagtgcccccggggggggttggggggcccccccccccccccaggggggggggggcttggggggggggggggcccccccttttttcccctttttgggtttcccccgctttttttttttaaaggggggcccccccctttttgcccccccccaaaaagagggggggtttttttttttcccccca

SEQ ID NO: 712960 - DNA, 116 bp, Homo sapiens
caataccatctactgactatctagaaatcgctgtcgccttaatccaagcctacgttttcacacttctagttaggttctaccggggtttaggtctacctgggtttaggtctaccggg

SEQ ID NO: 712961 - DNA, 170 bp, Homo sapiens
gctcactatctatcacacaccaggactgaatccatcagcagatactgccctgtgggaggggcagaggaaagagaaggcagacggactgacagacaccacagaggaacaggagagttagcctgggaccaatggaggagaagtacgaacccttggggatcttggcctctgtg

SEQ ID NO: 712962 - DNA, 433 bp, Homo sapiens
  misc_feature (45)..(45): n is a, c, g, or t
  misc_feature (152)..(152): n is a, c, g, or t
taattaagaacagtttaaaaattaagtggacaataaaaacaaacncattaattggcagtcgtggtggctcatgcctgtaattctaacacttaggaggtgaagcgggtggatcaccctgagtcaggacttcaaaaccagcctggtcaacatgntgaaaccccatgtctactaaaaatacaaaaattagccgggcatggtggcacatgcttgtaattccagctactcaagaggcagaggcacaagattcacctgaacctcggaggcagaagttgcagtgagccgagatcgcaccactggactccagcctgggtaaaggagtgagactctgtctcaaaacaaacaaacaaacaaacaaaaaccaaaatattaacgtaactgggcagcttaacttcaaaatgcatttgaaaacttttttttcccctttcgtcgacgc

SEQ ID NO: 712963 - DNA, 945 bp, Homo sapiens
tgggggggtttccccttttgggggggggggggggaaaaagggggggaaacccgggccccgggccccccccccccccgggtataaaaaaatttcccggcccaagccccccacgaagtaggggggggtaaatcagtagtatcgacccaaccatcggcggggtataattatctcggtgtgttataaagagaagaaacagggtggtgtcactccaccaagggtggggcgcacagagggggtgtcatagaacacactcgagcaccacagaggagagagaatcagcgccaggatcatcggcagcacctccaccagagaggtggtcgggagatataccagcgcaggcagtagaaagtatccagcgggcgcgcgcgtgagccacgcaaaagagagtgtgtatggtacatatacatcagacgagaaatcaacgcgtgtcacaggtagggagagtgtgtggcgtgaaagagagagggggtataaaaccaacgcagtgggcgcagtgcgcgcgtggagacacccctctaggggggatctacaagaggggatggggaggcagtgtgtgcttacaaatgaaggctagaaatatctgtgacgacgaatgggtgacaacacatcagaggagagggggtaacatcatctccgagcgaagcgagaggaaaaaacactcgtgtttgagcgaaagaaaaccccataatgtgtgttttgtgtgagtacgtagagaaaaatatgtgtgtgtggtgttgttgtgcaactgagagtgatggtgatcttaagagataaatcggggcacgtgagtggagtcaccaaaaaaaatgtatcttgttggtgtggcactagttgaaaaaaaacaaaacaaagacaacagaaaacaaacaaaaaaaaaacatcatcaggggagtgattatatttttggtgggtggggaggaaacaaaaaagaagtgataatcacag

SEQ ID NO: 712964 - DNA, 523 bp, Homo sapiens
  misc_feature (94)..(94): n is a, c, g, or t
  misc_feature (157)..(157): n is a, c, g, or t
  misc_feature (173)..(173): n is a, c, g, or t
gttcaccgaaggtcgttggcagctgtcagtggcggtgtgtcgctgaagaaagaccatctggccttgtggggattggctgtgtgcaatactcctncaggagaggctaagatatatgtgtacacaagagattctgtgatgttctgtgagagaaatcccntaaaatatgcagcatnatagaagtgtatacagaacagtattacaaattgagaagctggctagtggttaaaggcggaacccagatgttcaaaaatattcagagagaccaacttccagaggcggtccaatctagacagaggtgcattccttcagggcgtgacacattgaatctaatatctggcgcaaggacaaacatgagcggaatgggacaactattgggagccacttagtgggaaggagcctccttgccggatcagctggaatatggccacatatacattatttaacgtgaacttggtgctggtgtcccatggcggaacactggagtgtacattaacatatttctggttattattaagaagcgtcg

SEQ ID NO: 712965 - DNA, 310 bp, Homo sapiens
gtgcactgtgcatgctaagtggagataaagcaaagtgtgaaggacgcaacacagcagacgcatccgcgaggttgtcttgctagacctgctcctccaaagccagagcccaagcctaacaagtgccctgcaacgaagggagagacggtacccaaagggacaaagggaacagctgatgctggcaaggaggggaataaccctgcaggaaaatggcgcatgcaaaacgagacctggcgacgagcaaagctgcaggtgctgagatgccaagtgaagggtgtgcattcttggatactgtttacttctggtgacggta

SEQ ID NO: 712966 - DNA, 505 bp, Homo sapiens
  misc_feature (4)..(4): n is a, c, g, or t
  misc_feature (495)..(496): n is a, c, g, or t
tggntcaggaaagccccctgtgggagagccccaggcgcacagggcatgtggggtgtgggaagcgccgttccccacgccctgttgtgggtgaactcgatagagaaggaaggagggtgacacccaccggaggtgccaattagtaaccacagtggcctcaaagaactcaaatgaaaggaagacttgcacgtctctcacttgaagtccagagctagaaatgattaaggttagtgaagatgtagaattttcatagctagagagaagtcaacgcttggcttcaaaacttcaaaggatgggctgactctctttgaggaccactgcagctggtgactttaagttacagccagtgctcattgaccgctctgaaaatctcagggcccttaagaattatgcaaaatctattctttctgtgctctagaaatggaacatcactgtctgggtgacagcacatcttttaatagcatggtttactgaatattttaatcccactattgaganntactgctca

SEQ ID NO: 712967 - DNA, 870 bp, Homo sapiens
agggggatgtgtgtgtgcgtgtgtgtcagtctgttggtgagtgtgttaaaggctacagagcacagtcggttcaaaatgcttggaacttcccaaactggctttactttatgtatatacaggtgctcagggttaacgcagtacatccatgccatctgctgtggcgaggtatccccggagtgcatgtgttcttgacgtctataaatagtagaaagatatatatgggtattcgtttgtaccaacttgaataggttgtattaaagcatgaagtgaaaggttgcagtatcagtgcattcaggttattgtctaattttggttctgacagtgcatgtctttggaagcatgctgaaagcagagattaacacaggagtcgagtaagcagagagaaacatttgtgagatgtacagcattgggttatgcattggtatagtgtttataccgtgggtagtggctgtcaaaccctgcagatccccgtcctgtcccgcttctccctgcccgtgggtgtctctggtcacaggtcaactgaatagcatacatttgtcgtgtgataaatactcgttaaccagtggaatttgaactgtcattaatagtattcctaagtgtgtgcgtgcacgaaagtgggtatgagcctgcttaaagtttgccatttgcagatcttaacaggtgagtggtagacaggaagtacgagagtggggtttcatctttgtcaaaaaatcgtttttaacttcatgatcttaattgtgctttgtcactcataagaaggaaaagcatacctgagttgtagacaagggagggaaagcacttgagggttctggtggtgtggtgcttagtaatggggggtaatggttgtaactcagttaagcttggattatg

SEQ ID NO: 712968 - DNA, 603 bp, Homo sapiens
  misc_feature (447)..(448): n is a, c, g, or t
  misc_feature (450)..(450): n is a, c, g, or t
  misc_feature (454)..(455): n is a, c, g, or t
tcgccccccccccgtggcttctcgtggtgcggtctagtaaattcttgatatatttctcgtggtctcgtctctcttctttgtgctccccccgctgtgtgtagtatatagatgctcccccccgtgtattttgttgcccctcctcggtgatcctccccctcgtctttgtgagattgttttctcccaagaagccctctccctctggttgtttctcccccgccgcgggcgctctttttgtatatttgtgtgtagagagaagtccccccggcccctctggttcactgtccccgggattttctcctcatgggaacccactttttggccccacgttgttcacctttaccctcctggggcccgcgcgcgcccccacacacgcgagttgtgtttctagaaaagctcttctctccgggggcccgggcgcgcgcgccgcacacaaagtttttttttttnntntttnntttttttttgcgaatgaggcaatttattaacccagcatggtttgttctaatgcttcttgttggcagctgccacctgtccggcgattctgtccagatctctttgtcccttctgtcgtcttctcgcagccgtatagtagtagtagcgccg

SEQ ID NO: 712969 - DNA, 611 bp, Homo sapiens
  misc_feature (174)..(174): n is a, c, g, or t
  misc_feature (181)..(182): n is a, c, g, or t
  misc_feature (185)..(185): n is a, c, g, or t
  misc_feature (200)..(201): n is a, c, g, or t
  misc_feature (207)..(207): n is a, c, g, or t
  misc_feature (209)..(210): n is a, c, g, or t
  misc_feature (219)..(219): n is a, c, g, or t
  misc_feature (253)..(253): n is a, c, g, or t
  misc_feature (258)..(258): n is a, c, g, or t
  misc_feature (275)..(275): n is a, c, g, or t
  misc_feature (304)..(304): n is a, c, g, or t
  misc_feature (324)..(324): n is a, c, g, or t
  misc_feature (347)..(347): n is a, c, g, or t
  misc_feature (358)..(359): n is a, c, g, or t
  misc_feature (427)..(428): n is a, c, g, or t
  misc_feature (446)..(446): n is a, c, g, or t
  misc_feature (487)..(488): n is a, c, g, or t
  misc_feature (493)..(493): n is a, c, g, or t
  misc_feature (503)..(503): n is a, c, g, or t
  misc_feature (512)..(512): n is a, c, g, or t
tttttttttggttttgtaagatttttaatttctatattaaaatatctatttaatctatgtttttttttttacgaatgaggcaatttattaacccagcatggtttgttctaatgcttcttgttggcagctgccacctgtccggcgattctgtccagatctctttgtccctgaggngtcagtnnagncggccgccatctgtnngtcctntnntccaccatntttcagcccctccagggcttggaggacccggggngccanactcttggagcctcggntgaagtggctgggcatgacgccgtttctntgacgtcccccatagatctnggtcatggagccaaccccagcgncaccccggagnntccaggtgccgcgctgtggaagcagctcgcgtgtagaaccagttctcatcgtagggagcaagctcttnngtgcttggccagcttganggtatccacccattcggggactttcagcttcccggactttnngaggnaggctgccanagctctgangaactcctgctggttaacgtcttttacagtaactccaggcatcgcgcggctagactgagcattgcatatctggatcaaccagatgattaaccgttgata

SEQ ID NO: 712970 - DNA, 782 bp, Homo sapiens
atcgaaatagtatgatcgacacgtatcgtctatagccccaagagtatttacactagcactgctagtccggaggaactctgacgtggagatgtgtgtgctcgtgactgagggtccactgcctttttagagcagtggggactcgtaccttatcaagttgacccggagaagtagacgcccatggcaaggggagctcctcctactcctcatttgaatgtattagctgataccccctctgggcgttgtgcctctgcgatctgtcggatgcacctcaggttccgtgctgtcgtcaagcagatgctagattttcctgtagaaaaagcaaggaaaaagcagttgattcgcagaacttgtggtctccgtattgacatttactccaagaaaacgattagcaacagagtaaaggtgctagtgctggcaagagaatggactgaacaggagacccttctactcctggaggccctggagatgtacaaggatgatcggcacacaagtgtcggaacatgtggaagtcgtactcaggatgaatgcatcctccactttttgagacttcccatttgggacccataccttgagaattcagatgcttcccttgggccttttggctagcagctgtgcccttcagtcagtcaggtactccagtttatgagtactgttgcgttgtgggatcttgtgggtggccctcgcgtggcttctggggcacggaccagggggtttggagccacttttctcgggtccagggggcggtgcccttggggttgggttgacggtttgttagaagtcag

SEQ ID NO: 712971 - DNA, 725 bp, Homo sapiens
aggtcaagtatcgtttggaggcttccttggttggttttgtcctgtttcgtacattccatgggaatagcagtgagacctttgggccctcttggcggttacattgccagcgcgaaggccactctgctgcagcgcaagtcacgcagcctgagctcacagctcacagccatccatttcgttttctcacgtttctgacaaattgcaaatgacaggatgtgcgggcgagtgagccacaagggtcccctgggtccttgcctcgcagacccagatgggtaactgtttgacctgggttaggcctgacttgactgtcgggtaaacagccacccaatcaacccatgggccccctgcacccaagggaagggaggaagcagcctgcatgtcctcatgcccctgaagaacgaatcaagagacccaaaccagaccaggcacagtggctcacacctgcaatcccagcaccttgggaggccgaggcaggagaatcatctgaacccagaaggcggagatgcgcagtgagctagagatggcgccactgcacatccagcctgggcgacagagcaagagactcaaaaaagagacccagaccaggattacgaatgaggcaatttattaacccagcatggtttgttctaatgcttcttgttggcagctgccacctgtccggcgattctgtccagatctctttgtcccttctgtcgtcttctcgcagccgtatagtagtagtagcgccg

SEQ ID NO: 712972 - DNA, 107 bp, Homo sapiens
cacgtatgcggagtgctacgctggactgtcttttggcataacttgttacacgtttggcatggctagcacacaggttggtgtcttcaaaaaggccaaccagataggcc

SEQ ID NO: 712973 - DNA, 173 bp, Homo sapiens
aacgacttttttttttttccccctcttttttttttcgaatgaggcaatttattaacccagcatggtttgttctaatgcttcttgttggcagctgccacctgtccggcgattctgtccagatctctttgtcccttctgtcgtcttctcgcagccgtatagtagtagtagcgccg

SEQ ID NO: 712974 - DNA, 1472 bp, Homo sapiens
  misc_feature (321)..(321): n is a, c, g, or t
  misc_feature (381)..(381): n is a, c, g, or t
gtcctcttctttccacaccatgacgctaccagtaccaggcatgccccgtaacactaccgaacaatgaccgctttgtgctctccaagggccatgcagttcccatcctctacgcggctctgagcctgaagctggtgttccctgcgccacgatgcgcgatgcctgtctgcaacgctgtagagaagagatcagacatcctgaacttggtacggcgcaccgcgagatcctctgaaacaaacgctttcaccctgatcgatggtccacatgtgcttccccttgcgtgcctacgtggtccttacgagtggacctggcgtgtgcttgcgncatttggcgctaggagaccgagactaaggtacatttccgacctaatgggccagcgtagcncagatcgatcatagtcttgcctatgcgtgcgcgacgaatagagtgcgcacgctggtaccagaagcgtgcgtcttgatagatagtgcgatgggcccagttgtgcacttttcaggcaccaactcaattctaacttaatgtcctagcgaagcgaaaacccttagtttgagcccaccaatattcttaaaggtaccaattccatagttcagtcactttgtgtgccctccataaattatcgaatcaccagggccccccaggtctttgcctaacgtcaaaccgccgagtaatttgaggtaaccaatttcattcaactcaagaaagaatgttccgcgattaggccccgatggggtcccttgttacgggagtttgttggggccaatttcgtcccggattccacttgcccagattggggcacttcgaggaaaccacaccacatgccgagatagttgaaacgaggaattggaccttgtgttttgacctatattggtgtccacatttattccgtgcccacaataggaggcccacaaaaagccacaaaccccaaaagaccacaaaaaaaccaaatggccgccaatttccaaattttgccccaaaatggaagccgcgttttcccaaaccggggcgggcccctggaaaaggggggaacttcaaccctcgcgcggggcggttttagggaacaacgggcacctcacaacggcggcacagcgcttcccttttttgtggcccaactttgcggcgaaaaagccccccgcttctttttccacaccaccgaagaataaagaaagaagacaaattgagtgtgccttttgaaaggcggcagaggcaatttcccatttcccccaatggtggcaacgcgcaattacctttaaccaatgggccgccacaggaaatgtccccagaggaaaggccacagacaacaaaagggcaacagggtagttcctctgtggtgggtctaaaaaacacacccctttgtctacaaaccaatgtggtagagaggaaacccggccatacccgccttacacaaagggttagggggaaccactatttggcccctatagattctatttcccctggttcaaatttgtacgccccga

SEQ ID NO: 712975 - DNA, 579 bp, Homo sapiens
  misc_feature (516)..(516): n is a, c, g, or t
agcaggtgtctcctctatcttaggggccatcaatattcatcacaacacttatcactatataaccccctggcataacccaataccaaacgcgccctcttcggctgagtccgtgctaaatcacagcgagtgcctacattcgtcgctatactctcgccagatcctagactgcgtggcgatctacctatactgactacacagagccgcgaaacctcaacaagcagcacttgcttcgagaaccccggcgcgaggtagggaagaaaccccattgctatatcacagagcaccgtatttcgtggatattatatcggggtctacaccctgtgaagagtttactcatattctctagtctctatacacgaggctctcggggaattaaatcgtgccgcactatattggtaacgtctacgtaatcccggagagaagaaacgagacccaattgtggagtatccactatgggtgacttcgatgcttgagagcctatttgacgtactcacaatgtcgggcgtttccctatangcgcgtatacatccggaggatggaaagacacgccacaccacattacgtcagtctgtcaaccag

SEQ ID NO: 712976 - DNA, 209 bp, Homo sapiens
tttttttttggttttgtaagatttttaatttctatattaaaatatctatttaatctatgtttttttttttacgaatgaggcaatttattaacccagcatggtttgttctaatgcttcttgttggcagctgccacctgtccggcgattctgtccagatctctttgtcccttctgtcgtcttctcgcagccgtatagtagtagtagcgccg

SEQ ID NO: 712977 - DNA, 401 bp, Homo sapiens
  misc_feature (2)..(2): n is a, c, g, or t
gncgactctcgaggatgcccctgatgttggcctggctaagaaactgtgtattaataagtcatttgattaaaaaaagggacttgggggggaattgtggctcatgcctgtaatcccaacacactgggatgctaaagaataagctgaggagttcaagaccagcctggtcaacacagtgagacccccatttttataaaacaaaaattcttaatattatctttttacaaaggacttatttatatggcatcttcaagtatttcaaacatttcgtgtttggattatggaatatgtctccagaagaattaacactatttctatttaaggtaattttacatcatttcctttattagaagaaataacagatctgcagatggcattttgtgaaggctgccttctattaatag

SEQ ID NO: 712978 - DNA, 600 bp, Homo sapiens
gcgttgcttagcgtaaaaagcgagctggaatgcgtgccaacatcaccctggcaaatgtcatccgccagctgggcagcctgagtaaaaatgcaaaggacatttttggagagctcttttctcaggccaatacctttgcctttcgggtaagctcccttgctgagagggtcgaccgactacaggttaaagtcactcagctggattccaaggaagaagaagtgtccctgcaaggaatcaacccccgaaaagccttcagaagttcccccattcaagaccagaagctttttggcagaaactctttcccagtgcctgttttagaaacatacaatacctgtgatactcctccccctctcaacaattttaccccttacaggggcgatggaaaaaaggccctcaaattttacccagacccttcatacttttttgatctttggaaggagaagatgctgcaggacccccaggatatcattaaaaagaagagaaagcataggaaagaaaagaaagattatcccaatcgagggaatgttaacccccgtaaaatccagacccgtaaggaaaagtgggagaaaatgaaaatgctgcagggcccccaggatttcatta

SEQ ID NO: 712979 - DNA, 122 bp, Homo sapiens
tactctagtaggatccccagcccgagctgcgctacgctacctggtgacggcgactgcaacggccgattccgactgacccgccacttcgccggggcgacgcggtgtgacctggggcgcgcatc

SEQ ID NO: 712980 - DNA, 241 bp, Homo sapiens
ccaggcgcggaccttctcctgcatcttggtctgcaagaggcagaggtgcttggtgtcgcgcacctcgatattccgcgagcccgagatcaccgagtacggattgatcaggtcggtcgggtccagcaggttgccgcagttgtcgcattggtcgccccgcgccttctcgaagccgcaatgcggacaggtcccctcgacgtagcgatccggcaggaagcgctcgtcgtcgaccgagtagacctct

SEQ ID NO: 712981 - DNA, 641 bp, Homo sapiens
  misc_feature (641)..(641): n is a, c, g, or t
ggaaagccactgatttttttgatttaaaaaattttacagggccaggggctgttttgccaaaaagggggccaatgggtttcaaacggtttgaaagtgagggtgggggtgagggatgggccccaaaatcctttcaggaaagctgggaactgtccccagggaactggcaaggaaaaaaggccggggggggcttgctaaagcggaaatccaaaaaaaagttcaaagggtttggggaaaaaactcccaaaaacccccggagcccgtcgggggggagtcccacaatagcatttttttcttttgaaaaggacagggggggggcccctactcggctgaaaactttggatgggggctggggattgaaagcttcccagagagcatcacaagagggggtcgccccattcttgaaggcttcctaaacacccccgggactgtttggcgttggccccacaagggttttttacccatttccgaaagaggtttttattttttttttatcccaaaaactgggcaagggcaacaattaggcttgggaaaaccccttttcttccggtttttggcccggagtttaacaattccacggagggtttcccatgggttttccccaaaggggttttccaagaaatttggggcttttgggggttgtn

SEQ ID NO: 712982 - DNA, 172 bp, Homo sapiens
ccaaaaaaaaaacaaaaaaatcagccaggcatggtagtgcgtgcctgtaatcccaccactctggaggctgagacacgagaatcgcccgaacccgggaggcagaggctgcagtgagccaaaatcacgccaaagcactctagccttggtgatggagtgagactctgcctaaaaa

SEQ ID NO: 712983 - DNA, 384 bp, Homo sapiens
  misc_feature (2)..(2): n is a, c, g, or t
  misc_feature (51)..(51): n is a, c, g, or t
  misc_feature (133)..(133): n is a, c, g, or t
  misc_feature (149)..(150): n is a, c, g, or t
  misc_feature (180)..(180): n is a, c, g, or t
  misc_feature (195)..(195): n is a, c, g, or t
  misc_feature (253)..(253): n is a, c, g, or t
gngcccgtaatcgataacccccgaacctcaccacctgctcagccttttttncccctttttcagcaacccctgatgaggctacaaagtagccgcaagtcccccgtaaagacgttaggtcaaggtgtccccatgnggtggcaagaaatggnntacattttctcccccagaaaactacgatancctttatgaacttangggtcgaaggtggatttagcagtaaactgagagtagagtgcttagttgaacaggcccntgaagcgcgtacacaccgcccgtcaccctcctcaagtatacttcaaaggacatttaactaaaacccctacgcatttatatagaggagacaagtcgtaacatggtaagtgtactggaaagtgcacttggacc

SEQ ID NO: 712984 - DNA, 405 bp, Homo sapiens
  misc_feature (87)..(87): n is a, c, g, or t
  misc_feature (381)..(381): n is a, c, g, or t
gacagttacgctcgggggtatattccagctggggaactggagcgggttaaacagcgtccgtgaccacaataccatttggaagagctnctgtaaactggagcccaccctgaagaatgcaagaattgtgggtgaactcactggcttccggccagtccggcctcaggtccggctagaaagagaatggcttcattttggatcttcaagtgcagaggtcatccacaactatggtcatggaggttacgggctcacaatccacttggggttgtgcaatggaggcgggccaacctcttcgggaaaattctagaggaaaagaagttgtccaggttgcctccctcccacctctgaggactctagtgatcaccgtgtgccccaagacgactncccccccttcggccaatgatatgt

SEQ ID NO: 712985 - DNA, 724 bp, Homo sapiens
  misc_feature (483)..(483): n is a, c, g, or t
acgtcggtacccccaaatggaatctcacgctgaaaaataagtgcagttgatccggtgctccgggcttgagcggaacgttttgcgcgccgccaaggtccagatacttgtaagcccacctatgggttttatcgaggaggcaccgatgcaaacgtggcaaattaccttcgttgatgatcacggtgaaacgtccgtgcagcagttcacctgcgaacaaaagcccagcctcgaagacgctgcgcatatgattcgtgcgaagctggtgccgattgctgccaagctcgatctcaatgacctggaaggccgtaaacccgagccgacggtcaagattctcaaagaccagaacagtatccagattctcgatatttctccctccgtctaaacatttttcacgcgccacacgagcacctctggtggcggtgatagcttcacgctactctgcaatcgagatcagcgaatgaatcgctaaggtctggtcttgtcagntacatgcttgttttcctgcggtgatgttatgccgtggtgcccgcgccagcagggcgcggggcttcaggaagcacggaaagtctatccatcggtgtgaggaggacgtttcatgagcacagcctatcaagaagacatcagcaccaacgtactgcgccgcatgaaagaaggcggctttgatttctcgcgcttcaccccatcgagtctacgccattcccggatgaggaacgggccgcaggctggg

SEQ ID NO: 712986 - DNA, 248 bp, Homo sapiens
atgtatctacttatgatgcagaacatcatcaatgctgtctcccaccatggttggaaacaatgataccctggacattgtgcttcacagctaactctgcattcctctttttggttcaaaaattccctttttcaagggattgattggggccaatccgaagtttaattgccttccttgaacacccaggggagaagattaactcccaggccagaggaggaaagttggctgaattagggaggtccatccttgga

SEQ ID NO: 712987 - DNA, 202 bp, Homo sapiens
gggggggaaaaaaatgggtcccctgggggccccccccggttttgttttttgcccaaaagggggcccgggggggaaattttttccttaaggggggggtgttttgggggtttttttccccccccggttcaacccggggtgttttttttttttgggccggcccctgggggggttttttttttttaaaaggaaccctgggggccca

SEQ ID NO: 712988 - DNA, 1172 bp, Homo sapiens
gattagagtagcagcttcttcagcccaccgttccgcggggcattgtgccccaggtgttctctggttcctcctgtacctttcctggccacaccagggtgtggtaacaatcacaggacaccctgagtctcagggtcggtcatcagcctgacattctgacccccttttctgtctcttcctaatgccacagggagcctcaaatggcacggtagacatctcagcttctaaagggattatgacattgtgccctgtggcttccttccctcctttctttccttctttccttccttccttccttccttccttccttccttccttccttccttccttccttccttccttccttctttccttcctttctttcttctttctttctgagagcacaggttttgctcttgttgcccaggctggtgtacaatggcctgatcttggctcactgcaacctctgcctcctgggttcaagtgatactcctgcctcagtcttcccaagtagctgggataacaggcatgcaccatcacgcccagctaattttatatcttcagtaaagatggaggtttctgcatgtaggtcaggctagtctcgaactcccgacttcaggtgatccgactgactctggctccaaaatagctgggattacaggtgtgagccaacgatgcccagcgggcagcatttccttgcttgcattggactagacctttcacgactgctggagtcggcgaggacacggactgactaattctaagagtgcggtcattggatgccatctgaggcaatacttacctccttgtaaccaattagatcccatgaagtttttcagccctgtaagcggacacaccggcacagctggtacctgccttccactcactcaggcacagccaagcagacccttccggacactagctaacgccttggaagcgtgagggttgctcaatacatcgtgcaccgacactgtgagtatatagtagcgagcactagttactagacacctgtgtgctatcaccacgcaccggttcgatgaccactactcttatgcgaatccgcacatacttttgttgtctgtctgactcattctcacacacagcatacgaccagcggccggttcatagagcagcaccctccgtctccgagccacttcagtacgaaacattatctataatagtgcagcgggcctgtt

SEQ ID NO: 712989 - DNA, 5375 bp, Homo sapiens
  misc_feature (4597)..(4597): n is a, c, g, or t
atggccgccgacgtcttcatgtgctccccgcgccggcctcgcagccggggccgccaggtgctgctcaagccccaggtgtccgaggacgacgacgactcggacacggatgagccgtccccgccgcccgcctccggcgcggccaccccggcccgggcccacgcgagcgccgcgccaccgccgcctcgggccgggccgggccgcgaggaacctccgtggcctccagcagatcatccacagcggccacttcatggtgtcgtcgccgcaccgagagcacccgcccaagaagggctacgatttcgacacggtcaacaaacagacgtgccagacctacagcttcggcaagactagctcctgccacctgtccatcgacgcctcgctcaccaagctcttcgagtgcatgactttggcctacagtgggaagttggtgtctccaaagtggaagaatttcaagggcctgaagctacagtggagagacaagatccggctcaataatgccatctggcgggcctggtacatgcagtatctggagaagcgcaagaatcctgtgtgccactttgtgacacccctggacggctctgtggacgtagacgagcaccgccggccggaggccatcaccacggaagggaagtactggaagagccgcatcgagattgtgatccgggagtatcacaagtggagaacctacttcaagaaaaggctacagcagcacaaggatgaggacctctccagcctggtccaggacgatgacatgctgtattggcacaagcacggggatggatggaagacccccgtccccatggaggaggatcccctgctggacacagacatgctcatgtcggaattcagcgacaccctcttctccacactttcttcacaccagccggtggcctggcccaatccccgggaaatagcacatctgggaaatgcagacatgatccagccgggactgattcctttgcagcctaacctggacttcatggacacctttgagcctttccaggacctcttctcttctagccgctccatttttggctccatgctacctgcatctgcctcagcacctgtaccagatcccaacaacccacctgcacaggagagcatcctgccgaccacagccctccccactgtgagccttcctgacagcctcatcgcgccccctaccgccccatccctggctcacatggatgggcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagaccgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcatctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcngtgagtgcatgcccctctctacttctgtgcctttgtaaaacgtgtagataaccgcactggttcggctgagccaagaactctcctaaatcagtggacttatctcctccagcccttgctggggagatcatttctacacaaaatctgtgggatataaacatggctcctgctgattcagcctactctcactctgctgactacattgtcgagattctgaaccttccagactatccagggtgcccacgctgcgcagcagccctgacagagcgatgcgcgtgctcccacagaacggcccactggccaggacacgcctgcaccgcatgcgagaataccgcggaaacacacacccaggcgggacaccaacagccaccgcgccacaggcccacgcgccgccaatcaagcaggagacaaaagagatagaaaaccagtgcaaaacagcagacaccaggacaagacaaactatagccagcacgaaacccagcaccaaccaaccgaggcacacacgcggccactagcacagaccacccaggacacagcgcacagaccactgacagccacctgcagccagcacaccgcaggtgacacaggaccagcagggcggcggacagtcaacccacctacgacgccagagctgcgacccactaacgcaattaaactaacccaccgccacacgcaaccacacctgagcgcgagcaagacaccaaagcaagaagcgagagacaagcgcccatgctcaaacaagctcacacgagtgacgcgtatttagcacaactacacgacc

SEQ ID NO: 712990 - DNA, 4036 bp, Homo sapiens
atggccgccgacgtcttcatgtgctccccgcgccggcctcgcagccggggccgccaggtgctgctcaagccccaggtgtccgaggacgacgacgactcggacacggatgagccgtccccgccgcccgcctccggcgcggccaccccggcccgggcccacgcgagcgccgcgccaccgccgcctcgggccgggccgggccgcgaggaacctccgtggcctccagcagatcatccacagcggccacttcatggtgtcgtcgccgcaccgagagcacccgcccaagaagggctacgatttcgacacggtcaacaaacagacgtgccagacctacagcttcggcaagactagctcctgccacctgtccatcgacgcctcgctcaccaagctcttcgagtgcatgactttggcctacagtgggaagttggtgtctccaaagtggaagaatttcaagggcctgaagctacagtggagagacaagatccggctcaataatgccatctggcgggcctggtacatgcagtatctggagaagcgcaagaatcctgtgtgccactttgtgacacccctggacggctctgtggacgtagacgagcaccgccggccggaggccatcaccacggaagggaagtactggaagagccgcatcgagattgtgatccgggagtatcacaagtggagaacctacttcaagaaaaggctacagcagcacaaggatgaggacctctccagcctggtccaggacgatgacatgctgtattggcacaagcacggggatggatggaagacccccgtccccatggaggaggatcccctgctggacacagacatgctcatgtcggaattcagcgacaccctcttctccacactttcttcacaccagccggtggcctggcccaatccccgggaaatagcacatctgggaaatgcagacatgatccagccgggactgattcctttgcagcctaacctggacttcatggacacctttgagcctttccaggacctcttctcttctagccgctccatttttggctccatgctacctgcatctgcctcagcacctgtaccagatcccaacaacccacctgcacaggagagcatcctgccgaccacagccctccccactgtgagccttcctgacagcctcatcgcgccccctaccgccccatccctggctcacatggatgggcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagaccgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcatctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagagctttaaagtgcattctttccacgaggaggtaccctcgcccacgcgtccg

SEQ ID NO: 712991 - DNA, 5233 bp, Homo sapiens
  misc_feature (4455)..(4455): n is a, c, g, or t
atggccgccgacgtcttcatgtgctccccgcgccggcctcgcagccggggccgccaggtgctgctcaagccccaggtgtccgaggacgacgacgactcggacacggatgagccgtccccgccgcccgcctccggcgcggccaccccggcccgggcccacgcgagcgccgcgccaccgccgcctcgggccgggccgggccgcgaggaacctccgtggcctccagcagatcatccacagcggccacttcatggtgtcgtcgccgcaccgagagcacccgcccaagaagggctacgatttcgacacggtcaacaaacagacgtgccagacctacagcttcggcaagactagctcctgccacctgtccatcgacgcctcgctcaccaagctcttcgagtgcatgactttggcctacagtgggaagttggtgtctccaaagtggaagaatttcaagggcctgaagctacagtggagagacaagatccggctcaataatgccatctggcgggcctggtacatgcagtatctggagaagcgcaagaatcctgtgtgccactttgtgacacccctggacggctctgtggacgtagacgagcaccgccggccggaggccatcaccacggaagggaagtactggaagagccgcatcgagattgtgatccgggagtatcacaagtggagaacctacttcaagaaaaggctacagcagcacaaggatgaggacctctccagcctggtccaggacgatgacatgctgtattggcacaagcacggggatggatggaagacccccgtccccatggaggaggatcccctgctggacacagacatgctcatgtcggaattcagcgacaccctcttctccacactttcttcacaccagccggtggcctggcccaatccccgggaaatagcacatctgggaaatgcagacatgatccagccgggactgattcctttgcagcctaacctggacttcatggacacctttgagcctttccaggcaggagagcatcctgccgaccacagccctccccactgtgagccttcctgacagcctcatcgcgccccctaccgccccatccctggctcacatggatgggcagggctgtgaacacacctcccggactgaggacccgtttatccagcccacggacttcggtccctcagagccgccactgagtgtcccgcagcccttcctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagaccgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcatctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcngtgagtgcatgcccctctctacttctgtgcctttgtaaaacgtgtagataaccgcactggttcggctgagccaagaactctcctaaatcagtggacttatctcctccagcccttgctggggagatcatttctacacaaaatctgtgggatataaacatggctcctgctgattcagcctactctcactctgctgactacattgtcgagattctgaaccttccagactatccagggtgcccacgctgcgcagcagccctgacagagcgatgcgcgtgctcccacagaacggcccactggccaggacacgcctgcaccgcatgcgagaataccgcggaaacacacacccaggcgggacaccaacagccaccgcgccacaggcccacgcgccgccaatcaagcaggagacaaaagagatagaaaaccagtgcaaaacagcagacaccaggacaagacaaactatagccagcacgaaacccagcaccaaccaaccgaggcacacacgcggccactagcacagaccacccaggacacagcgcacagaccactgacagccacctgcagccagcacaccgcaggtgacacaggaccagcagggcggcggacagtcaacccacctacgacgccagagctgcgacccactaacgcaattaaactaacccaccgccacacgcaaccacacctgagcgcgagcaagacaccaaagcaagaagcgagagacaagcgcccatgctcaaacaagctcacacgagtgacgcgtatttagcacaactacacgacc

SEQ ID NO: 712992 - DNA, 532 bp, Homo sapiens
ccacaccgcggctaaatttgtattagttagtgaatgagtgggttaccccatgttggccaggctggtcttgaactcctgacatcaagtgatccgcccacctgtaatcccagctactcaggaggctgagtcgggaggatcacttgaacccaggaggcggaggttgcagtgagtcgagatcgcaccactgcactccagcctgggtaacagagcaagactctgtctaacataactcaattaataaatcaaatcatgcagaccgcatccccaggaggcagtctgaaatggtctcaggaaaaacaaataaccaggatgaaatcttggcagggggctccctcttgacacggggttcggaaggacaggggtttgtcgccaaacttacccaccctcctagtggcagctggaccctggacccctttaccaccaccagcctgccccttgctactcatcaccagccagctcatgtcctagacttctctgcatccctcctctctctccatccacgttgttgcctcactgtctctggccaccctgg

SEQ ID NO: 712993 - DNA, 187 bp, Homo sapiens
  misc_feature (76)..(76): n is a, c, g, or t
  misc_feature (83)..(83): n is a, c, g, or t
tgtatggagtttacaccaggtgagttagcttatgggaggggtgctaaacactcttacgcgctctatgacttggtancgtgtgncgccggtggtgcacgaaattgacaccctggggtagtatagctagtaacttcgtttatggtagatatagaagagtgccttttgggtacgagctcgaatcgaaatc

SEQ ID NO: 712994 - DNA, 156 bp, Homo sapiens
agcaacggcagtcagcagcagcacacgacgtttcatgaaggtctccaaaggttgactcggcaagcgtgggcctggacactcggggcagtggcgtcgcctgcgcgtggcgacgatcctaaaggcttcgtgttcgcattgcaaccgagtgttcgtata

SEQ ID NO: 712995 - DNA, 4918 bp, Homo sapiens
  misc_feature (4140)..(4140): n is a, c, g, or t
tgtctcagtttcgggacggacgctccctctgtggggtttcccgctggattgcctaaggcctgattgtagtgccggatactcagtacaccagttgagctttgctaatcaagcagagccccctcttcactctgctctctgtccctgtcctaggccatcaccacggaagggaagtactggaagagccgcatcgagattgtgatccgggagtatcacaagtggagaacctacttcaagaaaaggctacagcagcacaaggatgaggacctctccagcctggtccaggacgatgacatgctgtattggcacaagcacggggatggatggaagacccccgtccccatggaggaggatcccctgctggacacagacatgctcatgtcggaattcagcgacaccctcttctccacactttcttcacaccagccggtggcctggcccaatccccgggaaatagcacatctgggaaatgcagacatgatccagccgggactgattcctttgcagcctaacctggacttcatggacacctttgagcctttccaggacctcttctcttctagccgctccatttttggctccatgctacctgcatctgcctcagcacctgtaccagatcccaacaacccacctgcacaggagagcatcctgccgaccacagccctccccactgtgagccttcctgacagcctcatcgcgccccctaccgccccatccctggctcacatggatgggcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagaccgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcatctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcngtgagtgcatgcccctctctacttctgtgcctttgtaaaacgtgtagataaccgcactggttcggctgagccaagaactctcctaaatcagtggacttatctcctccagcccttgctggggagatcatttctacacaaaatctgtgggatataaacatggctcctgctgattcagcctactctcactctgctgactacattgtcgagattctgaaccttccagactatccagggtgcccacgctgcgcagcagccctgacagagcgatgcgcgtgctcccacagaacggcccactggccaggacacgcctgcaccgcatgcgagaataccgcggaaacacacacccaggcgggacaccaacagccaccgcgccacaggcccacgcgccgccaatcaagcaggagacaaaagagatagaaaaccagtgcaaaacagcagacaccaggacaagacaaactatagccagcacgaaacccagcaccaaccaaccgaggcacacacgcggccactagcacagaccacccaggacacagcgcacagaccactgacagccacctgcagccagcacaccgcaggtgacacaggaccagcagggcggcggacagtcaacccacctacgacgccagagctgcgacccactaacgcaattaaactaacccaccgccacacgcaaccacacctgagcgcgagcaagacaccaaagcaagaagcgagagacaagcgcccatgctcaaacaagctcacacgagtgacgcgtatttagcacaactacacgacc

SEQ ID NO: 712996 - DNA, 3745 bp, Homo sapiens
  misc_feature (3637)..(3637): n is a, c, g, or t
  misc_feature (3653)..(3653): n is a, c, g, or t
  misc_feature (3681)..(3681): n is a, c, g, or t
  misc_feature (3705)..(3705): n is a, c, g, or t
  misc_feature (3736)..(3736): n is a, c, g, or t
atggccgccgacgtcttcatgtgctccccgcgccggcctcgcagccggggccgccaggtgctgctcaagccccaggtgtccgaggacgacgacgactcggacacggatgagccgtccccgccgcccgcctccggcgcggccaccccggcccgggcccacgcgagcgccgcgccaccgccgcctcgggccgggccgggccgcgaggaacctccgtggcctccagcagatcatccacagcggccacttcatggtgtcgtcgccgcaccgagagcacccgcccaagaagggctacgatttcgacacggtcaacaaacagacgtgccagacctacagcttcggcaagactagctcctgccacctgtccatcgacgcctcgctcaccaagctcttcgagtgcatgactttggcctacagtgggaagttggtgtctccaaagtggaagaatttcaagggcctgaagctacagtggagagacaagatccggctcaataatgccatctggcgggcctggtacatgcagtatctggagaagcgcaagaatcctgtgtgccactttgtgacacccctggacggctctgtggacgtagacgagcaccgccggccggaggccatcaccacggaagggaagtactggaagagccgcatcgagattgtgatccgggagtatcacaagtggagaacctacttcaagaaaaggctacagcagcacaaggatgaggacctctccagcctggtccaggacgatgacatgctgtattggcacaagcacggggatggatggaagacccccgtccccatggaggaggatcccctgctggacacagacatgctcatgtcggaattcagcgacaccctcttctccacactttcttcacaccagccggtggcctggcccaatccccgggaaatagcacatctgggaaatgcagacatgatccagccgggactgattcctttgcagcctaacctggacttcatggacacctttgagcctttccaggacctcttctcttctagccgctccatttttggctccatgctacctgcatctgcctcagcacctgtaccagatcccaacaacccacctgcacaggagagcatcctgccgaccacagccctccccactgtgagccttcctgacagcctcatcgcgccccctaccgccccatccctggctcacatggatgggcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagaccgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcatctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttgggcttccaaccttgcaagcttggttggacaagaatcaaaagccattgttccctggtngggggaagcctttaanaaaacccccttggaaagtttcttaagtnggtcttggaaaaaagaaatccagnaactttcccacccgtttcccttggcttggtncaagcccct

SEQ ID NO: 712997 - DNA, 5683 bp, Homo sapiens
  misc_feature (811)..(811): n is a, c, g, or t
  misc_feature (816)..(816): n is a, c, g, or t
  misc_feature (818)..(818): n is a, c, g, or t
  misc_feature (820)..(820): n is a, c, g, or t
  misc_feature (4905)..(4905): n is a, c, g, or t
atggccgccgacgtcttcatgtgctccccgcgccggcctcgcagccggggccgccaggtgctgctcaagccccaggtgtccgaggacgacgacgactcggacacggatgagccgtccccgccgcccgcctccggcgcggccaccccggcccgggcccacgcgagcgccgcgccaccgccgcctcgggccgggccgggccgcgaggaacctccgtggcctccagcagatcatccacagcggccacttcatggtgtcgtcgccgcaccgagagcacccgcccaagaagggctacgatttcgacacggtcaacaaacagacgtgccagacctacagcttcggcaagactagctcctgccacctgtccatcgacgcctcgctcaccaagctcttcgagtgcatgactttggcctacagtgggaagttggtgtctccaaagtggaagaatttcaagggcctgaagctacagtggagagacaagatccggctcaataatgccatctggcgggcctggtacatgcagtatctggagaagcgcaagaatcctgtgtgccactttgtgacacccctggacggctctgtggacgtagacgagcaccgccggccggaggccatcaccacggaagggaagtactggaagagccgcatcgagattgtgatccgggagtatcacaagtggagaacctacttcaagaaaaggctacagcagcacaaggatgaggacctctccagcctggtccaggtgggtgagcctgggagctctgaggacccccacttgacatgagacagcagggacttcggtggcccaccaggnagccntncnaggcggcaggccatgggccctccctggagtctcaggaatggctcaagaagcagtccagctctctctcctgggtgggctggagggagccgctctccaaatgcctccaccctgctgcctcacttccacggagcacccctttgacgaatttccccaggtgacaggcgtgggaattcttcgtcccactgttactctttgatgcttcctcccctgtgttggtgttgtgttaggacgatgacatgctgtattggcacaagcacggggatggatggaagacccccgtccccatggaggaggatcccctgctggacacagacatgctcatgtcggaattcagcgacaccctcttctccacactttcttcacaccagccggtggcctggcccaatccccgggaaatagcacatctgggaaatgcagacatgatccagccgggactgattcctttgcagcctaacctggacttcatggacacctttgagcctttccaggacctcttctcttctagccgctccatttttggctccatgctacctgcatctgcctcagcacctgtaccagatcccaacaacccacctgcacaggagagcatcctgccgaccacagccctccccactgtgagccttcctgacagcctcatcgcgccccctaccgccccatccctggctcacatggatgggcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagaccgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcatctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcngtgagtgcatgcccctctctacttctgtgcctttgtaaaacgtgtagataaccgcactggttcggctgagccaagaactctcctaaatcagtggacttatctcctccagcccttgctggggagatcatttctacacaaaatctgtgggatataaacatggctcctgctgattcagcctactctcactctgctgactacattgtcgagattctgaaccttccagactatccagggtgcccacgctgcgcagcagccctgacagagcgatgcgcgtgctcccacagaacggcccactggccaggacacgcctgcaccgcatgcgagaataccgcggaaacacacacccaggcgggacaccaacagccaccgcgccacaggcccacgcgccgccaatcaagcaggagacaaaagagatagaaaaccagtgcaaaacagcagacaccaggacaagacaaactatagccagcacgaaacccagcaccaaccaaccgaggcacacacgcggccactagcacagaccacccaggacacagcgcacagaccactgacagccacctgcagccagcacaccgcaggtgacacaggaccagcagggcggcggacagtcaacccacctacgacgccagagctgcgacccactaacgcaattaaactaacccaccgccacacgcaaccacacctgagcgcgagcaagacaccaaagcaagaagcgagagacaagcgcccatgctcaaacaagctcacacgagtgacgcgtatttagcacaactacacgacc

SEQ ID NO: 712998 - DNA, 5197 bp, Homo sapiens
  misc_feature (811)..(811): n is a, c, g, or t
  misc_feature (816)..(816): n is a, c, g, or t
  misc_feature (818)..(818): n is a, c, g, or t
  misc_feature (820)..(820): n is a, c, g, or t
  misc_feature (4419)..(4419): n is a, c, g, or t
atggccgccgacgtcttcatgtgctccccgcgccggcctcgcagccggggccgccaggtgctgctcaagccccaggtgtccgaggacgacgacgactcggacacggatgagccgtccccgccgcccgcctccggcgcggccaccccggcccgggcccacgcgagcgccgcgccaccgccgcctcgggccgggccgggccgcgaggaacctccgtggcctccagcagatcatccacagcggccacttcatggtgtcgtcgccgcaccgagagcacccgcccaagaagggctacgatttcgacacggtcaacaaacagacgtgccagacctacagcttcggcaagactagctcctgccacctgtccatcgacgcctcgctcaccaagctcttcgagtgcatgactttggcctacagtgggaagttggtgtctccaaagtggaagaatttcaagggcctgaagctacagtggagagacaagatccggctcaataatgccatctggcgggcctggtacatgcagtatctggagaagcgcaagaatcctgtgtgccactttgtgacacccctggacggctctgtggacgtagacgagcaccgccggccggaggccatcaccacggaagggaagtactggaagagccgcatcgagattgtgatccgggagtatcacaagtggagaacctacttcaagaaaaggctacagcagcacaaggatgaggacctctccagcctggtccaggtgggtgagcctgggagctctgaggacccccacttgacatgagacagcagggacttcggtggcccaccaggnagccntncnaggacctcttctcttctagccgctccatttttggctccatgctacctgcatctgcctcagcacctgtaccagatcccaacaacccacctgcacaggagagcatcctgccgaccacagccctccccactgtgagccttcctgacagcctcatcgcgccccctaccgccccatccctggctcacatggatgggcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagaccgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcatctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcngtgagtgcatgcccctctctacttctgtgcctttgtaaaacgtgtagataaccgcactggttcggctgagccaagaactctcctaaatcagtggacttatctcctccagcccttgctggggagatcatttctacacaaaatctgtgggatataaacatggctcctgctgattcagcctactctcactctgctgactacattgtcgagattctgaaccttccagactatccagggtgcccacgctgcgcagcagccctgacagagcgatgcgcgtgctcccacagaacggcccactggccaggacacgcctgcaccgcatgcgagaataccgcggaaacacacacccaggcgggacaccaacagccaccgcgccacaggcccacgcgccgccaatcaagcaggagacaaaagagatagaaaaccagtgcaaaacagcagacaccaggacaagacaaactatagccagcacgaaacccagcaccaaccaaccgaggcacacacgcggccactagcacagaccacccaggacacagcgcacagaccactgacagccacctgcagccagcacaccgcaggtgacacaggaccagcagggcggcggacagtcaacccacctacgacgccagagctgcgacccactaacgcaattaaactaacccaccgccacacgcaaccacacctgagcgcgagcaagacaccaaagcaagaagcgagagacaagcgcccatgctcaaacaagctcacacgagtgacgcgtatttagcacaactacacgacc

SEQ ID NO: 712999 - DNA, 640 bp, Homo sapiens
acagtgtgagcagaacagatgggtatgtgctagagggcaaatagttgaagttctatctaaggaaaatcaaggcccgcaagggcatataaatccttgtgatgtccacacccatgcaaagctaggaaaccgaagcgtacagaacgtatgtccgacactgcacgccagagagaacaattactagaaaccaatcaaggagggagtccagagcgagcatagataataaaataacgcccacgaacatgcattacaaaaagcaaacactccgtgaagcaaacaaacaacagcagtgcgaagatctgacacaccaacaataaaaaaaacagccccgcgcgcgtgaagaaaccaacgcacgagtcttctgaaagcaaaccaacccagaatgaggagcgagcacagagaacgcaacaaacgaggcgggctgtaacataaaccagcaggcgaaccaacaagcaaggaccacagcctaataaagaaaagaatagtccgccccccaagacgcagattggatagcagcaaggacaggacgagcacgaacacaacagtagccaagacagtacagaagagctagacagaacgaagcctcagtaagacgagacaacatagaacagatcaagaaatgaacctagtaagaacgaacagt

SEQ ID NO: 713000 - DNA, 4941 bp, Homo sapiens
  misc_feature (176)..(176): n is a, c, g, or t
  misc_feature (4163)..(4163): n is a, c, g, or t
tggattactagttatatcacttctgtatatggtctgtcacgtttgactaagcaattccttatagttgcttacaggtgcttggggctacagagctgagtgaggtaccattctttgtccttacggagccctcatgcttatgcccatgaccagttagacactggtaacctggcaccatnttcaaacgggctccgggaagaattgctactgcagagactgggatctgaaccattgattcctcgtagcttttcttatttaggaagaggtggcctgatgaccagttgacacgtgaaattgtcctcggggattcccgagcagctgcaatccaggctgcctctgctcagtaatagaagatggcagagactttggggagactctgctggactccagaaacaagatattcccaggctgctagccagctgtgtgagggccgttgccttatctgagctctgagttatttagtttttaatggaaacaagacccccgcagacacgcagggaaacacaaatccctatcagatcagcagccatggacgtggagacgtggcctttgtccctctgtcccagcgcccggcctgtgtagttggacttggcagtgtgcagcgctagaaaggaattgtctgaccccagcattgcttcctggctcctttcttcctttttcaggagagcatcctgccgaccacagccctccccactgtgagccttcctgacagcctcatcgcgccccctaccgccccatccctggctcacatggatgggcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagaccgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcatctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcngtgagtgcatgcccctctctacttctgtgcctttgtaaaacgtgtagataaccgcactggttcggctgagccaagaactctcctaaatcagtggacttatctcctccagcccttgctggggagatcatttctacacaaaatctgtgggatataaacatggctcctgctgattcagcctactctcactctgctgactacattgtcgagattctgaaccttccagactatccagggtgcccacgctgcgcagcagccctgacagagcgatgcgcgtgctcccacagaacggcccactggccaggacacgcctgcaccgcatgcgagaataccgcggaaacacacacccaggcgggacaccaacagccaccgcgccacaggcccacgcgccgccaatcaagcaggagacaaaagagatagaaaaccagtgcaaaacagcagacaccaggacaagacaaactatagccagcacgaaacccagcaccaaccaaccgaggcacacacgcggccactagcacagaccacccaggacacagcgcacagaccactgacagccacctgcagccagcacaccgcaggtgacacaggaccagcagggcggcggacagtcaacccacctacgacgccagagctgcgacccactaacgcaattaaactaacccaccgccacacgcaaccacacctgagcgcgagcaagacaccaaagcaagaagcgagagacaagcgcccatgctcaaacaagctcacacgagtgacgcgtatttagcacaactacacgacc

SEQ ID NO: 713001 - DNA, 424 bp, Homo sapiens
ctcgagctgggtacctgttgatcgcgcgaaacggtcgcggacaatatcgccggcaaagcgcatgatcgccatggtcatggagaaagctggaagccaaaaccagcgaccgtaactgacgcacccatttcatcgcgcagactatatgcaccccaatcaagtatcgcgccctccggggtcatcgagaacaatgcgataatgccgaccagccatggcagcgcattgcgcggcagcaccagcttctgcttctcgccgcttggatggtgaaacttgtccgcaacaatcgaaggccatgcaaaaatcagcaatcctgctgccacaagggtcgcaatcagcgcatgaatagtcgagccgacatgcgcgatgagaaagccaccagttgctgccccgatcaatccgccaaggctccagaatgcatgacaggacg

SEQ ID NO: 713002 - DNA, 4551 bp, Homo sapiens
  misc_feature (3773)..(3773): n is a, c, g, or t
atggccgccgacgtcttcatgtgctccccgcgccggcctcgcagccggggccgccaggtgctgctcaagccccaggtgtccgaggacgacgacgactcggacacggatgagccgtccccgccgcccgcctccggcgcggccaccccggcccgggcccacgcgagcgccgcgccaccgccgcctcgggccgggccgggccgcgaggaacctccgtggcctccagcagatcatccacagcggccacttcatggtgtcgtcgccgcaccgagagcacccgcccaagaagggctacgatttcgacacggtcaacaaacagacgtgccagacctacagcttcggcaagactagctcctgccacctgtccatcgacgcctcgctcaccaagctcttcgagtgcatgactttggcctacagtgggaagttggtgtctccaaagtggaagaatttcaagggcctgaagctacagtggagagacaagatccggctcaataatgccatctggcgggcctggtacatgcagtatctggagaagcgcaagaatcctgtgtgccactttgtgacacccctggacggctctgtggacgtagacgagcaccgccggccggaggccatcaccacggaagggaagtactggaagagccgcatcgagattgtgatccgggagtatcacaagtggagaacctacttcaagaaaaggctacagcagcacaaggatgaggacctctccagcctggtccaggacgatgacatgctgtattggcacaagcacggggatggatggaagacccccgtccccatggaggaggatcccctgctggacacagacatgctcatgtcggaattcagcgacaccctcttctccacactttcttcacaccagccggtggcctggcccaatccccgggaaatagcacatctgggaaatgcagacatgatccagccgggactgattcctttgcagcctaacctggacttcatggacacctttgagcctttccaggacctcttctcttctagccgctccatttttggctccatgctacctgcatctgcctcagcacctgtaccagatcccaacaacccacctgcacaggagagcatcctgccgaccacagccctccccactgtgagccttcctgacagcctcatcgcgccccctaccgccccatccctggctcacatggatgggcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagaccgtggagtacatcaccaagctgctcctgtcctgaggcccagccttgtccctcctgccacgtcctgtccacatgcatgcctctgcctgatgccctgctccactctctggtctgcccgtggggcagttggaaggcatctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcngtgagtgcatgcccctctctacttctgtgcctttgtaaaacgtgtagataaccgcactggttcggctgagccaagaactctcctaaatcagtggacttatctcctccagcccttgctggggagatcatttctacacaaaatctgtgggatataaacatggctcctgctgattcagcctactctcactctgctgactacattgtcgagattctgaaccttccagactatccagggtgcccacgctgcgcagcagccctgacagagcgatgcgcgtgctcccacagaacggcccactggccaggacacgcctgcaccgcatgcgagaataccgcggaaacacacacccaggcgggacaccaacagccaccgcgccacaggcccacgcgccgccaatcaagcaggagacaaaagagatagaaaaccagtgcaaaacagcagacaccaggacaagacaaactatagccagcacgaaacccagcaccaaccaaccgaggcacacacgcggccactagcacagaccacccaggacacagcgcacagaccactgacagccacctgcagccagcacaccgcaggtgacacaggaccagcagggcggcggacagtcaacccacctacgacgccagagctgcgacccactaacgcaattaaactaacccaccgccacacgcaaccacacctgagcgcgagcaagacaccaaagcaagaagcgagagacaagcgcccatgctcaaacaagctcacacgagtgacgcgtatttagcacaactacacgacc

SEQ ID NO: 713003 - DNA, 190 bp, Homo sapiens
gccttccgggcaaaggatgtcctcagtgtgtatggaggcatggacgaatagacggtttctactatggcgcattaactggagcaaggggcctggtatccatccaacttcctggagggccctgggcctgaggcaggcggactggacagggaacccaggacaacccaggctgagagtcagagaacgaggagga

SEQ ID NO: 713004 - DNA, 2065 bp, Homo sapiens
  misc_feature (1)..(1): n is a, c, g, or t
  misc_feature (10)..(10): n is a, c, g, or t
  misc_feature (32)..(33): n is a, c, g, or t
  misc_feature (40)..(40): n is a, c, g, or t
  misc_feature (50)..(50): n is a, c, g, or t
  misc_feature (1287)..(1287): n is a, c, g, or t
ncatttatcngcttgaatagaagccatgtccnnccacaanggctgggtgntgtcagagttgaggggagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcngtgagtgcatgcccctctctacttctgtgcctttgtaaaacgtgtagataaccgcactggttcggctgagccaagaactctcctaaatcagtggacttatctcctccagcccttgctggggagatcatttctacacaaaatctgtgggatataaacatggctcctgctgattcagcctactctcactctgctgactacattgtcgagattctgaaccttccagactatccagggtgcccacgctgcgcagcagccctgacagagcgatgcgcgtgctcccacagaacggcccactggccaggacacgcctgcaccgcatgcgagaataccgcggaaacacacacccaggcgggacaccaacagccaccgcgccacaggcccacgcgccgccaatcaagcaggagacaaaagagatagaaaaccagtgcaaaacagcagacaccaggacaagacaaactatagccagcacgaaacccagcaccaaccaaccgaggcacacacgcggccactagcacagaccacccaggacacagcgcacagaccactgacagccacctgcagccagcacaccgcaggtgacacaggaccagcagggcggcggacagtcaacccacctacgacgccagagctgcgacccactaacgcaattaaactaacccaccgccacacgcaaccacacctgagcgcgagcaagacaccaaagcaagaagcgagagacaagcgcccatgctcaaacaagctcacacgagtgacgcgtatttagcacaactacacgacc

SEQ ID NO: 713005 - DNA, 277 bp, Homo sapiens
  misc_feature (12)..(12): n is a, c, g, or t
  misc_feature (112)..(112): n is a, c, g, or t
  misc_feature (213)..(213): n is a, c, g, or t
  misc_feature (238)..(238): n is a, c, g, or t
ctacgtagttancgagaaatggattggtaacttaaaattagaagaaacacaccttcaaacttcaacttctttaaaagaaaaaaaaaaaacggtcctatctggttctggtaanaatattagaagcgcttggttttacaaaagaatgatgaagagaattcttccacagtgtacttctggtgcttagaaacatttttacgggaccttaagcgcggngagacgtggctggcagtcggcgggngttttttttttcatacacccgagcacggaagtatgtagt

SEQ ID NO: 713006 - DNA, 513 bp, Homo sapiens
  misc_feature (1)..(1): n is a, c, g, or t
nagtgcatggctggggaggctctatgaaacttaccataatggtgggaggtgaaggagaagcaaggtgtcttctttataaggtggcaggaaggagaagggctgagtgaagggggaagagcgccttataaaaccatcagatcttgtgagaactcagtatcatgagaacagcatggggtaaactgcccccataattcaattacctccacctggtctctaccttgacacgtggggatgataggcattatggggtttacaattcatgatgagatttgggtgggaagacaaagcctacccatatcaatggctcactgcagcctcaatctcccaggcacaagtgattctcccagcctcctgagtggctgggaccacagtactgcgagaccactcacagttcatttttgtattttttgtagagatggggtctcacaatgttgctcaggctgcgctcagacgatttgcctgcctcagcatcccaaagcactgggattacaggtgtgagccattgcactccgg

SEQ ID NO: 713007 - DNA, 116 bp, Homo sapiens
tgctgggattacaacgtgtgagccaccacacctggcctggaaggaacctcttaaaatcagtttacgtcttgtatctcgctctgtgatgcaggacactggagagagttgctatgcca

SEQ ID NO: 713008 - DNA, 313 bp, Homo sapiens
cgcgaaatgaggtttggttaggtcatgtgactatcccaagacacttttttttttaaacggaatttcgctctatcttgcccaggctagagtgcaatggcgcgatctcggctcactgcaacctccatctcccaggttcaagcgattctcctgcctcagcctcccaagtagctgggattacaggcatgcgccatcatgcctggctaattttgtgtttttagtagagacggggtttctccatgttggtcaggctggtcttgaactcccaacctcaggtgatcctcctgtcttggcctcccaccgtgcttatctcact

SEQ ID NO: 713009 - DNA, 717 bp, Homo sapiens
agcgggatctaagctcgtgagactgacgaacctacttaaaagctatggcacaaggcactggacgattgagctaggtgggcacaacagagcagtgtcgtcatttgtgcaacaacattgacaaacaagcagataataacgacacttgaccggaacggatacgaccgaagatagcgggagctgttctctcaatcagccccggcagcggcggaccagaatgagacgcgctgtgcaacccatagaccccggaccaagacattgacctacagaattagacgcaggtggcaggatccatcaacttaggacgtacacctgtgaggacgagaccgtaagcatgatgatgcatacgatggacataacctggggaaacgtcgagaaccaaggacagaaaacatatcgacaaaataaataccaagagacgatgactgcacctatctagaggcagagaaaaaagagaacatccacctgaattcaacaagagcacataaagacagagacaatccgtcggaaaaagcacagtaacatgggaagaaactaaataggtaaaaagaaacgccagggactagaacgagaataagcgacaaaaaaatgcacaagaagagagcatagacataccaagcaacatcacaccccacaagacacccagacagggccaaagacaagcagccacactaggaccagtaaaacccacaaaacgcactaacagaaacgaacaaaaag

SEQ ID NO: 713010 - DNA, 789 bp, Homo sapiens
  misc_feature (675)..(675): n is a, c, g, or t
  misc_feature (704)..(704): n is a, c, g, or t
  misc_feature (725)..(725): n is a, c, g, or t
agcgggaactgccaggcagcagcagccttccctgcccaggcctgactgaagatccaggctccagacacttctgttcattatcccccgggatccctcccctaaaagtcccaactgccacccagcacggtggcctagcccagaaccagctcacaagggtgcccatcatccaacaggccggcggcctcgagcaaaaggggtgtctcccctggggggctgaactgtcctgggcaggtcctgcgccctccgcagtctctgccaccgaggccacccagccagcctcgtgtcactcacacctgaaaaatgcacaaaggccccggaggcataacagctatgcaccaccacagggaaacaaagggagttttacaccctgaaaacagccgtcttgcacacttctgattttatgggcttaaagaaatgtgtttgtttcatcaaaacaataagtgccttcgatgacgcatgtcactcactggaccccgcgctggctgcctcgcttagtcctgctggagacccccataccttttcgatatgcaatataattaatcaatacatcctggagcattgcagagaatgccacccagcaaaataggagctgtccccagcaccagagagggaggccccgcccctcaaagcaccgcagggcatcagcaagcccctccctctcgtttaactaggccnccccctttgtaagacagctgtaggcgcantcagaaaatcacctgcatttntttccactgaagtaaaaatacctgaaatgaaaacttatcttctgaatttttcacccttgccgct

SEQ ID NO: 713011 - DNA, 215 bp, Homo sapiens
gttaaaggaaacaataaagacattactggccagtgctaacttggaagaagtcacaatgaaacagatttgcaaaaaggtctatgacagttatcctacttatgatttaacttgacagagcaagatttcataaagacaactgtaaagcagctaatttcttgagatagaggacagagagatgactcgttccatagagttgaggtctgatttctaccatt

SEQ ID NO: 713012 - DNA, 172 bp, Homo sapiens
atctcacacttgttcatctccaggccacgtttgcggcctgtagcccatgccccgctggaactccttggtggctgaacatggagagatagtgcaggagaggggcctcggaaataatctcaaagtaccggattgagctgtcacccttgcgacagcggtagacgattttggatag

SEQ ID NO: 713013 - DNA, 259 bp, Homo sapiens
tggaccttccaagtagctgggaccacaggcatgcgccaccatgccaggttaattttttgtatttttttttggtagagatggggtttctccatgttgcctaggctcatcttgaactcctgagctcaggcgatctgcctgcctcggcctcccaaagtgctgggattataggagtgaatcaccgtacccggcctcattactatgttttctaaagttgttccattcctacctttctcctcgaagcccctcagcttcaaatatt

SEQ ID NO: 713014 - DNA, 293 bp, Homo sapiens
  misc_feature (158)..(158): n is a, c, g, or t
aactctaaaactaggcctagttttggaagtttcaatagcataaaacattccaagaagtgaagagtgatctataatacccaagttctatgtgcaactaccagttaaacaaggaaaacattggctgtatcattctgtttgacaaccagtataaacccagnagaatcaagatctgattccttttccacacatctgctatggaaacttctaaaactaggtaccacagcggaaggggatttgggactggtggcagccaaagggtggtggggaaggagcatgaatatgaactatgactg

SEQ ID NO: 713015 - DNA, 318 bp, Homo sapiens
aatcgtcgcgcatgacaaacgaccccgatagtagagaggatataccgcaagcaacgcgcgcagctcgttactgattacggtttacaaccgaagatggacaaaggaaagggctcacagaagctccaccctctggaggtccataaaaggaaaaggtggctgggtggccacacctcttcctttctgaggacaggtacggccaacagatgaaggggcccgctgaggaagcaggtgagggcggactcggacacaacggcggcgccagccctgagaagcatggtaaggcttgcccagagccaccagctatgcaccgggagacca

SEQ ID NO: 713016 - DNA, 1260 bp, Homo sapiens
gtcacctgacgtatgcatcctattttaagggtacagcgtagttaatggagagtacataagacctaatccttgatgactttaaggggaaatattggtgctttagctgtatatcctttggatttcaccatgtgagtgtccttacagaaattgtgcttttagtgacataatgctaacgtattgagcgatgtgaactgtgaagcttgtcgcagctctcaaatggattcccaggtttataccatcttgactggataaatacaccaagaaagaatggtggtatgggccattcatgaacatcgtacttctgtcagacttaactaagcagatttcccgagactacggcgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctatactaaagtagagcaacacacattgaaagcttctgatcaacggtcctgaaattttcatcttgaatgtctttgtattaaactgaatttcttttaagctaacaaagatcataattttcaaatggattaggccggtgtaatcctggcaatgaatgttatgggattgagcaaatgtgatcggattatttacaaagtggagagtgattaatgatatgatgatcttaatcctgaatgggtaaggtgccataactaattataataggaagtggcaatattcagaatgaggtagataagatataagcgggggggaatagtggggctgtaaaaatataaaaaaaagg

SEQ ID NO: 713017 - DNA, 987 bp, Homo sapiens
tataaaaccttggggccaaaaataaatataaaaatgggcttaaggggggttggaccccccttttgggcaaaattaaaaattcccccattatggtcaaaattttccctcaggcggcctgttctttatggtgtgcggtcttataattgtagtatcattggttttaggaaattcggcgcgccttctgtcccccccgcggtctggccgtatcggccagggagggcgtatactctcggcaccctcttctgccccgcccgcgtttcacaagaccgatattcttctcgtgccactccagactccccgcgaaacaccagtctgataatcaacgagcgctgccggccccccccaccccaacgttggctgccctccacatctcggcgtacatagtctatcagcgtcagaacacacggggtttctcagccgattgtgtgggccctaacgcgcgggaattcctcctcgcaggacaccctcacgcgggtggaactcgcgcccccctctcgggccctccaaaagagtcgtggctgggcatacagcggccgttgaaccccacgtttgttccccagcccgcaccactacaaacgccgtcttggaaaaaatcggacaaattctttgcaccaacaactcagcccccttgtggctgtgtctaaccacccccacacttttttttttcccgtgcgaacacccgcgtgttgcggcaaacaacagaagcctttgttgttcctcttgcctccaaacagacaagacaaacaacaaacccaacaagccaaagccaacgaacaacaccgaagacggggggccggcgcccacatacaaaaaccaccccctccgagcggggcgccgccacgaccatcacgacacgaccccccgcgcgctgtgtgcggtcagacaggggccgccacccaacgtacgatgagcctcgctaaaaaacacccgaacccgcgcgcgcacataacacagcccgtgcgcagacgaaccgtctccgccgcggat

SEQ ID NO: 713018 - DNA, 776 bp, Homo sapiens
gaaggttaccccagcaaagtagggaggggtactccccgacgaggagtctgatggtgccaggagcctgctgcctcgccgacgctgggagtgagccccgtgtcccgccgcgcttgccaagggttggctgcgcgtgcggcgggagtagaggcgccttgcgcaccaggaagtgacatgtattccccgccgcagcaaaccaggccatccgcatggccttatagttatgccgcctcaggtatgtaagaggatttactaggtatacagacaggaaggtggatttcagtgtgttcttatggatggcaggccttaagagaagagtccacactgcacagcctcagatacttcatctaccatggtgggtctcttcatccaaaccaggactgattccctggtatgccagaaatacacaggatggtacacagactctatactgggcacagaatgtaagggagatatcacccgtgtgatagccacgaaatgtcagaaaggacaaaaaaagtcagaagaaaccaagcattcttggaccactagatggtaacctggcgaggaaaggctggatgatgtcgtgaacacactctggagggttgatcttttgaagaaaagttcaaggtgaaaattgaagtcagaagaaaatattaaaagactagaagttaaaatcaaatgctcaatggagtcagagtgatacgggatgaccagaatatgaggtcaatgggagttcaagctataatcacttactggatcaggtacgaatagtcagatttgtgacggagctaggaaac

SEQ ID NO: 713019 - DNA, 226 bp, Homo sapiens
cgggagccttaaccctagggaagggtagatgttttgtgagggagtgataccaaaatgacccagaggaatagtagggaaataggacagttgcatggcatgtcaggatggtatcttccagaaatgagtcacactggtggtggcggaaagagacaagaaaggtggatgttatcattcaagatgatatcattcaagaattacccagaggaataggggtaagggctcccgg

SEQ ID NO: 713020 - DNA, 458 bp, Homo sapiens
  misc_feature (7)..(7): n is a, c, g, or t
  misc_feature (67)..(67): n is a, c, g, or t
  misc_feature (81)..(81): n is a, c, g, or t
  misc_feature (105)..(105): n is a, c, g, or t
  misc_feature (117)..(117): n is a, c, g, or t
  misc_feature (134)..(134): n is a, c, g, or t
  misc_feature (143)..(143): n is a, c, g, or t
  misc_feature (148)..(148): n is a, c, g, or t
  misc_feature (174)..(174): n is a, c, g, or t
  misc_feature (181)..(181): n is a, c, g, or t
  misc_feature (197)..(197): n is a, c, g, or t
  misc_feature (199)..(199): n is a, c, g, or t
  misc_feature (233)..(233): n is a, c, g, or t
  misc_feature (235)..(235): n is a, c, g, or t
  misc_feature (269)..(269): n is a, c, g, or t
  misc_feature (281)..(281): n is a, c, g, or t
  misc_feature (293)..(293): n is a, c, g, or t
  misc_feature (331)..(331): n is a, c, g, or t
  misc_feature (339)..(339): n is a, c, g, or t
  misc_feature (347)..(348): n is a, c, g, or t
  misc_feature (352)..(352): n is a, c, g, or t
  misc_feature (357)..(357): n is a, c, g, or t
  misc_feature (365)..(365): n is a, c, g, or t
  misc_feature (387)..(387): n is a, c, g, or t
  misc_feature (426)..(426): n is a, c, g, or t
gggagancttcggctcacagcagggatagcccggtggcaggggggatggggattctgaagtgtggtnaggggccttatgcncggaggtgggaaggatggggcttntgcagtgtacanaggggccttatgcaaangttgaaaantgagngtgggccctgaaatgacttgggggtntggaatntcctggtcctccctcnanttaagggcaggaaccctcaggttccaaattggtncnaatgcccgcactgctccctggccaatccaaggtnaaggtggaggantcaggagagacnaagctgggtaagttagttcctggacggggtcaacatantctggggnacacacannaaanagagngcctgganacggcgggaaggggggcaatcnccagcagccccatccccaagggccaggccagatccccanaacacacacacgcatgcacacacacatacaca

SEQ ID NO: 713021 - DNA, 1231 bp, Homo sapiens
  misc_feature (1)..(1): n is a, c, g, or t
nccctcttcgtcgttgcgcgccgattcttcttttgttgtcgtcgtttgtgtgtccatcgctgcttcgtcataatgcgtcgtcgttcgctttaccgctgcttttttgcttgtattctctcattggtgttcgctgcgtcgttcttatctttttgctccctggcccctagaaaggcgttggccgaatgatgggtcctactttccccccctcgtggtttgctcgtggccttctcgtcaagcgccccctttctaggggggctttgatttgtgtctcgtgtgtcgtttatgagggtggtccctcctcccgtctcccccctcctggacacaggtggccgtgccacccctggcaattcacaggtgttctcctgttgaccagaatcgcatggtcggaagacctccagtgtctgttctccgtatgtctggcgtattgttgagtttctactcccgtaatgggctcctccctgtggcgctgtgcgccatcccaccctggcagtcgccccggttgtcccgagagaggaatgggaggaagttgtaagctgtgagtaacgctattccagtccacggaccccctccggaccgttcttggaccaggccctgaaatgccccttgcgtgcccttggcggtctcctccggacgaccgcccaagatggtgtctccaggcccgaggccccacgggctgtaagatccttgttgtccaattgtgatcttgggtctcttgtagggaccctgggccacactgcggtgcgcccaccctggggtccccctccgcaggctggcctcttctggagctctcctgtgtgagagaatctcccttggcccggcgccaccggcccgatgtggttcctgtgcgaggccccttcggagagtgctggaggtgccctggccgtccgggccatctcgtgagtgcccgatggttcttggccacttatgacccttgtggaaaaagaaagcccctggatagctaattgggccattttagaccagaccagccaacgggaagaataatccaccaccaggagatgcgccagccacagccctgcggctcgctgccttcggcccagctccataaagtcctaggcatggaccctctgccttcccagatgccccagaaacccaagaatgaaaaccccgtggactacccccgttccagatccccacccagcacccacctatgccccttacgcccctgaaacgccccatggaggaggacgcgggaggagaagtcgccccgcca

SEQ ID NO: 713022 - DNA, 239 bp, Homo sapiens
gatccttgcacctcagccctccgaggagctgggactgcagttgcatgccaccatgcccagctagtttttggcagagatggggttttgccatgttgctcaggctggttttcgactcctgggctcatgcaatccactcgcctcggtttcccagggtgctgggattacaggtatgagtcacagtgcctggcccagtattccttttgaggagaaaattttatctgggaatctctcaaaaacat

SEQ ID NO: 713023 - DNA, 894 bp, Homo sapiens
ggggcagaaggctcttttaattaggaagagagggaggacaaaggagagccttttctttgtccattactcttagaaatgaacaggtacataatagaaaataaataattattgtggtaactgtttacacagcagtgttagagcctctctgtaggtgaaacaaaaataaatgttcttacaaaaaaaaaaaaaaaggaggcaaggattaaacatcaaggagctatattttttcgtgattttagaaaattaacgggattgacggttaaatactgtgtccgggaattcttaagaaaatggttttcatattaggcctattcagtgtagcattttatatttggcattaattttggtcaaattttgattctccactgtagggggtctctcatggacaatggttcccttgtgtacctatagaaaagcctcttgggaagatttcccgggttaataattttttacccagaagatactggggagggtccttggtatgtacctggtagattacatcccagtagggtcctatggagaaagacctgtggtcatcattaccttcattattctactgtgaacgtcattaggcgaataatatctccagagattttctacatggaattctccagtaaagttttaactgagaattcacaggtggcaaattgttggtcaatgtgtgttattctcaacagaggttggctgtggggaacaaggattggtagggagggaattggaataacccttgatggggtacacatggccaaccatgtgcaaggctcggtgttgaaaaggggggcgctttcaaactatcgggggggggacagtggaccattggggggggtgtccggccgacgaactgtgcaggtgacgtcaaaaaagggggggggggcacggagggcactacggttc

SEQ ID NO: 713024 - DNA, 326 bp, Homo sapiens
  misc_feature (7)..(7): n is a, c, g, or t
  misc_feature (272)..(272): n is a, c, g, or t
  misc_feature (322)..(322): n is a, c, g, or t
gcgaaangggggcatattctctgcagaatttctggaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttangtaaaataaaagaatagacactaaaatcatggttgatctataaattacanccta

SEQ ID NO: 713025 - DNA, 886 bp, Homo sapiens
ggcacagccagagctaaaggctagagcctggagtgccgcgcagtcgcctagaggtcctctaccggttattcctgtgccggatctacatcgcccacagggccccactgagacgtttctgcctcccttctttcttcctccgcttctttctctttccctctcgttgcagcttgccttgggagccttgcaacaggcgcacagccccggggtcgcccccaaaacccccttctggcttctgccccattcacaagcgtgcccactttaccggccatgggcgcccctccacttatctccctcccttctttctccccgactaaattgtgggcaaagacaagcaacgatggccgcattttgtggactcgcgttcgggcccttgtgcgattgcttggcctggccagagcaaccagcccaatcccgttgtgttcacaaccgtggaagagttcaggcggcaagaattaagtccaaccaaacgcaattttcccataacccaactgttggtctctcaacgtgggtcggcacccacccaggtcagcaacattaattcacacgcacacaattcgtggtttcccaccagccaatgggccgactcgctgcgggctcggtcccacagcacttagcaacattagggccctcctcctggggacagccattttccttttcgcaagaaataccccaaggcgtcctccactctcagagagggcgtaagaattagccaaccgaattcggtggcaccgcgcaatttcccggcacgctagccgcaatgagcgctggccagcaacagcgcttctgggacgacatggccttcgcagaagctggcacgtgcctgtaaccttttttgcaaaccaaaccaggtatttcgccaaaatgcgatggggcatcagtggactgc

SEQ ID NO: 713026 - DNA, 130 bp, Homo sapiens
gaggatccccgatattctttatgaaagaaatatgctagcaggccagttatcttttgaggctagtcttagtttattataaagcaaccatatcatccttatagttcttcatggtcttatgatgtgggatggg

SEQ ID NO: 713027 - DNA, 960 bp, Homo sapiens
ccgccgctccgtgcccctctctgcagcctctcctgccactctgtgggcccccgttccccctcccggtggtggggggctgcccccgtgggctgggggctggcctggttggcccggggccgggctgtagcggggctctcgggatgtgcggacgggggttggtgtggctcgcgcacgatcgtggctttcgctcggcagctctggagcttctcattaaccttttgcggagggcagattccgacggaaaatacagtaccaaagctgtccgaaatgaattcctccctttaatctcgttgtgtccgggaatcggatatgcccaaggtggactgagcgaggcatcctgttggcgggatctggcatgaggccagtaatatcaactcccaccagtggtttggggggctccctgaggcgccccaacaggtccggcccatgggaacacccccttcgtagactttgcatccctcgagtgtgggaaataggaccagaactatccgtgtaccggggttttgtttgcacaataagggatggccccaattgttggatttccttccgtggaagttggtgacgccaaggttgggtcacgagcttgttggttgtccacggcaagggcttgcagatcataatggctcttgtggtgccagattacaggctgggcaccagataggcaggagaggcaattcgctaaggaaggacgacataattaccggagcaggatactgccctttttgcattgttggtcccgtctcacaatcaacggaccttctcctggtgggtccccagggtgagcctctcccaggcattggtagtcccgggagataacccccccgggggcatacaggggacacccgaaaaaggggttcccataattcggttttattgaccccggcaaacgccttttaagcgtgccagttggatgctccatggtccctggattttcgcggtggcacgagtccccacgcgttg

SEQ ID NO: 713028 - DNA, 474 bp, Homo sapiens
gcacgagggagagtagaaaaacaagaaagaaaaaaagcaaacagtaaatacaaatgtacattttatcatcatacaacactctatttcttaccaacaacttcccaatcgtcaccatcttcaacagtcaattgagcagttttatcctgtagcttttcaactgccgcatcaactttgttttcttttgcgtctccattttgcttttcagcctcttcatcttcatcatcatcttcagtacgtaaaacatcataaacagacttctggatttttggttgctcatcagtagtctttttgttagttagagacctatccttgtaggtatttttggtttgttgaggcttaccaaactgagcacctctggcagcaccccaatccaaagccggttcttccttttctctttctcttcttggtggtcttgaggagctttggaagttggagcctctggctgcactccaatcgatatctggctcttctctt

SEQ ID NO: 713029 - DNA, 780 bp, Homo sapiens
gccatcgcgccctagtcgggtaccgaggcacgcgccgggcgtcgcgtgcgtttcgcggcgagcggaaatgacgcgagttgtgtgagccgccagtatggccgggcctatggccggcgagcactggtctacgtgcgtactgtggggagcggcgcggtgctgggtgctgcggtggcgatgctggcgcgccggcggggggcgggttcccacctgcagcaggagcgtggttgctccgaggccagcgtgacctgcgacgcctctctctccttgggcactgtgtgggcctgaggccctggcaatcgggggccaagtggcgtgaggttttgggaagcgagtcagccgtcggcggtaggcgcagttctccggggggcgaggacgcctccgatgggcggcgcggtaggaaggagtccggcggcgcgcggggcacgtcgcgggcggtccggggaaggcccggtcataacggcgctcacgcccatgacgatccccgtatgtgtttccgaacctgccggtcatcgccatcacccgcaagccggtgttcccgcgcttgatcaagcattatcgaggttaacaagagtaagaagtcggtagagactgcgtgagaaggaaagttcgtctcgacccagccttatgtcggggtcttctaaagagagatgacagcaaatgagtcggatgtggtcgagagcctggatgacatctaccacacggggacgtttgccagatccatgaaatgcaggaacttgggggacagctggcatgaatcgctgcgacccggaaaagtctata

SEQ ID NO: 713030 - DNA, 1121 bp, Homo sapiens
ggcaaagagggatttttctggaaatctgctggctcccaatccagcagacaaatgtcaacagcctagtaactggcaatccgtactgggagccagtgaagcacgcagcagcagctgtatactcccgatgacggggcagtgtgaaatgtttgcctcagcgtgacgtggccaggagctgtggtgcttgctgactactggatgctacaattactgcagaagtgggcaaggcatgtgagatggtcgtgactgccatgctcttggtgctctcacccatatggcgctagctgtgcagcatcctggtagccggcgcagtgtgagtgccagacccggcgatcacgtggtcagcactgtgagtcgactgtgaggtacaaccacatttgggtattggacctgaaggctgcgaatgaccctgtgactgtcatcctgagggatctctttcacttcagtgcaaagatgatggtcgctgtgactgcagagaaggcttcgtgggaaatcgctgtgagcagtgtgaagaaaactattgctacaatcggtcttggcctggctgccaggaatgtccagcttgttaccggctggtcaaaggataaggtgcctgatcatagagtgaagctccaggaattagagagtctcatagcaaaccttggaactggggatgagatggtgacagatcaagaccttcggaggatatgactcacatggatgggagagagggaaagttcatggagcgtccttcgtgagggaccacgaatgtaacaagatgttgagcagaatctcgctggatcgctacatgcacagtgacttacgcgctgacagggaaagtaacccgtgatcaagaaatatcacggaagaaccatcggaagaccacagggcaagcggggagacaaggcaggtccacgtgcaggacacgaaggcggacgaaggaagagcgaatcgaagaaaacagaacaccacgcgccgacgacaaggatgtaaacacaggccgagattacgaaacacaccaagggcccatgtgggaaacaggccgacggtaaacgcaacacgacgcaggacggtagggacagaacagagaacagggaaacccgccagagacgagaacaacaccggagagagacagagagcgacaa

SEQ ID NO: 713031 - DNA, 224 bp, Homo sapiens
gaattccggctctctggggaattccggctctctgggcttctgttttccttactgtaaaggctggagtgcagtggcacgatctcggctcactgcaatctctcaaccccaggagggttcaagcgattctcctgcctcagccttcccagaagctggaactacaggcgcccgccaccaggcctggctaatgttttgtatttttagtagagacggggtttcactgtgtt

SEQ ID NO: 713032 - DNA, 452 bp, Homo sapiens
  misc_feature (4)..(4): n is a, c, g, or t
  misc_feature (6)..(6): n is a, c, g, or t
  misc_feature (60)..(61): n is a, c, g, or t
  misc_feature (89)..(89): n is a, c, g, or t
  misc_feature (104)..(104): n is a, c, g, or t
  misc_feature (109)..(109): n is a, c, g, or t
  misc_feature (121)..(121): n is a, c, g, or t
  misc_feature (140)..(140): n is a, c, g, or t
  misc_feature (181)..(181): n is a, c, g, or t
  misc_feature (187)..(187): n is a, c, g, or t
  misc_feature (189)..(189): n is a, c, g, or t
  misc_feature (191)..(191): n is a, c, g, or t
  misc_feature (207)..(207): n is a, c, g, or t
  misc_feature (282)..(282): n is a, c, g, or t
  misc_feature (317)..(317): n is a, c, g, or t
  misc_feature (343)..(343): n is a, c, g, or t
  misc_feature (345)..(345): n is a, c, g, or t
  misc_feature (416)..(416): n is a, c, g, or t
gagncnccgttcgcgctgccagcagcttccgcctgctacggtcctggcaatgcacctcgnnattacatttctttacacccatttgactnactggaaacagtagntaggnagtcgttccganttgagttaaagaaagtatnggggcacttaaaaaactgagtaatcggccgcagatgtaccntcgtgntntnggacggttaaatttgnggttgtccaatggagaggtgtaacgtatattgtcttcctgtccgtccgtctgtgttgtagggtttttgctatggntaaagggtttctattacgtccttgcgatgaactgngatctatatatctttcgctgtttttntnggcctgcggggatttaaaggttgaaataaccgatgcgtagaaataatgctacaaataaacgtacatcctancgactttttttgcgtaaccattgttttagtgaatcc

SEQ ID NO: 713033 - DNA, 362 bp, Homo sapiens
  misc_feature (31)..(31): n is a, c, g, or t
  misc_feature (76)..(76): n is a, c, g, or t
  misc_feature (89)..(89): n is a, c, g, or t
  misc_feature (91)..(91): n is a, c, g, or t
  misc_feature (96)..(97): n is a, c, g, or t
  misc_feature (104)..(104): n is a, c, g, or t
  misc_feature (107)..(107): n is a, c, g, or t
  misc_feature (109)..(109): n is a, c, g, or t
  misc_feature (115)..(115): n is a, c, g, or t
  misc_feature (117)..(117): n is a, c, g, or t
  misc_feature (136)..(136): n is a, c, g, or t
  misc_feature (143)..(143): n is a, c, g, or t
  misc_feature (209)..(209): n is a, c, g, or t
  misc_feature (218)..(218): n is a, c, g, or t
  misc_feature (231)..(232): n is a, c, g, or t
  misc_feature (235)..(239): n is a, c, g, or t
  misc_feature (241)..(241): n is a, c, g, or t
  misc_feature (244)..(245): n is a, c, g, or t
ttaattaacaaaaatacaaagctctggtggntttttttgtctctcgccccccccaccaccactcctacccaaccanccccttgccacgnanccccnncccgaanccncnaccccnancccccacgctgccccaggnctcaggngaaacggtggtccaggtctctctgggggctagcagagtatgagtaggccttgcccaataccaagcngtcccggancagctcccccccnnccnnnnngnggnnggagaggatgagggccagcgagatggtctggtgccacttttcagaggacattagggagtacagctgatagacaatgacagcgccctccagcagcaggaggatgttgaggatccgcag

SEQ ID NO: 713034 - DNA, 851 bp, Homo sapiens
  misc_feature (402)..(402): n is a, c, g, or t
ccatgggccgtgtgatcccgtggcacagagcgacatgggcgccgggtctgtgttccgcgcgcacgtgaagcaccgtaactggcgctgcgcgcctggcgcgccgtggatttcgtcgtgacgtcggcactggctacactcaaggcgcatcgtcgaaggacactcatccacgacccgtggccgcggccgctgcccctcgcgctaagggaggtcgtatccagtggcatcacgctatcagagttttaaggaaagcaggactggacgctgttcatatgccgaccgatggtgctattcacagcgagtgcccaagtgaggtggtattagcgcggcgagatgagaggcgcactatgctcagagcaacttggcgcgagatttgtagcgactcgcttagtggtgacacctaantgcccattgacggagtactaaaactcgatcgtcgcgtgaccttgtgcaagcgtatgaaatgcacctagtggaggaaccccgattgaggcacaagcatgggtcgcactgtgttgcccaattcgatgcggtaacactaatttgacactagctcggtttgattgcgtactccctagcagatcgcacctgcaaggtagcgcaaaacgtaaagggaaccccagataggggtagcacaggccaatggacaccatcttgcgcgagacaatcacaaagggaaacgagcgctttcaaataccatcccgtttcgaaggaacgccaaaacccaagtaaagcgacaatggcacatagcgctcacatgggactggcctgggggactggaggccctatggggaacgggggggcaggaggtccccggaagagaactcttggaaccaaacgacattcctccccaa

SEQ ID NO: 713035 - DNA, 1194 bp, Homo sapiens
  misc_feature (102)..(102): n is a, c, g, or t
gccccccacaagtgtctgtgttgtgttgcgtgaataagttgactcccctggtccccaccgctgttgtgtcgtcgcaacggggacaagccctgtgaaatagtnggggtgggggagaatatgcacaagccaacatgaccggcagccgcacaacgaggtgggacccacacaacaaaaaggggggtttaaaaggggtggcttacacccagcaccacaagcggtttgtaataaaagatgggaacaaacaatttgtgggaggggaatttctgtttattttctcttaaggcgaaaaaaaagggggccccaaccccttttgtgggcggccccacacccccgcctgttctcttgagaagaccgcctctcaccaaaaagggggataactgtgtaaaaaaatattataggggtcacaacaatgaaaggggtgtgttgtggtgagagagagagaatatatgatctcgagttgctccccaggtataaccggtttcttcgcccactcaatagaggaaagaggtgtggggtccccacagacgtttataatgtgtgtgtgtgttggggcccacacgtatataaagatgtgtatggcacacgcgctttcgtgtatgaacaccaccactctgtttatgcgccccgcccacactggggtagaccacacagaggactttattgtgtttgttcctctgttgttgagaatgtcctgttggagatctctggactcgcctgtgtgagccccgcttctccacattcttgcgctagattttgtgttgtggttgttgtgggaaccccacaacaccacagctttgttctacagagaatagaaaggagcgcccctttatataaaatataaaagatgtcacccttgaggtaaacttcacgtatgagatgaatgaggaggtgtgtggaggctatcccctcacccctccaccccccttgggctttttattcccgagattttcccacgttttcttaaaccacggaaaatgactgatataattatctttttggaaactgacgcccttaattttttttagagggggaaataagttttcccccactcaccccagccataacgccatgtttgcaccacgccaatataatcgcccgttgtaaactactgagagtattgtatctgttctggtacacccagtaccagaatgtggaactgtcttatgaatataaataaattctatatttccttta

SEQ ID NO: 713036 - DNA, 958 bp, Homo sapiens
  misc_feature (264)..(264): n is a, c, g, or t
ggacgcgtgggtcggacgcgtgggtcgacccacgcgtcgcgtatttttttattttttttggtccaggactggactccggtcccataatttgtgctataacaaatcattccgtgtgtcaagtgtgtaaccactgtgctccacgttagtttgacactctcgtgggactcaagaaacagctctagtttaaagtatgatctcccatacataacgtggcgtgggggcacattctaactcaactgctgaaagagacacgatcacacaatnccaccttgtctggctggtattaccacggcctgggggtactctggcctttctccccttaaccctccccgctctcccaccttaccctgcgaacaacagcccttctaagcctaggggggcttcgtcagatgtagatgtgaaagagttccacaggatcgacatacctgtgtgtgggcacctacgtggcaaaggagtgctgtatggggatgattctctcgaccgtggaccccagtgagaattcgtatataaagttctttaagttgagtgcccctgttctcaaaaccacatcactcctgatcccacaacgactaccatacacaatacccgtcgcctatggccccgaatgacataggatgtgttaatcccccagtccaagatccccccatctgtaacagtggggcacttctaggggtgaaggaaatatccaaggggtctttgaccacacatatatcttactttctccccccccaagtacagttatcaatcaagaaagagagtcgatagttagcggtgtattagactacacctatcgttaccgatcacaagggatcccatattgagcacacaggtcaacgccatgcaagatatcttttacaatgagaccagttacacctttgacattaggtcacagaaaaacactcagagataacagtggtggcagtagaagccactgagagctcgcccaatgtctaaatgt

SEQ ID NO: 713037 - DNA, 327 bp, Homo sapiens
  misc_feature (52)..(53): n is a, c, g, or t
  misc_feature (55)..(55): n is a, c, g, or t
  misc_feature (57)..(59): n is a, c, g, or t
  misc_feature (61)..(61): n is a, c, g, or t
  misc_feature (63)..(63): n is a, c, g, or t
  misc_feature (66)..(69): n is a, c, g, or t
  misc_feature (72)..(72): n is a, c, g, or t
  misc_feature (76)..(77): n is a, c, g, or t
  misc_feature (267)..(267): n is a, c, g, or t
acagctcctttaatggcagtggcatgaacataacagctcctttaatggcagnnantnnntngnacnnnnagncaanntcgtgagccatgttcatgccactgccattaaaggagctgttcatgccactgccattaaaggagctgttcatgccactgccattaaaggagctgttcatgccactgccattaaaggagctgttcatgccactgccattaaaggagctgttcatgccactgccattaaaggagcggtgccgagctcgattanaggagctgttcatgccactgccaaaaaggagctgttcatgccactgccatataagagtgc

SEQ ID NO: 713038 - DNA, 392 bp, Homo sapiens
gcttttaatggcaggcatggtggcactgcacctgtatcccagctactcagaaggctgatgtcaaaggactgcttaagcccagaagttcgaggctgcagtgagccatgatgccactgccattaaaggagctgttgagccatgttcatgccactgccattaaaggagctgttcatgccactgccattaaaggagcgctcctttaatggcaggagaatggcttgagcctagaaggtggaggttgcaccgagccatgttcatgccactgccattaaaggagctgttcatgccactgccattaaaggagctgttacagctcctttaatggcaggacaatcagttgagcctaggaggtcaaggctgcagtgagccatgttcatgccactgccattaaa

SEQ ID NO: 713039 - DNA, 202 bp, Homo sapiens
tatcctaacagcatgaatgaaatctttatgattagtctatccttgggagaatgagagctaaggtactatgcctgtatttgatttgctcatacattttactggtctgatttacttatagactgcagacggttttttgttgttgtggttgttgggttttgggttttggtttttgtttttttcgagactgagtctggctctttcg

SEQ ID NO: 713040 - DNA, 211 bp, Homo sapiens
ttggggctgcttgtttccaaagaacaatgatactgaaattaggccagttataaacttcagtttctataaggcgaggagagtgaggaatctgctagaaacaagttggaagctagcacaggttggttcgtgcggtttaaggaaagacaccatctacagaatgtcaaagtgcataacaaaacagcaagtgctgactgagaagctgtggcggtcg

SEQ ID NO: 713041 - DNA, 398 bp, Homo sapiens
ctgcacggatccctacaagagaagagacgagatgatcttatttacgggggatggcgctttgtgaagtatgccttatttctcttgtcctttcgtacaggaggacattctgtagtaattgaaatccgacctggctcactccggtctgcactctcatcacgttagattttaatcgttgaacaatcgaacctttcatagcggctgcaccatccggatgtcctgatccaagcatcgaggtcgtcaaccctattgttgatcttgcttctctaatagggattgcgctgttttcccttgggtaccttgttccgttgttcgggtttttggatcgtttgagtattgtagttcgttttgactggtgcagtcttagcttgtactgctcggagtttgggttctgctcctcg

SEQ ID NO: 713042 - DNA, 832 bp, Homo sapiens
  misc_feature (832)..(832): n is a, c, g, or t
atcccagcacttgggaggccgaggcgggtggattacctaaggtcaggagttcaagaccagcctggcagcatagtgaaaccccatctctactaaaaatacaaaaattagccaggcgcagtggcacacccctgtaatcccagctactcgggaggctgagggaggagaatgcttgagcccgggagacagaggttgcagtgagtcaagatcatgccactgcactccagcctggcaacagagcgagatgtcccccccccaaaaaaaaaaagagagagactggctttcaaagaggaccaagactacggggaatttaaaacggttggctggctgggcatggtggctcacacctgtaatcccagcactttggaaggccgaggcggtggatcacctgaggtcagaagtcgagatcagcctgaccgacataagtggaaccctgtctttactaaaaataccaaaattagctgggcatgggggcggacctgtaatgcagctcctccagaggcttgaggcaggagaatgctgaacccagggtgggaggtggagtgagccaagttgcgcatgcactcagctgggcaatgtgtgaacttcttttcgaataaaattaacatagaatatgtgacttgttcattagttgcgaagactttgcaagtcagagttttagaatattcacattgatggtcagagtgcaggaactgctggagatcatttaagcacaggaccgggtgtgactatgggaaacagaaatgaaggcggcgttcaaaagggaataccggatgtttgaaccacaggggggcgagataaccagagatgacatagctcgcgtgactggtcggcn

SEQ ID NO: 713043 - DNA, 184 bp, Homo sapiens
  misc_feature (37)..(37): n is a, c, g, or t
cggtcgctctacgacggactcccccatgttgggctanctgcgggtcttgggactgtctcccccgcagacaacgggacggacctacctgtactacgtgtctttctgacgctttttacggtaaccacggacgactaacccgcctcactaactctacggtgtatgctacatacaaaaactcagacat

SEQ ID NO: 713044 - DNA, 123 bp, Homo sapiens
atttatgccggtgtggtatcaggactgtggtatgttaggtactgtttgcattataaattacagccatagggtcttctcgtcttgctgtgtcatgccgctcttcacgggcggtcaatttcactg

SEQ ID NO: 713045 - DNA, 1286 bp, Homo sapiens
gctgcagattctaaaagtaagctccaggtgtgcaagcattagcattccatggagtcgcagtacatgggtggacgctcgaggcgacgaacgctgggatcgacacgagagacaacagcaacggcgatcgaagacggacgccaggcggccgcgcaggcacggcgtgacacgtgacgagaccgtcggtaaacgtcgccacgtgacacgagacggagggccaaggacggctagtacacccgtggcagacgataagaacgagccggttaccggcgaacaaaccaagaggcagtcgtgaactacagacctacgacaagggtagaagacaaaacccacggcaaagtacactaacccctggaggccacgggcaatcacgccatagaataagacttcacagccccatcgaagactccccataggagacatgacgctcccgcgggagaatcgcaccacaaggcttaacattagggcgccgcaatggggccaaaaacatgtagacaacgcagacaaggaggccacggtaggcacggcggcgaggaaggaggaaccagcaagaaagataccgacaccgaccggtgcacacaccacgtacgccggaagacacaccagcgtggccaccgagcggcacgaggagcagaacgacccgacgacgactacgggacggagccccagcacaaacaaaaggacaaactaggcagccaccaccaaccacaacaccacgtagcgcgcgcaacatcccacccgaccaaaaaagagcgcctacacacgtatggggcggcgtgcaaccagcaggcacacacacagcgacgccacatgaacatatgggcgagacggagcacatcacgccttaccaggctgacgactcaccctcgactcaccgcccagaaacaaacactcccaagatccaccacagcagaaacgcgagactaaggagacaccaaacacgagaaagcgatattgagagagccaggagagcgctcactgcaccgacccagacaatcgcaagacagacataccaccaacagcacagctagtggaccttctcgtccctagccaacacaaacagggatgacagaacatacacacgcagtcaacacaacgaacatagacaaacgcggccgcaaacatgaaccactaccatcatgtcgaacaccagacaccgacacacacccatccgaacgacaggagaaacaacacacacaatcaccacaacactgagcagcaatggagagcatgcacacacaacaccacaccagcaggagcacacacacgccaaggaaaggatacacacc

SEQ ID NO: 713046 - DNA, 535 bp, Homo sapiens
cacacaatgcacatggctagagcctcagaatgtgccaccccttgcagaagtgcctgtcattccggagatggggccaccttggggcccacagggctggcttcttccccctcttgaaaggggaggggggagcatggcacctggcatgaggagggggtggcctcctctccatcccctgaagagctcaggcagggccttgcagagaacactcatgttccttcggggacaccggccggggaactttccctggccaggactcagcctgaaggaagctgctcctgaggcaggtatgaggtcagtgcctagggcacgtggaactggagggaggacatatcagaggggcagagctgtgggctcggtggtactctcctgcatcctggtagactcactttgctgagtcccatgcactggccctgagggtagccatgcccttgcttggcccaatttttgatcggggccatcctggagggggtggagacctgctgtcatgagctggccaggagaagctggtataaaaaagtcgagggtgggttccttt

SEQ ID NO: 713047 - DNA, 224 bp, Homo sapiens
gggcatggtggcgtgtgcctgtagtcccagccactcgggaggctgaggtgggaggatcacctgagcctggggaggatgagactgcagtgagccatgattgtaccactgtaccccagcctgggtgacagagtgagacccccgtctcaaaacaaaacaaacaaacaaaaaaaacaactaggggaagactgcacaagaaaagaaaacatagggaaaagggaaacaaa

SEQ ID NO: 713048 - DNA, 779 bp, Homo sapiens
agacccgcgggtcaaacggactggggccaagagccgggagcgcgtgcgcaaaggcaccagggcccgcccagggcgccgcgcagacggccttgggggttctgcgggccttcgggtgcgcgtctcgcctctagccatggggtccgcagcgttggagatcctgggcctggtggtgttggctgtgtgtgctcgtggggggcgtgagattgctggtgtgcgtgctgccatgtggaggtgaccgcttcctggaccacaacatcgtgacgggcagaccacctggaaggggctgtggatgtcgtgcgtggtgcagagcaccgggcacatgcagtgcaaagtgtacgactcgggtgctggctctgagcaccgaggtgcaggcgggcgggcgctcaccgtgagcgcccgtgcctgctggagtcgttgcgctcttcgtgaccctggcgggcgcgcagtgcaccactgcgtggacccgggcccggcaaggcgcgtgtggccctcaccgggaggcgtgctctaccctgtctgtgcaggagctgctggagctcgtgccactctgctgggttcggccaacatgtcgtccgacgagttgaaacgacccgtctgtgccccgggtcggaagaaggtaccgagctgggcgcagcgctctacctcgggtgggcggccacacgcagccgagaatggaaggagggagcccctgagctgggaggcgtggtcggaccggcgccgactcaagtgcccggagaaccagcgcggaggggccacggccacgggagatagacagagac

SEQ ID NO: 713049 - DNA, 434 bp, Homo sapiens
agaaaaagtggatggaaagtctcagaggtaggtggggtgtggtcacatgcacctgtaatcccagtgctttggggggccgaggtgggaggatcacttgagaccaggagttcgagatcagttgggcaacgtagtggaccctgtctctacaaaaaataattagccaggcatggtggtgtgcacctatagtcccagctactcaggaggctgaggtgggaggatggcttgaacccaggagttccaggctgcagtgagctatgattttgccactgcactgtaggctggatgacaaagcaagcccttgtttctgacatcatgatgatgatgatgatgatgatgatgatgatgattattgagacggaatttgactccagcctgggcaacaagattgaaactccatttcaaaaataaataaataaataaataaataataaata

SEQ ID NO: 713050 - DNA, 360 bp, Homo sapiens
  misc_feature (37)..(37): n is a, c, g, or t
cgtcctgatgataggggctatcagtgctcaatgcatnctctccctgcagccctatacataagttgccactacaggcatcgccgaggcccaggttcctgagctttcttagcttgtctgctaaggttttgacaaaacttttttttttttttttttaaaagacagagccttattctttgcccaggtgggagtgcaggggtgcaatctcgggtcactggtaacctcgggctccggggttcaagcaattctcaggtgtcagcctcctgagtagctgggataacaagtgtccaccaccatgtccagttaattttttcagtagagatggggatcaccatgttggccaggctggtcttgaactcctgt

SEQ ID NO: 713051 - DNA, 177 bp, Homo sapiens
gttcacatcagtgtgtaggatatgctatcacgtatgtgcatgagaagaatggagaaaatggatctatgcggatgtctgtacacacacacacacacacatacacaacaagcttgcacatgtatagaggatccgaaattccaccaatactgacgaactacaaacgtaacagcagcaggc

SEQ ID NO: 713052 - DNA, 144 bp, Homo sapiens
atggtagcttacctacatacaatcataattacacccagagagataaggtgctataccttcactgtgaactaagagtgagactacacctacatttggtggctaaatggtcagagctccctgtcagtcccaggttcagggctccgt

SEQ ID NO: 713053 - DNA, 328 bp, Homo sapiens
ttttttttcccccgggggttcccccttggaaagcggggggcccgtttttttccccttaaaacccggggcctttttttttgggggcccccccttttagtcctttcttttaaagggggaggccccctaaaaggtgaacccccgggtcaaaaattaacgggagggccccttttgggtcttttttttttccaacaccccccggggggggggcccccgcaattttttcgggtgggggcccctttttcctttttttttaattaaatttaaaaaaatttgggtccttttgggccccttgggccttttggtttaaaaaaccccggggtttttttta

SEQ ID NO: 713054 - DNA, 503 bp, Homo sapiens
  misc_feature (21)..(21): n is a, c, g, or t
  misc_feature (86)..(86): n is a, c, g, or t
  misc_feature (96)..(97): n is a, c, g, or t
  misc_feature (105)..(105): n is a, c, g, or t
  misc_feature (111)..(112): n is a, c, g, or t
  misc_feature (115)..(115): n is a, c, g, or t
  misc_feature (118)..(118): n is a, c, g, or t
  misc_feature (120)..(120): n is a, c, g, or t
  misc_feature (124)..(124): n is a, c, g, or t
  misc_feature (126)..(127): n is a, c, g, or t
  misc_feature (129)..(130): n is a, c, g, or t
  misc_feature (142)..(142): n is a, c, g, or t
  misc_feature (148)..(149): n is a, c, g, or t
  misc_feature (153)..(153): n is a, c, g, or t
  misc_feature (160)..(160): n is a, c, g, or t
  misc_feature (163)..(163): n is a, c, g, or t
  misc_feature (165)..(165): n is a, c, g, or t
  misc_feature (207)..(207): n is a, c, g, or t
  misc_feature (211)..(211): n is a, c, g, or t
  misc_feature (224)..(224): n is a, c, g, or t
  misc_feature (230)..(230): n is a, c, g, or t
  misc_feature (245)..(245): n is a, c, g, or t
  misc_feature (250)..(250): n is a, c, g, or t
  misc_feature (252)..(252): n is a, c, g, or t
  misc_feature (256)..(256): n is a, c, g, or t
  misc_feature (269)..(269): n is a, c, g, or t
  misc_feature (282)..(282): n is a, c, g, or t
  misc_feature (297)..(298): n is a, c, g, or t
  misc_feature (314)..(315): n is a, c, g, or t
  misc_feature (317)..(317): n is a, c, g, or t
  misc_feature (326)..(326): n is a, c, g, or t
  misc_feature (334)..(334): n is a, c, g, or t
  misc_feature (338)..(338): n is a, c, g, or t
  misc_feature (346)..(346): n is a, c, g, or t
  misc_feature (355)..(355): n is a, c, g, or t
  misc_feature (361)..(362): n is a, c, g, or t
  misc_feature (374)..(375): n is a, c, g, or t
  misc_feature (424)..(424): n is a, c, g, or t
  misc_feature (503)..(503): n is a, c, g, or t
acatactgttacataattctncacactgaagcataatgacaatttcctatcctgtgttaaatctaaatcagctaaccctgagatgncatcccagtnntgagttcnaccagnnatnctntngttntnntnntttttgtgtgtnttttanntttnttttttnctntnttttcttttagtttttttgttttttttttttttttttttttntttnttgtttttttttntttttntttgttttttttttnttttntntttnttttttttttttnttttttttttttnttttttttttttttnnttgttttttttttttnntnttttttttntttttttntttntttttttnttttttttnattttnnttttttgtgttnntttttttttgtaatcccagaactttgggaggctgaggcaggaggattgnttgagcccatgagtttgagaccagcctgagcaacatagtgagacctcatttccacaaaaaataaaacaaaattagctgn

SEQ ID NO: 713055 - DNA, 155 bp, Homo sapiens
agtgacccgtcactgactgtctggtgactgactgaccggtgactggtgaccgactggtgaccactgactgactacctgaccgactgactggtgactgactgacccggtgactgtgtgacactggtgactgagccgcacctgactgcgctggtgac

SEQ ID NO: 713056 - DNA, 264 bp, Homo sapiens
  misc_feature (25)..(25): n is a, c, g, or t
  misc_feature (31)..(31): n is a, c, g, or t
  misc_feature (261)..(262): n is a, c, g, or t
taaaagtgtgtacattgtttttganttttantttttgagactgggtcttgctctgtcacgtaggcgcagtgcagtggtgtgatcatggctcattgcagcctcaacctccctggctgaagcaaccctcccattttagcctcccagctacttgggaggctgaggtgggaggatcacgtgagcccaagaatccaagtcaatgtgagttactgtcacactgctgcactccagcttgagtaacagagtgagaccccatctctaacnnaa

SEQ ID NO: 713057 - DNA, 150 bp, Homo sapiens
ggcaagcagcagtatctgcagtccatagaagagcgtgagaaactggacgggctctacgagtgcattctctgatcctgctgtagcaccagctgccccagctactggtggacggagacaaatatctagggccctgcagttcttatgcagcct

SEQ ID NO: 713058 - DNA, 1212 bp, Homo sapiens
  misc_feature (1113)..(1113): n is a, c, g, or t
agactcttgtacttcctgaagtgaattcggtaagttaagtcgaagtcaaaaaagattagtgcattatgtcgaatggacagaactagctgtaacactagtactagttatcccatgcttatcctcgttcaggatcgagttaggaggtacaatagtggatgttactttcatctcgatttcgtgatgtttctaatttgcaatcattaatcttcttcctaggctctagtgcctggcgtagacggtgtaatacaatatagtagctagaacattagtcaagaatcaaacaacatgttagatttcagttaaattgtatctcttatcagttttgtcttgtgtagcggagatgttatggtgaagtccctaggtacatctagagtaatgaagtttccacttgccgttctatttactgttggtgttataatggctgattctttattctaagatattggtaaagtgggcaaggcgttagatggttggatatgtagatggttgttctttgagcaataataagacagaatataagatttctctacaatcacgcgtttccaaatgcctgctgacaaacttagcgatagggtagacagtctaactctttcatctacattcttctaaattccattggggctttccgtattgggccaggggtaataccagaagtactgtggagtcattagtccgagcttggcatctgttattaagaaatgtcgtgatgacaggggcaggagggtcatgtcagtaatacgtaagcaatttgggaagactgaagtagggcaaatggttgagaaataggcatcaggcataggggcaaagaaacaggattcataaaagaacacgaacacaggggggaggggcgctaacaaatgatccccagaggggaccaagaatacgcggaaaccagcgttgtggtacacaggggatccaaaggagaggagaaactaagacaggaaaggcgcaggcgtacacaagcaggcggcggaaaacggcagaacggggaacgcgcgagaggaaaccaccaacgcgcgggggaacaacgagcaaacacccgccaggtaaacgacgagaaacaaaaaaagacgagagctaggaacacgcgacattgtgcggcagaagaagggnaatatgagaagcaaacaaagacacacacagacacataaacagaaaagactacatacatacaaaagagaaacagcaccatcttagatacaaccacaacag

SEQ ID NO: 713059 - DNA, 128 bp, Homo sapiens
aaggctgaggcaggcagatcatgaggtcaggagttcaagaccagcctgaccaacatggtgaaaccccgtctctactaaaaatacaaaaagtgtaaaaaatacactttggaaggctgaggcaggcggat

SEQ ID NO: 713060 - DNA, 478 bp, Homo sapiens
aatataaggtttaatgtttttggatgaaccaatatggtaaatagtaggctgggcacggtggcccacgcctgtaaccccagctctttgggaggccgaggcgggcggatcacttgaggtcagcagtttgagaccagcctggccaaaatggtgaaaccctgtctttactaataatacaaactaaagaaaaagtaagaatggccgggcgcggtggctcactcctgtaatcacagcactttgggaggccgaggcgggtggatcacctgaggttgggagttcgagaccagcctgagcaacgtggagaaaccctgtctctactaaaaatacaaaattagccggacgtggtggcgcatgcctgtaatcccagctactcaggaggctgacgcaggagaatcgcttgaacccaggaggcagaggttgtggtgagctgagatcgcaccattgcactccagcctgggcaataagaggaagctccatctcg

SEQ ID NO: 713061 - DNA, 800 bp, Homo sapiens
ttttctctttaaaaacattttctctgcggtaatttccttgtcatccttgtgtctacataaatcacttgaatccattgaaagtgctcaagggtaatcttgggtttctagcaccttatctatggatgttactttggcgaatgggaataatcacctggtcacctgccccaagactttcccctctgaataaatacccatgaactctgatggctgtgtatcaaaggaacttttcttgtataaattgctgatgcaggaagttaagtttaaacacaacgtctatagaaaagaaaggagagttattacccagaattcaacatgtagcgattattaaggacaattcttttgtgatttaactaaacaaacagtggcggcaggggtggggggtggcaactcatttaatcttcctatacatacaaaggatatgtcaacaaatggggtacttctctgtgagcgttattctgatgcgctgtatacagtttgtcacctctttactttttagttaagtcatcactgatagactttcctctaaaagccattcattccaagattgtacctgggcggaattattctacaatatgttaattcctctataagagtcatcaatcaatcatgagggggcgcgagtttggcagtcaggccctaaatgttatgtaactagttcgactattataagcttgagtgaagtagaggtctattgaaataataacacaggttgggaacatcggtgaatagcagactacggagaatctcacggatttaacgtacagtgcaaaggatgaaactgtgtaaacgagggcaacccg

SEQ ID NO: 713062 - DNA, 169 bp, Homo sapiens
cagatatcggtcagtatagaaacatagagaacagtctggaatcaaccaagggtgtactagattgacctgaggaatgatctggataggttgttgtgaaagtggagaagattcacgaaaaggtctaaatgaattgcgtgtgcagggcgcggatttaaagtccaatttctca

SEQ ID NO: 713063 - DNA, 153 bp, Homo sapiens
cctttcggtgaccccatgcattggctcatgtcgttgggagtgttgtcgtagtcactctcaggtgtgctgttctgcttctccagcctaggcaacacagtgaaacccgtctctacaaaaattttaaaatgaggtcagacgcagaacgcgcctaat

SEQ ID NO: 713064 - DNA, 195 bp, Homo sapiens
ctgagacaggtggatctgctgagctcggagtttgagcacagcctgggaacactgtgagacccatctctacaaaacatgcaaaagttggccggccatggtggcatgaacctgtggtcccagctactccggagtctgaggaaggactgctcgagccggggcaggaaaggctgcagtaagccaagatcacgccactcc

SEQ ID NO: 713065 - DNA, 182 bp, Homo sapiens
tccggttcaatcacttccctgtctcggctcccaggtggctgggattgcaggtgacgccaccacgcccggtgattttttttgtatttttagtagagatggggttcaccattttggccgggctggtctcaaactcctgacctcaggcagtccgcccgcttcggcctcccaaggtgctgagcttg

SEQ ID NO: 713066 - DNA, 144 bp, Homo sapiens
tgggtaggtaccaaaggaatagcatacatttgtcaaattgaatgatctggacatagttgataatgtcatagttaaatatgcttcataagtattgtagtcttttacaaggaaaatgggaatgtgtgtaatgtgaatatagcagct

SEQ ID NO: 713067 - DNA, 463 bp, Homo sapiens
agtgtttagaaaggggtaaaactaggacacagaaagacgctgggaattaccacgacccccaagtgcttccggctccaggaaataaccattcaggtgttggctggaggtcacacaattttcccctattaccgggtgcaaaaggactcatcacttcccaaaagcttcttttcaaaccacgattttcccatttatttgggtccaaggcagtcccattctttatggcctatagtctcactcccaactacccccggggggggttaaaaaaaaacaaaagggattcccctctgggggggccccaaaaattcagattaaaataggagggggggtgggcagcttcggggagattagaacacttggagggttaaatctaccttcccaggaggggaaatttaatccaggatagggtgggagactcatatatggcacaatagggataaaacctagagggtagaattctcacatt

SEQ ID NO: 713068 - DNA, 263 bp, Homo sapiens
gtacattcttctcagcaccttagagcccactgatgcaggcatactgggacgactaaggactcaccaagctgggtctgctcatggtgcttctagcatcatcttcatgatggaatcggtccagtgaggctgtcatctggaggtgctgcgcagttggggctgcgctggggatacatcattcactcttgggacgtgagagctcatcactaatgagttgtgagcagagtacctgactatgcagagtcccatagcatcccctaatatag

SEQ ID NO: 713069 - DNA, 154 bp, Homo sapiens
ccagcccatctgatcgaagtcaagcgggagcatgctggtaacaagaaacttgacggtgagtacatctacctcaagccggaatgggccgacaagctggcatctcgtgcctacctgctcggtggtgtcaatcctcggtatcagccgatggtagtgc

SEQ ID NO: 713070 - DNA, 414 bp, Homo sapiens
  misc_feature (253)..(253): n is a, c, g, or t
  misc_feature (323)..(323): n is a, c, g, or t
aaaaatacattatagtaatttccttggccatggttttatggcacgcagtatgtgctgaaataaatgctagcttttttttcctgggactttttcaataacgttttgtagagccactataagagtagaagagtgtaggctgggcatggtggctcacacctgtaatcccagcactttgggaggcagaggcgggtagatcacgaggtcaggagttcgagaccagcctgaccaacatggtgaaaccccgtctctactnaaaatacaaaaattagccggatgtggtggcaagcgcccataatcccagctactcaggaggctgaggcaanagaatcgcttgaacccaggaggcagaggttgcagtgagctgagactgccattgcacttcagcctgggcgacagagcaaggctccgtctctg

SEQ ID NO: 713071 - DNA, 1621 bp, Homo sapiens
agggtaaatcccacgctgattacttagcgtccagtgacagtgactcccaagaagaataatctgaaccgaccacggaggctgccatagagcacactagatcatggcaagatacttactacattcctagtggtgtgccgagttgccaagctcgcctgtgcctccacggcacagctagagaatacaccctacacacatactggtgacgatctagtcagggattggccaagtaagtgccaatgagtgaaatcgctaacatgacgctttatctcctaataacaagcatcacctagccacaagatttggctagcctagtacaacaatagacgaccacccactgatgaccaccccaactcctcgcgctctagagggtactacccgttggctcgtacaacacgacaccactaaagagctaacacttacacttatcaaaccacactatacccaacttcaacgcttacacttcttaaccacaccaacttataaatcacataacaacacaacaactacacccccctacacccacacaacctcattcatacctacacaggaacccacatgtccaccctacttacccacagtaaccatgtatccctaactcattagccgccaacacatatacgcagaagagcacacccgtaagagatgaacacaccattacacccctaggacagcgtgtaaacacagcataacgctcaacaccgtagtgcaaagaaacacggctggcgcatttatccgtttcaacaacagaattatccaaacacattcccaaaccacacctacacagtacgacccggtcaaccgcaacatgcggctggaccacacaactccccaactacaccacacataatccttttaacccttacacaattacacccataaataacaacactaacactatgaaagaagccccgtaaaaaacttcatataacaccacccacattaacataacaactaccaaaacaaacttctacatcagcacaccacaaacacttcaacacaccaacacagtactaacacaaaagaaatattagacatcacaatcaactcattatgacactcacgctccaacacaacaccacatacaaccacccctacacccagctcacgacaccactaataatacgacaacccatataatacgcacactagatgtcaccacacaacaactaccgccacaccaaagcctacacacaagcaccacatacatacacctattcgcaaaaaacatctattcagcaacaccagctcctacacaccacacatcacacccctagatattccacccaaacacacaacccgacacactatgcaacagcataaccagcttatcgcacgctagagcgaaagcgagcgcatagagcgcgccccctaatggcgaccacaacgggcagtccaaccacgccacccccagcgatcaggtagacaaactaggaccaacatcgaaccgtgcaccactcgcaactcctaatgtcgagcacgtctcgtcacaccccgcaccagaacaaaaatgagaccacgacagcatgtcttacagccaaaggggcccggccagtacgatatcgcacaacgtcagcacccacgctgggcggaccttatcacggccggagccaccaagggggaa

SEQ ID NO: 713072 - DNA, 436 bp, Homo sapiens
cccgcttctgggagtggggaaagaacatcgtctgcgtggggaggaactacgcggaccacgtcagggagatgcgcagcgcggtgttgagcgagcccgtgctgttcctgaagccgtccacggcctacgcgcccgagggctcgcccatcctcatgcccgcgtacactcgcaacctgcaccacgagctggagctgggctgtggtgcatgggcaatgcgctgcctgcgcagtcccctgaggcttgcggccatgtgactactgtgtggctggctaatgccctgatgcctgggatatgacctgcccgggacagtgcatggacgatgtgcaagcaagaaggggctgccctgagactctggcgaagagcttcactggcgatcctgccctggtccagctgcgttctgtgccacaaggcagacagatccactgaacccatccacagg

SEQ ID NO: 713073 - DNA, 552 bp, Homo sapiens
gcagatccaggtcacaggggactgaatctcatcaccccacaaacataccattcaggttttgccaagaatgacactgtaaatgtaacaaagcttccatgcttgttagtgaacaccaactcagctcctctcctctattcagaaatcaggatgagatgaaaacaacaagcaggccaggcacggtggctcacgcctgtaatcccaccactttgggaggacgaggcatgtggatcacctgaggtcgggagtttgagaccaccctgatcaaaacagagaaaccccatcactactaaacatacaaaattagccgggcatggtggcaaatgcctgtaataccagctactcaggggctgaggcaggagaattgcttgaacccgggaggtggaggctgcagtgagccgagatcacaccactgcgctctagcctggacaacaagagtgaaactctgtctcaaaagaaaaaaaatttaaaataaaagaacaaggaaacaaaagtaacaaggcttgacaccagatgagcctgaatctaagcaagaaaagccagaagacatccatt

SEQ ID NO: 713074 - DNA, 295 bp, Homo sapiens
ctaagttctacattaacagttgcttacaaggatttcagaaaaggaactacattctcttctgctggctataatggtataaatcagatctacaaatcgtatgggaacgagtcatctactctgtcctctatctcaagaaattagctcttttacatgttgtttttatgaaactcttttctttcagttaaatcataagtaggataattttcatagacctttttgcaaatctgtttcattgtgacttcttccaagttagcactggccagtaatatatatattgtttcctttctgaccaaag

SEQ ID NO: 713075 - DNA, 825 bp, Homo sapiens
cagcataatatacgcatgggaggagctgtggttgtaacactctacaaccatgggtttccggaagccgccagtatttcaggaatgcatcacgtgaagcttgtcccaaccaaaggttctggcgggtgatgggttttaaggcataaagctgtataaaaggcagattgcagtaggaagattggagagcaggaagggcgaaacagcttgtgtgcaagagacatccggtggtatatctatgcccttcaaaggtgaatgatggtccctgggggttgtgaaagaggtcaacgtgtggtgggtgggatgtgaagtaatggataagtggaatcaagtgctttcttaactctagtatgagaaagggctgaatggaacaagtcagcaaatggctgagctgaaaaaccttactgtggggcattaaggtgagctggggtcatgatgtgaaatccatcaaaatcggtgctatcattatcagaaggtgacatatttggacaaatcactggactgacatggggtctcgctatgaacgattagcagagaagactctcagagcgttcagcgcagagtagaggctatggcttctgattgaactcccttatgactactttggaaaatcacgatgatgataatatggataatatatccatacattttaattgtccagaatttagcacttggaattgcacatggaaaatagcgtgggataacgatatgttcgccaacggggtgtgaaccagtcctgtgttgcctatgacactgggctgaaaagacctgatgggttaacaagtggtttgggcaaatggctacccctgttgcgttaaccctcaaccttgg

SEQ ID NO: 713076 - DNA, 1112 bp, Homo sapiens
  misc_feature (148)..(148): n is a, c, g, or t
  misc_feature (914)..(914): n is a, c, g, or t
tgactacgcgcggcgggagcggatgcggagtcggcaggcgccccgtggtgcgcagggctcggacacctcactcgacgggacggaaagccggagcagcagaagaccgggacgcgggagaggactgatgcatcgctacaccggctgagcngaggaacgatcgcaggtttagcgacaatacgatggttggcgcgcagtgatgactctggcgcagatactcctgcgagtgctggctgatgtcatcgtcatcacgtcctacggtgacgcgcatgatctacccgcaggtgagacaatccttccagaacaaacagttaagaagatatactcattgttgccgtgaccaaagattgatcctgaacttaccgagagacatgaatatcacaggtactccacagaacacagccagtacttagcggtggagaccacttccatggaagaaggatatgaatgttgccagaaaaagtgtatgcgaggttgaattcctcggattaagggacgccagcctgactcacgtaggaagaaaattggcagtccttaagataattcactccactgtcatccaaggggcgtagtccagtcataggtctaatacttcgcaatgattcccctcggtggatggatgcaagttagctcccgcggccctgcgaatcatgaaggaattatgccgtggttgtaaatggccggcgctgggaagacaccaagacctgctccagtgtggtatcgctttgtcctaagccctctcctttcccaatgggcaatatccccctggggtagttcacagaggtagggactgcgagttctccgggggcccctgtttttttgcttgtgcgtcgaccagtttttcactctcccaaataccctcagaagtcccttctccaccttgagaatgcaacgcgaggatcgattcgaaccggggnattcatgtccctgattgtcagaggcctttggcatttccgatgttttgcgcacttgcttctggggatgttcgcgaccacacagggcgtttgtcccgggctcccttgtgtgaacccccccgtgtgttggatcccacacagccctagtaccttcacacgggcatgtcactcagagtagattacgcgagccctgctattcct

SEQ ID NO: 713077 - DNA, 271 bp, Homo sapiens
  misc_feature (40)..(40): n is a, c, g, or t
  misc_feature (55)..(55): n is a, c, g, or t
  misc_feature (70)..(70): n is a, c, g, or t
  misc_feature (89)..(89): n is a, c, g, or t
  misc_feature (229)..(229): n is a, c, g, or t
tttttaaaaattttaagttgtatttaaacaaagagaaccnatggattaaaagacnttaaaataatagcanccaatggaaatacatgacnggaattctgatgcgaacaccctattaaagaaattttttagagactattggagattgggcacagtagctcatgcctgtaattccagtactttcagaggccaaggtgggtggatagcttgaacccagcaagttcgagactancctgggcaacatagtgaaacccatctctattaaaaattcgaa

SEQ ID NO: 713078 - DNA, 945 bp, Homo sapiens
  misc_feature (50)..(50): n is a, c, g, or t
  misc_feature (76)..(77): n is a, c, g, or t
  misc_feature (104)..(104): n is a, c, g, or t
  misc_feature (131)..(131): n is a, c, g, or t
  misc_feature (147)..(147): n is a, c, g, or t
  misc_feature (149)..(149): n is a, c, g, or t
  misc_feature (176)..(176): n is a, c, g, or t
  misc_feature (203)..(203): n is a, c, g, or t
  misc_feature (207)..(209): n is a, c, g, or t
  misc_feature (213)..(213): n is a, c, g, or t
  misc_feature (239)..(239): n is a, c, g, or t
  misc_feature (243)..(243): n is a, c, g, or t
  misc_feature (324)..(325): n is a, c, g, or t
  misc_feature (336)..(336): n is a, c, g, or t
  misc_feature (342)..(342): n is a, c, g, or t
  misc_feature (353)..(353): n is a, c, g, or t
  misc_feature (374)..(374): n is a, c, g, or t
  misc_feature (382)..(383): n is a, c, g, or t
  misc_feature (389)..(389): n is a, c, g, or t
  misc_feature (402)..(403): n is a, c, g, or t
  misc_feature (405)..(405): n is a, c, g, or t
  misc_feature (471)..(471): n is a, c, g, or t
  misc_feature (538)..(538): n is a, c, g, or t
  misc_feature (668)..(668): n is a, c, g, or t
  misc_feature (670)..(670): n is a, c, g, or t
  misc_feature (674)..(674): n is a, c, g, or t
  misc_feature (855)..(855): n is a, c, g, or t
atattacataaatacagcttacatactagagtatcaaacactctgttccngtaagaagttcaagagtacatttagnnctatcttaagaaatatgaatactttgncttccattattacattagatgacaaantcaattcaaataagantngtcatatcctgctatgattaacaaaanaccacgtcgggggagtgggggggtgtntttnnnaganataaagataatcaaatgctttttganaganctgttctcttcactgccacacatattcatacaaatgacttagtaatctaatatgggaggtggtccttcacttatattaggnncttggtaagtntttgtngaatgagtggnctatctatgggtatgggtttnctactttnntttgtnctttttttgttanntngttttcaagtaagagcaatagtaaacatactgagttcacattttgctcagatcataagcctataanacagtgattgttacaaacaccacccatcatagcacaaatcaatgtgcatttctgaagctagtaaganaagttctatcatgttgtagaacgaattctaaccgactaattcactgggcttcaatcacttgtgatatggtcaagaaaagggggctggggctcctaggcttgtatctatttcagctatcagtgaattcctntntttngggcctcactccccttcccaccccaatagacacaaatttaaaaacattgctaaaaatagtagttgtagcatgtcttcacccacttgtaatttggctctgaaaatgtattcaggctccaggttcagaagagagactttccaagcaggagacaaaattcactaagggagctcactcaaatggnaatgagttcatggaccagagagcaaagcaaaacattgctcttaaaagcaagctcaacggacacacatgatgagactcacagttgcacact

SEQ ID NO: 713079 - DNA, 403 bp, Homo sapiens
  misc_feature (261)..(261): n is a, c, g, or t
  misc_feature (395)..(395): n is a, c, g, or t
gcaaagttccaggttccttactggatggctccagggccgtcggatgcaccccttcggagctaattagcggagattgagaaaccagtgggtttgcacttgaaacgaaaatgtacttggggagaaacttgaccgcaaaatgatccatcacaggactatgtcgcaaagtgactgtgaagaagaccctgaagttgagttcttaaagtcgctcaccaccaagcagaagcagaagctcctcaggaaattggatagacttgaaaaganaaaaaagaaaaagaaaagtgataagaaaaagaagaagttacagaagagcaagcttaaacacaagaaacgtaaaaacaaatccccttcctcttcctcctcttcctcctcttcctcctcttcctcctcctcctccncctcttcc

SEQ ID NO: 713080 - DNA, 212 bp, Homo sapiens
aaagagatctggtgatacttgtgtcagccagatagcaggattgtgtcctgtactccagctggacgttacaccagtgcatagcagtacagagcaccagccaaaaaagtacgccctcagccagtcgctatcagcactttcggaccaggactagcataaagagcgtccacctgaggccacccatctcacctgacactgatactgcctgtagaagt

SEQ ID NO: 713081 - DNA, 107 bp, Homo sapiens
catgtacaggtcttatggcgctggctgatttctcctctcatcgtgacgggccagctgagaggcaggcaaggatcctacaatcgacttgctcagaggatccagtaaat

SEQ ID NO: 713082 - DNA, 444 bp, Homo sapiens
ccaagggtcccttagcctcccaagtagctgggattaccagcatgcaccaccatgactagctaatttttgtatttttagtatagacagggtttcaccatgtttggccaggctggtcttgaactcctgacctcaagtgatccacccgcctcagcctctcaaagtgctgagattacatgcgtgaaccactgtggcctgctgaggcttggttatttttaagcggtgattttgtcatatgctacctgaaggtagcacttgatggtgctttctctattgactttttctgtattgctagcaggacacttagggtggaaatgattcaaaaggaaatgttttacccagttttcatgtatccaatgtggaaggaaccatttgttatatacagttctttccagtatgtgcaaatatgaatgatcggctaacgaccttgggggatcctctaacgag

SEQ ID NO: 713083 - DNA, 263 bp, Homo sapiens
ctcgtgagtgagtgtacatgacaggcagtaataactgaatcaatgaatgtagcaggggactccgatggaccctggaccccactgttaaccgagtggccaaatataaggtgtatcttccttgcatgaaagcaggagttctcatgtctgctttccttatggaagagcagtgggggattaacttcaggatgaatatattagtcaccttgctaggaaagttggaggtgttcatttaaacataaagtgggatgaatatatagcttgcc

SEQ ID NO: 713084 - DNA, 214 bp, Homo sapiens
gagctttccttaaatagagggattgactcgggtgttgtgtgatcattatggctgacgcctgtttctctgcgaggtaggacggctgctttctggtctggcagggatgggtccgctttgcaaatgctctacgaggctcctccttgcatggcctgcaatctggccgcagcccctagtagattcctcgctgatccgatttcttttctctctgcgcttg

SEQ ID NO: 713085 - DNA, 268 bp, Homo sapiens
actcaattatacagatgctatagggattactatgcaccttcttacatctattgctacatagataaactattattatcctaaatcactgtctagcttacaagcacatccctccctgtgactgaagaatttgtattttgtgctaagatgcaatgaaatgtgcaaattgttcactgcatagcaaaaaaaatcacagcacaattaaaacccacgaaaccatctttcccaaccaagggcaatttcaaggcttcactccaattccattctcaac

SEQ ID NO: 713086 - DNA, 606 bp, Homo sapiens
gttaatggtcagtccagtgttttaatctgacgcaggcttatgcggaggagaatgtttccatgttacttttactaactttagttcttctatagggtgatagatgggcccaatggggtgtgaggagtccagttatattgtttggggattttttaggtagtgggttgttgaggcttgaacgcttccttaatgggtgggctgctttaaagcgcctactatgcggtgtaaaattttttactctctctacaaggtttttccctattgtccaaagagctgtccctcttgggcactaacagttaattttcacaaggggatttagaagggtcctgtgggcaattttaagtttgacactaagattctatctgtggacaaccagcttatcaccaggcccggtaggtttgtcgcctctaccttataattcttcccactattttggctcacttagacgggtgtgccctttaagctgtccttaggtagctcgtcgggttccgggggcctaagcttgggctccccttgcaaagttattcctagttaatccattatgccgaaggtataggggttagccccttgcaataataatgccgggaataattttccatcttccccttg

SEQ ID NO: 713087 - DNA, 769 bp, Homo sapiens
gcgtcggacccacgcgtcggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctggtgagcgggggctgaagaggaacagtaggggagggccaagaaacgtggccctctatagtgtctcgggtgtctctctcagatatctcacggggtggtgcaggtggcactcctgaggcgacgcctgacagatgagcaggccctacagcaccccttctttgagcgttgtgaaggcagccaaccctggaacctcacccccgcaagggttccgggtggcagtgtggacagtgctgggtgctggacgagtggccctaagcacccatcgtgtaacggcactgaccaagaatgcagctgttgagggacccttatgcgctgcaggtcagagcggcacctcatcgacaactgttgccttccgggctctacgggcactgggtaaacgaaggggagcagcagaacgggggctctctcccagcacggcccctgggctttccatcatgggcctgaagagagggagacctgtgtataacgaggtgaagcggttgtctggtaagac

SEQ ID NO: 713088 - DNA, 171 bp, Homo sapiens
tggtgactctcgaggatccctcataggttcgcaggggattacagtatataccaccacgcccagctaattctttatttttgtagtagagacagtgtcttactgtgtgcccaagcggtctcaaattcctgcttcaagccatcctcctacctctgtcaccctgcgaacctatga

SEQ ID NO: 713089 - DNA, 286 bp, Homo sapiens
tgctttggaggatccagtgttgctggggatgcgcttcggcagtggctggctacatgtactgatagacagagagtcccaggagatgaagccacaaaggtgggcatggcccggggtcatcaagcgccccaatgccaggccgagaagtgtaggtcgctgaggagctgtgaagggtgttgagcaaggaagggccaatgtggtttggtctacgtggagtcaggaggacacagatagaattagggaaacaggagggagttgagaatgccaattggacgggaattcttttatt

SEQ ID NO: 713090 - DNA, 89 bp, Homo sapiens
gctcgaccaagaccctacttctaacctccctgttcaaatgaattcgaacagcatacccccgattccgctacgacaaactcatacaactc

SEQ ID NO: 713091 - DNA, 190 bp, Homo sapiens
taagaccgtggatgtatgtaagaagaggcgattagagggtcttgtactctggactaaagtgaaggggctatcctatttattgctatagcatatgatataatgatgagtatgataggagtattggtatggtcattgtccggagagtatattgttgaagaggatagctataagaaggatcatggatgcggtt

SEQ ID NO: 713092 - DNA, 953 bp, Homo sapiens
  misc_feature (868)..(868): n is a, c, g, or t
aagacaccttaacaaagaaaaaaaaaaaaaaaacctttgacccttattttatactttaaaggacagtgttttggagtacaagtgagctatagcttgcttaatgacctggtgagatttgatttccccctttccaatttgcctgattcagattactccgggggatgatgcatggtagggagggacagaactcaagttctcagatagtctctatacatttccagcattgagtaaggacatggtgtggactcttacaagcctttgtgaagcagcctgtgattgggcacttgaaagtgtgcacgaaggtgtgtttccgtgtgtatgtgttcgcgcgttggtgtatcaacaacagcgtatgttgcagaattaacaccccacgaggccagtgatgatgaagcacagggagaaaagtatccctgtgccaaggttatccccctcaagaactctgcggacaactcccggggacaatgagcgaagctatcacaggacattgagacaacctgttgacatgaacgtagaaacgtgagaactacttaccacataaacacatactatacaaactttaccccagaaggtgaactatagagacaatatacagagaccactatctacaatccactgtgattacaataatacacaaccctatggtgagcaccccttgcattaatgaccacccaaacaagaacggaagccagcgcagttcgacagagcacgatccacattcacacgaggacagaaaaaccaccttaacaagtgggcttaacaagaggacgaaaacagatatgaagcacatttgcccatggcgtccaaagcatgaggacaactgttggctgccgtctaccgcgagggtaataccattaacacgtatagncaacaaaagcgcctgcacacgagcgcgccacaaagataaccatcagtgtggaggtaacacaccacaagtgagtcgaccatgtaca

SEQ ID NO: 713093 - DNA, 1375 bp, Homo sapiens
  misc_feature (1)..(1): n is a, c, g, or t
ngtagtgatgtgtgtgttgtgatgcagatgtgtgtgtgtgtaggtattgttgtataagcaatgcttatgagtatgatcagctctacataaactaaccctgtgtggttgtaagaacacacaaccgagtgttgggccccccctttattggatcccttcgagagggagtcccccacccgagtgggtgtggcacacacaaaaaagccacggggccttttgttttataatccctgccggcgcccccttgtttctcttaatcgccggtgtcactaaaaggttacctcgaagccccttggggttgcccaaaaattttcggacaccagaagggggttccacaccacaagtgtcctgccggagattccgtcataaaaaggtttcctccgggggtacatgggaaaaaatttctttgggcgtgggcccaaaagcccaaacacccccctgcgtccccttgggaaggtccccgggagtacccctcttattgagggagaaaaaccggtgacacaccgtgccgggggaagctccccggcactattgatcggagagaccccaaagggctcggataagtggaaaatagtgcacaggcttagaacccccgggacctttgccctgaatttcgtgccccctaccctcccctcggataggggaaaagaacacaaggatgccccccacggcgccaataggccacttcttggcgggcgtaccatctcgctttgccacaagcacccaacaatgtttttggttgaagacctgaaaggaatggtaaaaggatttcggagaggtgtgagcacatcacatatagagaagaccacacagtaaatgggaattttcccgcaccaccacaccgtgagatatagggcttctcgttaccacgcgtctctgagccccccgcgaaaacctgagagcctctcccgttaactctggaaagaggctacacctgggagcacacactggaaccacaatttctccccacgtttttctgcgggaaaattctccacatggtttgcccgcgggaaaaagcttaccctcttgtggaatttttctcaccctaatgaatatccttggaatcacgaacccgtagtatattggagacccccaagggccctggaatgaggttccccacaacctcgaaaggcttttcaatgtgcccttttgagaggctttggaggaaaattcgctgcctaacttaccacgtctgagatcacagttcctgccaagaatgcccactcacacccacccaagaatggcccacagtggggcacaacaagcctgtatatgctgacccggaggccagacttgcagagcttgttttgtttcatacctgtccgtaaggggtcagcgctcttgctttgctcttttccaatgaatagcccttctgtta

SEQ ID NO: 713094 - DNA, 355 bp, Homo sapiens
  misc_feature (1)..(1): n is a, c, g, or t
ngtgtcagcccatgtatatagcacgtgctcactgtggtcttaggtatttcacacagggtcctctgtgagtgtctgagtccctgactacagccactctggtcacccgaagagcataaggtagcgcacttatctcacacagcctacactctctcagaaagtgtcccatcacaaagaaatgatgaatgtttgacatgatgggtatgttaatcactctgatggtgatcaccatacattacatgtataaaaaagacagttaaagtcatgaagacgctaacatggaaagcgctccttctcaagaacaggagtctcctctgtatgtggagaagaccaagggccaaaatatcgcccgctctct

SEQ ID NO: 713095 - DNA, 428 bp, Homo sapiens
taggatcaggtgaaagatttttcttgtaactcaacactatatacagtttcagcctaaaaagagccaagatctcacctattattactttgaaccagagctttatcaaaagatgccataaaatagctgattgaccatgaggccacaagccttaagactcatcaactatctgcctctaattccactgccagagagctgctcttacatttccctcagagccaggtttgggccatggagaaggaacttcttattttgtagtcagggtgggcactgtatcattctcccacacaaatgctttaaatggggtaggatgtgaaccaacagatcttaaaatgagcagatccttttcaaccgggaacttgacaaaggagaaaactggacaattttcaaaacttgtgggaaacaacagcgtcgacgcggccgcgaattta

SEQ ID NO: 713096 - DNA, 1658 bp, Homo sapiens
  misc_feature (1449)..(1449): n is a, c, g, or t
gcttggctcccggatccataccccgtgattctccgatagataataagtgggcacgtataacgtgtcattcctcacaggagtactggcatctacgatgagatcttccctttgtacatgacctttgtatcacgctgctggagtcggccctagacaaactgttgttagtgttgaacggaacagtatacgtgcctaacgagggtccgtgcatgtgtgcgactgccatgatgatgaggtgaagtcatctccctatccagtcatgtcaagtcaaccgcgagtgcactagagtcccggcattgcctctctagcgataccgtcgtacaatggccactggcttaaagctaggtccgtatgcctcctcgggagtatctcgagggatcacttcacacgcacggtatccctcgactacatgaaacgtctcttgtgtgactccttcaacacgcggcgccttgtcgtcacgtaccctcacctgcatgtacaggcaagtccctcgaagtaagttaaggtcgtgatgcgtaccgcggtaagcgcccgagacaagaggtgctcgaaatgccaaggggccctaacacgcgggtcctcgggggaagaacttagcaggcagacaataacaatgcgcacggagcgcaacggattgtaggagcgccaggatccctgttgtatcccacccttctatcgcaccattattgacattcgagcccgagtttaaccaatcaccttttcattatgaaaggcgatagctccctctcatggtcgattggactcccattgatagagagcgggcctccatacatactaaagcgtgcacccaaatgctgcgctcctaatggcacctcgcaattcgaattaccttatttaaagacacacccccaagtcggtgtgggcgctaatataacgactcccgcggatatgccctccggcgcttagacaatgtcgcgccgcattccgtgtacggtgatgacgttagcaattcaccttgtgtcccctgtgtagattcggtttcgtgtttggcgcactagcaaccgcgggtaagaggctatacagttcttctgttgcgcatgccatcaaccgttgcaccgctgaggttcttacaccacttcaggagcgattggcacgtggcgtgcgggttcgcgacgtcatattcatcacctgttgattctctcaacacgttaacggagtcgcgcggtggataaccaccccttcatatggcaaaaaggcgtatcgcggttaatcggaattaccagaacacgtttggccaagtgcgcggttccacgtgtcgatgtgagcacacccaccacgcgctatcggagatatcccattattgtacccccacaggaacggaattgggcggttacctgacggcctttggcgcaaggcgcaatgaccacagggggcgccctcacactccttgatgacggagaatcgcctgtatccgagcccaggcgcgccganagcaaaatagccacgataaccgcacaaggggaacacattaacgggcggcgacacaaaaaggcggcccttacgctacgaggagtcagatacccggagtacaaccaacgaaacgttaggaggcccgccaccgcacacacacccaatgagagggaacgcccccacagggtcgggggaccacaccaaaagaggagcattacggggcgagccca

SEQ ID NO: 713097 - DNA, 114 bp, Homo sapiens
  misc_feature (71)..(71): n is a, c, g, or t
ttgtgggtggttttatctcttgaaggctgacttccacaacctattcccatcctaaagcaatggagtccttngggatgttagcactctttagtcgttgggattcacagaggcttg

SEQ ID NO: 713098 - DNA, 447 bp, Homo sapiens
ttcaccgctgcttcataaacaatcttagcagcgtgtgctgaaagccttttgtgcttgtgggtggaaagcaaagataatcgtgttacgcggctttgctgtcaacatagccttaaaaattgttgttgacgttgggttagttgttggcacgataccagccaataccccaagtggtgcagcgacttcaacctttccttagattttatcttcgctaatcacaccaactgtcttatcacacttgatcgcgttataaacagattctgaagcaaaacggttctttgtatccttatcttcaacaccccacgaccagtttcgtcgtgtgcttcgtgcgccaatagcaatgagttttctgatccagccaaggccattgctgcaacaatcttatcaacttgttcttgtgtatatgttgagaattttttttttttttatcaattggttaattctgaaaaa

SEQ ID NO: 713099 - DNA, 176 bp, Homo sapiens
ccttttactgggtatgttctggcttttgaaatacattacctattctcttctaaagccaaaattactacagactaaggctggacactttgtctcccctcttggtctttgaaaaattacaattatccccaatttgtgtttgatatggggcaaaatatctccactctttttgtgttaga

SEQ ID NO: 713100 - DNA, 168 bp, Homo sapiens
aaaagaagacaaaaccaccacccaccacacagacatcggcactgatggactcattgagctgcggataatcaggctgactaaggactgttgccgcatagtatgagtcatgggttagtttcagatcatttgccagcatgctatattttctgcttagctgccatgcgaccg

SEQ ID NO: 713101 - DNA, 258 bp, Homo sapiens
atctagaggatcgtcaactggttcgagttcggtgtgcagcgcttgccaatgtctatctcagtgtttccacgtcgctcgctcttgacggtgacgacactgggtctgaggtgtaagcgctttcaggcccttccctggggcttggaggcgaatggcgcaaaggacttttctctacaaggcgaagccccttgcagttacccaaagagtattgtctgcttattgtcctaagagggttggactccctgaaaagcctgtgacagg

SEQ ID NO: 713102 - DNA, 223 bp, Homo sapiens
ttatcccggggtagtcatgctcagtgcaccatgaagtaagagaagagatggatacacctcagccccacctctctggaacaggaaagatgattgtggagggagcacaggtcagcgtgggaagagggtcatggtggcgttggggctgggttgtttccccaacttctccaattattgctaaacgaaccctgacaccttgcgggtgtgctttggcgaaaccaagtct

SEQ ID NO: 713103 - DNA, 608 bp, Homo sapiens
aataccaagtcagacgcccaacgcaaaaaaacgcgagatagtaaaattgccgcaggagctggtcagtcagctgggggtgcgatctgatcaggacctatccactgagttcggtttcaccctgcactacctgaagaaagagcgcaaagcccggggcatttcgagtgtaaatgtgcctaagtaccccgaagaaatgttgtccttgcttgggaaggtagccgatcgtgatttggtggccaggttgggctactcatcaaccacactttcaatacttcgaaagaagttggggatcaagcggcaccataaggtctggacggccgaacgcattgcgttactgggcaaaattaaagactcagaggtcgcggccttgctcggcggcgcatttacaaaaggatcggtcggtcaatgtcgtcgctccctgggaatacctatttgccgaggaccaagaaatggcgccccaactgcccttttcctctcgctcagtcggggcttaaccagcgggaagatggaagcattgccaagcgcacaaccaggtgagaccggacaattgactcaatttccgctagtccctggttcagaagccaattcgtttcaagcctaagccaaaggat

SEQ ID NO: 713104 - DNA, 493 bp, Homo sapiens
tggaacattgcgatttggaatgtaagcaccagccacaaaaacctcaaaaaaaaaaaaaaaaaaaaaaaaaaaaaaagtgtggtgcgggcgcgccccgggccccgggagaaagagctttttagaacacccattcgcggtgggggcgcgcgcggggcccacaagagaggaaaagtgtgaaacgtgtggccccaagagcggtggtctccaagagagagaaactcggggcgccgagagaaaatgagggcgggggactctctctccaccacaataacaaaaaaagcgccgcgggggggaaaacccgcggaggcggtcacgtgagagacaaacactctccaagaaaggaggagatgtatctgaggggggcgccatatataacgcggggggagctctatatacaaacaaagcgagagagcgcaccacaaaggagagagcgcccagcaggaaactaacgcaaacactctcacgcgcccgcccgcgcgcccaacgggggaga

SEQ ID NO: 713105 - DNA, 443 bp, Homo sapiens
ccaagttcctggagaatgaggacaaaggtgtgccagcttcatttcccccacctgcccattctgggaacctatgatttgaagagcgtcctgggtcaactgggcatccctaaggttttcaacaatggggctgaccttctcggggttacaaaggaggccccccttaagctttccaaggccgggcataagggtgtgttgaccctcgacgagaaaggggctgaagctgctggggccatgtttttaaaggccatacccatgtttatcccccccgagggcaagttcaacaaaccctttgtttttttaatgattggcccaaaaacccagtttcccctcttcatggggaaagtggtgaatccccccccaaaataaatgccttttgctcctccacccctcccctccatccctggccccctccctggatggcattaaaaaagggttgagctgga

SEQ ID NO: 713106 - DNA, 280 bp, Homo sapiens
tctctatccgggaatgtctggtcggcgtgggcaatcagaatacaaagggtggggagaggtctgtatttctttatttttaaataaaaaaacagatttagcgctcggatcgggtcagcatatgatctcttatataatctggcatctagacactaaagaccggtgcaaactctcctcccaggatggggtctactcggtcggagcagggtaagtaaaaatttctgggtatggacccagtcagttcctaaaaccagaatctgcagggggaggtagagagccgggc

SEQ ID NO: 713107 - DNA, 179 bp, Homo sapiens
ggaaaaaaaaaaaaaaaaattttcttttcctttttgggtttggccggaattggcttgggggaaaaggttgaacccccccaaaacccaggggaaattgaaggaaaaaaaacttgcccctgtccccctggggccccgggtccacccccaaggtttccaattaagggttgtttaaaggttga

SEQ ID NO: 713108 - DNA, 501 bp, Homo sapiens
  misc_feature (23)..(23): n is a, c, g, or t
  misc_feature (97)..(97): n is a, c, g, or t
  misc_feature (117)..(117): n is a, c, g, or t
  misc_feature (119)..(119): n is a, c, g, or t
  misc_feature (142)..(142): n is a, c, g, or t
  misc_feature (187)..(187): n is a, c, g, or t
  misc_feature (192)..(192): n is a, c, g, or t
  misc_feature (269)..(269): n is a, c, g, or t
  misc_feature (289)..(289): n is a, c, g, or t
  misc_feature (311)..(311): n is a, c, g, or t
  misc_feature (321)..(321): n is a, c, g, or t
  misc_feature (325)..(325): n is a, c, g, or t
  misc_feature (330)..(330): n is a, c, g, or t
  misc_feature (343)..(343): n is a, c, g, or t
  misc_feature (362)..(362): n is a, c, g, or t
  misc_feature (364)..(364): n is a, c, g, or t
  misc_feature (385)..(385): n is a, c, g, or t
  misc_feature (387)..(387): n is a, c, g, or t
  misc_feature (420)..(420): n is a, c, g, or t
  misc_feature (430)..(430): n is a, c, g, or t
  misc_feature (451)..(451): n is a, c, g, or t
acaggcagaatcaaaaaaaatanaaaacagaaaaaacacaacacaacccagcaatcggccagcatgccgggggtcgacaagaggcaggcgagaccangagactacatagcaaagggncnttaagaggattggggggggaganagagaaaaagcagagcggagggaagccggggcgagcccaaaagcngagcnacatccctcaacacgagagcagtccggggcggggcagagccgcgaagggcggcggaggcacaacactcccactggantctgcaaattccaccgcagnggcaggcggccatcgggcggangccgtcggcnatgncaggntggcccacaaggngacagcatcggcaaccggngncacaggagcaaagcgagcggngngtggggggcccaaacacctcaagccatgagcangacgccactnagcaaagtgtcgcgggaaggntttgggccctcggtaggtgtagtttccacaaatctcacagttgtagttga

SEQ ID NO: 713109 - DNA, 441 bp, Homo sapiens
  misc_feature (23)..(23): n is a, c, g, or t
gatagggggaggggaggccctcncggcgattgtcggaagcgccaacacaagacccccgttcaccctcacgccagactaccggagggtcgggcggacgccgcccattgtctccgatatccccgacgtcaccgtgacccccgcgaggctgcttttcttcgcgcccacccgccgaacggtgccgcttgaggatatggccccggccgctgacgccatcatgtcaaccgaagaggaactggacgggtacgatccgcagcctctcgggaagcggtcgaatgtactgccgatgatggagctgctcagggaatttggtaataacaccagtactgacggctcaataccctcgactgcggcgccagcagacgatggaggacgagctgtaccggatgacgatggagattatttctcagtaccctccggagcagtccacacagccccaggacc

SEQ ID NO: 713110 - DNA, 198 bp, Homo sapiens
gaaggctgatctcggtggatgggggttgatggcgtatttgcccccttatgcgagtgggaagcgagtaccggaggcgcggtggtacagcaccttggtgttgcgggagaagtgcatgtgcagggtgctgtcgtcgctgacggtcacggagactttcttcagggtcttgtacccacatgtgtgagcaagaacactctggct

SEQ ID NO: 713111 - DNA, 932 bp, Homo sapiens
aaaccctacatatgtgaaaaatgtggtaaagcttttaaccaatcctcaacccttaatttacataagagaattcattctgcacaaaaatactacaaatgtgaagaatgtggtaaagcctttaagtggtcctcatcccttaatgaacataagagaattcatgctggagagaaacccttctcatgcgaagaatgtggcaatgtctttaccacatcctcagacttgctaaacataagagaattcatacaggagagaaaccctacaaatgtgaagaatgtggaaaatcctttaataggtccacaactcttacgacacataagagaatccatactggagagaaaccctacacatgtgaagaatgtggaaaagcctttaatggtcctcaacccttaatgtacacaagagaattcactctggaaaaaatccctacaaatgtgaagatgtggcaaagcctttaaagtgttgcaaacctgcataatcataagaaaattcatactggagagaaaccctacatatgtaaacaatgtggcaaagcctttaaacagtcctcacacttgaataaacataagaaaattcacactgtagataaaccctacaatgtaaagatgcgggaaagctttttaagcagtactcaaccttcctcaaataaggagaaactcattactggaggacaattttaggacatggtgagcactgtgggaccctttaagtcttccctcatctttttaatcatatcatactggaaaaaaaatctacactggaaaattgccaagttttaccgaaatcatcggttctaactatcaaactggtttcgccaacctaaaattaaaaagggaaacttcagctgcgacctccgcaatattcgcgacacccgatataagggaaccaacccatcttcgcccaccaacacaaccgatatagaagcacccgtccaa

SEQ ID NO: 713112 - DNA, 346 bp, Homo sapiens
aggggggggggggggttcgggggggggttttaaaaaacaaagcccttttttttcacccccaagttgccgggggacccccccccccctttttttcccccccaaaaaaaacccgggggcggtccccccccccggttttttccttggcccgggggggggaaacaattttcccccgggaaacagttttccccctgggccctttttggggcccccaaaaaaccagttttttccaaaaaaccggggggggcccgccccggattccccgggaatttttccccccccggccccccccccccaattttttttttcccccctttttaaaataaaaaaaaaaaaggggcccccccca

SEQ ID NO: 713113 - DNA, 910 bp, Homo sapiens
cccgtgatcctggctgtcccagggtcgccgagggggttctcgtcccgtcgcccgccccctgtggactccagagtctttgtctctctgggcgcaaattattcccgtcgtggattcggcgggttccattcctggctcggtgggtccccgcttcccgcgcagatggggaccacacacgccgcgttttctacgtgttccggcccctcattgtttgcccgcccaaaattgtctttttgccgccattattacatttattgggggggtacccgcccgttttgtgggcagaaaaccttatatcgttgtcgcccaaaacccaagattgaggaattatggcacgcccttaatttcgttcttctttgcgttcttctttcggggttttttttttttttcttggcgtgacttcacggagttttataatactggggagcggtgaaaggtggacaccgccactcgggtgtggaggcgagcatccccccaatgttcacccaagtggccgaggaactcttgagattgcagcacctgttggttttttaatagtcacttcccaatatgaggagagcattgtttacacgggagtcccttgcgcatcgctaaaagccacccccccttctcttctataggaggaatggccccgtcctcttcccagtgccaaccacacggggagggtgatagcacttgctttcgtgtagattatgttatgcaaaatcttttttaatctttgccctatataattttttattttgttttattttgaatgatgagccttcgtgcccccccttccccctctttttgtccccccaattgaaaattattaaagcttttggttttcctgggaatgggtggaggcaaccaggggttacctgtacactgaattgagacccattggattaaaatgcaccccctttaaaaatga

SEQ ID NO: 713114 - DNA, 271 bp, Homo sapiens
cccttggttccagggcatccagtgtgcagtgaaagttgagaaccatatggtctaagtgttcatacacactaaccttctaccctctctatcttcctttctgcattctttaaataaagaaattaagtaacatgcttatgataagaaaatacaaactgtgcaggagagcatggctctctcacctttccagaataaactattgctgacaagtatagtgcataaacaatcatagtagacatcacacatccatacataatccacgaagagattatac

SEQ ID NO: 713115 - DNA, 241 bp, Homo sapiens
ttcccggcgttcagcccggcccgcaaaggtgggacggctcccggcttcagttacggaagcggcccgtgtccagcgacgagggttcgaaaatgccccgcgcgttcctaggtgaagaagccgtgcgtctccacgtgcaagagggcaaactggggcagccgatgctccccgacgaggagcgcggcgagatctacgtgccagtcagcctgggcttcgtgcccaaccacagcccttaccgggggaa

SEQ ID NO: 713116 - DNA, 143 bp, Homo sapiens
acagctcataacattagcctagccacaccccgaattaaacagcagtgattaacctttagcaataaacgaaagtttaactaagctatactaaccccaggattggtcaatttcgtgccagccaccgcggtcgctggtgtataccg

SEQ ID NO: 713117 - DNA, 249 bp, Homo sapiens
  misc_feature (1)..(1): n is a, c, g, or t
  misc_feature (142)..(142): n is a, c, g, or t
ngctctataggatcccccgcgaattcgggtgctgctgatagctcattcctgcgagccttagatattctcgtgaaagcggcacagaagtctgcagcctttgaagagcagtagaatgagacagtggtgccgaaagagaagatgnttagctgcattgcccagatcatcgcagcacaggaagaaatgcttcggaaggaacgagagctggaagaggcgctgaagaaactgtcccagatccggcagcagcaccac

SEQ ID NO: 713118 - DNA, 275 bp, Homo sapiens
cattcgcgaatcacattctgtatattgctcatggtcaacaaacgtgattcaaatgattgtaagttatcccaccatttaaagagaaaagtcgctgcaataattttaaaccagtggcgttatcattaatttcaccacgggactgctttttaacagaagttcttttagtgcttccgtttgacacattaacaagtagcttttaactctcatttggcgatcgtggattcacaagttacatttcttcctcaccaacataaatgtaatcacatttcagtgtt

SEQ ID NO: 713119 - DNA, 118 bp, Homo sapiens
gccttatctagagggagctgagtactgttgaaaagagaagcaaactttggcagggtggaaggcctaggaggcacaatggttggtggataattcaagcgaaggcacagcatgaagagat

SEQ ID NO: 713120 - DNA, 546 bp, Homo sapiens
ccagaaagcattgtctccttagggtataagttcgaatttcaggagttttacctgtgcctcggagttcctttttcttgtatttctgtatttcctgtggaggctttcccccaaatgctaagccagccttggatatgtgcttatgcttgagtcggctgctcaaaatattggttaccctgttttcaaacagggtaattatgttttcagtgtactcagaagctgcctgaggacttaattaaaaccagcagtttagcaaagttagggatctgatattctggagcacagatttaaaaaaatctattctccttaaaatccttttatgaaacttcgagtaagagacccgctgaaacagagaggagagaacacatttccacacttggccacctcttgactctcctggatcccattaggggagagtgagtgctagttctctgccaacccaggattaggccctaaggctgccgtaaaaaggatcccaggagaaaactcaggaataaaagtggagaaagtgagacatctgactaaaatgactagaagccctcaggaagt

SEQ ID NO: 713121 - DNA, 189 bp, Homo sapiens
  misc_feature (41)..(41): n is a, c, g, or t
  misc_feature (61)..(61): n is a, c, g, or t
  misc_feature (186)..(186): n is a, c, g, or t
ttgctgcggtgctctacgacggctcccgtggcttgtgttgnttcggtttcatggggtcccnttttggggcctgttgtacgtctgtactttcttgactcttccgctggcggttactacgacggtaccgtgctgacgggccgtgcacgtgcccacttacttgacctggcggcgtgctacccaccacgntga

SEQ ID NO: 713122 - DNA, 159 bp, Homo sapiens
tacgatacgaggctaatcctatatataacctacagaagtctgatacttcgcgggatctaactgagcctatcaccactccagcctaagcccctaccccccattaaggagggcactggcccccaacaggcatccccccgctaaagcccctaagaggtgtcg

SEQ ID NO: 713123 - DNA, 400 bp, Homo sapiens
cctgcgcaaaaatgatcttccagttgcccgagaagatgggcatgggggcttcccgggagggaaccccgtagactcctaggctgtagcactgggcactgtcttttagacaaaagagacgcgccgcgccggttcgcagttttgggggcacctttcttgtggcttgagggcacttatggtctctgtgggccaaatctcctcataagctatctgaccgtcaggtgcttggctcccaggagtcccagggaattgattccaaagctgggaagaggcagtcctctgggcccagcactgtgcaagagtttccatatggtgtcctgggggtgtctgattccaaagctttgcttttaaacacttcagaatggaatttggttgagccctggaagaggaataaaagtgtgct

SEQ ID NO: 713124 - DNA, 386 bp, Homo sapiens
tagagcggtctgggtcaaaccagagctgtagccgccagcctatgccacagccacagcaactcgggatctgagctgcctcgtgtgacctacacaacaactcatggcaatgctgcatccttaacccactgagcgaggccagggattgaacctgaaacctcatggttactagctgggttcgttcaccactgagacatgataggaactctgcgaagcagtttggatttaaccgcatgagtccctcagattcctcaaactttcactgagggaaattattaagcaactcaacattttgaggcatttacatacagatttgtcttttagtataaaacatcttcggtgaatatagcgccccgaatgaaattctgtttttcacacttatctgtgtg

SEQ ID NO: 713125 - DNA, 317 bp, Homo sapiens
atagcacactacagtgttctaggtattataacctaagactgtcagatatcaggtcactatactttaaaagttcaactgtacctcttaattcccatccctcatctctactgagtattctggagactgggagtggggggcaaatgtgtacccggaaatacagtgacaggatggacctcatacctcatagcctgtgctactcagccagccagtgagacatgcctcagtggctctcaaataccattcttctcagctagtagattttagagatcactctgcctgctcccttagtgattagggcagggaaccctccccgcact

SEQ ID NO: 713126 - DNA, 182 bp, Homo sapiens
tctagaggatcccaaggctccaataggggtctggtgtgttccatcgtctgaattctctctcgagtctgcactctttcttaatacattttcatcattttatccaagaataaaacgatgatgcgatgcttgcatgggttgttgagcctagggaatttatccatccatgagccctggcccatatg

SEQ ID NO: 713127 - DNA, 609 bp, Homo sapiens
  misc_feature (352)..(352): n is a, c, g, or t
  misc_feature (410)..(410): n is a, c, g, or t
  misc_feature (512)..(512): n is a, c, g, or t
agtgagccgagatctctccactgcactccagcctgggcgacagagcgagactccatctcaagaaaaaactatcatgtggcaatgtagtgagtgttaaacttttgtgttgtccaaatcctggattatttttcagttcatatctttctgggcttgacatggctgatggggtagcttgaacccttcctacactaaaaagccattaatcctttctgtaataggagcaggaaaatagtaatcatccacctagtaatataaagatactgtgaatattatcttttatacattaaaaccagttctagtttgtaggaaaataccatacaaagtttatttttaaattctagttattttcagngcttacttaaatgtaattctagaattcctccacacctttaataattttgtatgccagngaatcctaaagataatcatgattggtggaagtgttcctgttggcagcttgaagaagaattcacggaatttcggggatggggggaaacaaccaaaaatcaggngccttttatttggtggacacccggggggaccacaccgaattcttaggcccctcgccaaccggcccactgggcccttgcctccctccttttttttttc

SEQ ID NO: 713128 - DNA, 1310 bp, Homo sapiens
  misc_feature (1042)..(1042): n is a, c, g, or t
  misc_feature (1264)..(1264): n is a, c, g, or t
cggactggtggtgtggtgatcatcccaggtttcgggctgtcatgcgttatctcacatggaagcatggaaatccgagacgttccacctctgtccttggcggtgattctggttagggcctgcacggtacttctgagattgtcgcacagagacctgttccacacgcatgcacgtccaaccgttccgtactgctagtatcctgccgttggcagcggaaccatctcctcgaaggccacgaagccgaggtctacgtgtgaactctcgtagtaggctcaatgcgtggcacaaatttggcattgcagctcctaacaggagactagaaccgagcagcgagggtgacagttggggaccatgagggagactgacggaggtcagctgaaggccttggggtagggtcagagtactccagaacgcgggccgttgggtttcaggtgggtgctatactggtgcaccgcgtgaaagggtgcgaggggatacccgcgtaacgcgtgctagcccaaggaaagcgcattttaccgagtgaagcgcacattcaatgaacttggtgatggcgggatgcttgtatcatagggatacatgggtttggaaaaaaactacgtggggtgcgtgtgtcggcgctggaagtagcttatccttccggatgtgtcttaggaataggtcagggagggtggcaccgatggacttttggacacggccctcccccagggattcctttgtggtcgcctttcttgcaatgcaggcgtgagactaattgttacttcgctttgttggtacatagttttgtcaacttttttcaacgcgcccggtagaatttcgcaggacatatcaaaagccacctaattacttctaacattttcaggctagataacccctctggataggcggatttataccattttccaataataattctttcatttattggcaaattatagagcgccaaggtaggggtacaaagcggctctaagattattgtgtacacccttcgggtggagaaaaggatatacaggcggggtgggtgaagagcaaatttttacccgtgtanccatttagaaagaggacattgttcacacatatatatccatttccaggagagtgggtgttgacaaacagcccccatatgtgtgaatggacagggccacatttcgagctgggacttgcgcgatcatgggtcgagtttatccattggacattcaggacagcgcgctgcagacacggtaatatcgtgggcgaagacctcaggagaagacagcggaagactctccanacgtgcatcgaacactataagtttgagcgaggagagtgatatttgg

SEQ ID NO: 713129 - DNA, 357 bp, Homo sapiens
  misc_feature (4)..(4): n is a, c, g, or t
tgcncatgcacagtggagagatggttaacgtcattaatcaataagaaaaggcaaatcaaagtcacaatgtaggggctgggtgcggtggctcacacctgtaatccctggaccagcacattgggaggctgacgcaggtgaatcacgaggtcaagataccgagaccatcctggccaacatggtgaaaccctgtgtctactaaaaatacaaaaattagctgggcgtggtggtgggcacacacctgtagtcccagctacttgggaggctgaggcaggagaattgcttgaacccaggaggcagagggtgcagtgggccgagatcgtgccattacactccaagctggcaacagagcaagactcc

SEQ ID NO: 713130 - DNA, 469 bp, Homo sapiens
aacagaggacattgggaggcagatgcaggagcgcagaggatcaaacagcacgtgaaactcgcacagacatctcacacaggtaccatgaaggtctccgcggcagccctcgctgtcatcctctattgctactgacctctgcgctcctgcatctgcctccccatattcctcggacagcatcaccctgctgaattgccaatattgcccgaacattgccccgagcacacatcaaggagtctcactacaccagtggcacgtgctccaacccaacaatcgtctaagtcacccgaaagcaccgccaagtgtgtgccaaaccagagaagaaatgggttcgggagtacatcaactcttaggagatgagctgggatggacagtccttgcccctgaacaatacacaaaatttgcctgtatctagcttgcacaagtcctagcttggaaggctacccctcactatcctacccctccttgtcca

SEQ ID NO: 713131 - DNA, 417 bp, Homo sapiens
atcagtctcagcatttttttcagccttgaagttaccagtttaaatgaatacagagtactccagttcaggatgacataacaaaaccaaaatcctaacaatatgagcaacaaataggtttaaataactaaactaaagaaacaaaaatattcaggcaatgttaaataaagaatagagctagcattcagcaaaagaacaagacagacatctaagaatcaacctggggcagctccccacagcttccagttttgccatctactgaaacattaagtgaggagaagtgaatgaataaaatcctgaataatagctttcagagagcgagacagaatgagatcaggtgtgtagaagcagcaaaattgccctgaaaggagaaactgtgcctcagtgacttccacattctaccagagactacaaaaaaaa

SEQ ID NO: 713132 - DNA, 887 bp, Homo sapiens
agcgggctgcgggctcgagaaccgagctggagctggtttgatccttcagtgtcctaaaacgcgcgggcgtgcgttctgggtttattgattgatttccgccggcgcgggagcctctgcagagatgagagcgctgatagatggagattgggcagacggattcttttagagctgcggaacaggactccctctgatgttgcataaggaacttgtcctggacaacagtcggtcgcaaatgacagtgcataactcgaaggcctcgcagatgaatttgaagaactggaattcctatggtatcaaatcaaccgtagagtcctcacctcaatcgcaagacttaccaaagtgttaagacagaacttaagaaagcttgtaactaggtcgtatgacagagtctcagggtggccttgtgatagtattcgtgcagaaacatgtgtcccgagatgctcacggcatctaagagttttagaagtgtgcaacccagaatagttagaaaggatcctctagacactgaatacgaggccacgtgagaataatgttaggagaagacctgctacagaggcttaggaccttttgcgattttgcgaggtagcctaaccttgaacgagtaccgagagaaactgtgttcaaggctcctcccgcagtctcacatatctcgacggctatgaccgggacgacaaggaggccctgactcggatgctgagggcgtacgtggagggcctggattgatgaggaatgaggatgagggatgcacgacgagtatgatgaccgatgctccagtattgtaagacgaagaggcgagaggctgaggatgagtcaggtgacaagtagcacgtgacttgagaggggaatcaggataaccaagttataccgagccggctatccgcgcaata

SEQ ID NO: 713133 - DNA, 447 bp, Homo sapiens
  misc_feature (170)..(170): n is a, c, g, or t
  misc_feature (409)..(409): n is a, c, g, or t
  misc_feature (438)..(438): n is a, c, g, or t
acaggctccctggctggcgtcagctaaagtggctgttgggtgtccgcaggcttctgcctggccgccgccgcctataagctaccaggaggagctttacgacttcccgtcctgcgggaagtggcgggcacgatcgcaaggtagcgcagaagcttctcaatggccagcgccanctgcaagccccggcggcgcactcgcctcacctgagcctgggaggaaaattcttccaaggatgatctccactcagagctgaggaacttttctactcagcagatgtgtgtgttttgatgttgacagcacggtcatcagtgaagaaggaatcggacggatctcgctctgtcaccaggctggagtgcaatggtgcaatctcggctcactgcaacctccgcctcctgggttcaagcaattctcntgcctccacctgcctgagttagctgaaantacaggatt

SEQ ID NO: 713134 - DNA, 633 bp, Homo sapiens
tgtaacgctccactgactgatagagcgaccggcgaccatggcgcccggagtggaccgcgggccgacgccgtactggaggttgcgccgtcggtggcgcccgcgactgctcgctgctgattcatcccggttggcagccgcgcaggagccgtccccggagctgttgtgttctcagaacgacaaagacgaaaatctgtgaagagtgcctgaagaaccgtctccgtgtcttgtggtgcaacactaacagaggcttgtctgggactacccagttacaaagcgtcttgccaccgggtttcccttttgtaaatttgagctctgcacgctggggagtttggtgggtgaaccttgtgaggcgctgatcatcaccatgtcggtagtcgggggaacccctccgtcgtgggcatgccaatctgtgctgtgttgcttgcaggaggaagaggagccggaagccggacaggagttgaggagaagggcatgcggtgagccggtaggagaggcggaatacggcaggagggaaccggagagcagaggattgaaggacaaggaccatgattgaaaatccggaaaaaaatattattgggcctgttttaaacgaaagaaaaacccgtattgctaaatttgggaaaaacaacttaa

SEQ ID NO: 713135 - DNA, 151 bp, Homo sapiens
gaacgagcaagttgaacttctcttcttcagcgtcgagctgcttctgatagtccttcttgtcctcgatggccatggagtgatcgaccaccttgaggtagtcggggatttcatcggccttggtgtagggtccggtgatgttgtcgagagcgcg

SEQ ID NO: 713136 - DNA, 188 bp, Homo sapiens
ttggatcatagttagatatcctaaggccagttcctagaactctaagtagaaggcatggttaagtattatgaagaagcaacccattccattactgtactatctctatatccccctgagagattcaccctctattcttaaggagaaagggctgcagatctccaattgctgaaagcgacatccttgcttga

SEQ ID NO: 713137 - DNA, 153 bp, Homo sapiens
agacttgtaatgggctcggcatatataccacctcgaagccccgtattatgcactcgctccacaaaagctgagttggccacctgctcttatgctctcaccatgtgatgtaatatgatggactatctgtgtctaccttcatgcgcagaaacatac

SEQ ID NO: 713138 - DNA, 685 bp, Homo sapiens
tgatgttcttgtgttctccccgcccgtgtccgcccgaccctgcgcccgcgatgctggcgctgcgctgcgtgctcccgctggctctggcctgctctcctgtccctgctgtctcctgatgcctgcatgctgcactccccagcgtgcccagctgctctgcaagcaatggtgctcctgtgctgaccctgtcctcttcctcctcctccgtggaaccctgctcgatgtaccttggactgtggactgccaacctgtgtgaatgcctgctctgtgcctgctgttgtgttgcttgtgagcttgaatgtgcagatgtcgtcccaaaagacatgcttgagaacttcagagccctgtgcacttggtgagaacgtgtgcttcggctacaaagtgctccaccttccacagtggtgatcccttccttcatgttgccatgtgcggtgcgacttcaccaacccatcaatgtgcacatgtgcgtggaagtccatctactgtgaagccgctttcctgacgagaactttacactgaagcacgtggggccaggtgtcctgtccatgtgctaatgctggtcctaacaccaacggctcccagttcttcatctgcaccataaagacagactggttggcatgggcaagcatgtagtgtacggtcacgtcaaagagggcatagacgtcgtgaagaaaatagaatctatcgg

SEQ ID NO: 713139 - DNA, 1813 bp, Homo sapiens
  misc_feature (461)..(461): n is a, c, g, or t
  misc_feature (466)..(466): n is a, c, g, or t
  misc_feature (472)..(472): n is a, c, g, or t
  misc_feature (480)..(480): n is a, c, g, or t
  misc_feature (498)..(498): n is a, c, g, or t
  misc_feature (505)..(505): n is a, c, g, or t
  misc_feature (549)..(549): n is a, c, g, or t
aaatttctttgtaaggcaaagcaatagtatgtatatactttcctaaagatgtcaagttcagtttgcttaaatttaacagtacatgtgacactttctgtttgaagaataagttggttttaagtttataccaaacaaaagcatctcttttgttttgcaaaatctgaaactttgatctttctagttgtgacttcttgtaaatatgttttatataaatattctatgaattggttattaacaaggtaaagaaagattgatatgtaagctgattcttaaacattaattttctggagataacttttttaaaattatgctttaaaaatattttaacacatgttatcaaaaaggaactgaaatatcttaggcataaaagacatctctagaggtcattattcagtttccagaaagtactgaaactatctctgacagattgatacgttttctgcatttatagctctctgganagagnttctgnatatttancaattctcactgtgaggnatatttnaagtatttcaaatttaaatgctcatttcagattcagatattatnatcatcatcattatttggttctggcttcagtaaaaatgtgaaaaacacttttccatcttctgataatatttcatatttataaaattattattaagttataactcagctttttcatttatgctttaaatccttttattatctcatcacaaccatctttgactgtttatcagaaatggttctcttttgtacattgaccattattttatagatcacatttaagttaatataaatcatgcctataaatttcagcctgcttattttttataatctagtcagatatcagctagacatattgttaccaagtttggagagccttgggataagctagtttcaaaactggctgttagcatccctcagttgtgttttgggagcaaaggacacccttaaaaaagggaggcagttatattttgtgagcattataaaataaacttaaattctcataaaattagtgaatatgtttggaacagtgtgaattacgtgtgtgctacatgaagtatatagaattcatttgaagtaggaagtctggccttacctcaaaagacagtcattcaattaagcagttaaacataagccaccataagaagtttttttgatacttagagagagaaaggcaacgtgtattaaaattccgggaccattatctcaggagtgctgtgttattattgactgggggcctgctgggacctagaaatatatctaaaatgtggcaggtggttaattagagcatatgaataaatatatataaatttggttaaagcgttcactttatgggtaaactataactcaattaaaaagaaaaaatatgcaccaaagaaaataaataatgaagtggaaatatagagcctctaaaatcaaagttagaaaaggcagattattcaaatttggcggaattgatggtcaacgggaatgatggtgatagaatcaagtctcacctaagctcatggacactagggattcggtccaagggttaaatcgactgcgtgtaactgaattttttcaagacaataaattaacaggcccaacgtttcactggtaattggggtcgccgtggtgtgtatcccataaggggttatgttctaacatggccgtaattttcaatctgcaccactttacctcgtttcttcggcgacaccacgaaaacggccaaaacattttccatcatatataaggactcacccatttttcttcaacacttttcccaccggcccttctcacactggtccacttaaccctcttcgaacgccttgaatgccaaattccccaa

SEQ ID NO: 713140 - DNA, 430 bp, Homo sapiens
  misc_feature (66)..(66): n is a, c, g, or t
  misc_feature (89)..(89): n is a, c, g, or t
  misc_feature (117)..(117): n is a, c, g, or t
  misc_feature (171)..(171): n is a, c, g, or t
  misc_feature (267)..(267): n is a, c, g, or t
  misc_feature (282)..(282): n is a, c, g, or t
  misc_feature (315)..(315): n is a, c, g, or t
  misc_feature (340)..(340): n is a, c, g, or t
  misc_feature (403)..(403): n is a, c, g, or t
ccatcccaaaaaaaaaaaaaaaaaaagatgtattagaatctggccacaccccaatgtgtgtgtagnacttagaaatgctttagcaaccnccaaacaaaaacttcaaagtggagtagnggcacagagaccatatggcctgcagaatggaaaatgtcacctgtaaggcctctnaccagaaaaatttgccaaccgcacaactagggtgtgatggagaatcccaaggtgacccttccctcccaaagccactcagggaatcatctgaacccntgtggcctgcatttnaacaaacagagacacaaacacatttttaaagangctagaaatcttccctcccaaaacnaagtgtggttaatcaattgaccaaaacccagttttctttctttctatcaatcttaaaatgggngacagagcaagatcttctgtctcggaa

SEQ ID NO: 713141 - DNA, 93 bp, Homo sapiens
ttcaagcttctaacgatgtacggggacatgtctcaattctttgtatatgcattcttttcagatgtattaaacaaacaaaaaccctacaaaaaa

SEQ ID NO: 713142 - DNA, 453 bp, Homo sapiens
  misc_feature (53)..(53): n is a, c, g, or t
  misc_feature (143)..(143): n is a, c, g, or t
  misc_feature (280)..(280): n is a, c, g, or t
  misc_feature (427)..(427): n is a, c, g, or t
  misc_feature (450)..(450): n is a, c, g, or t
ctgtgagtcctagagtctagctctgtcatccaggctggagttgtactggtgtnatctcggctcactgcaacatcctcctcccgggttcaagagattctcctgcttcagcctcccgagtagctgggactactggcgcatgcacncacgactggctaatttttgtattttttagtagagatggggtttcaccatcttggccaggctggtctcgaactcctgacctcaggtgatccacccgtctcggcctcctaaagtgctggcattacaggcgtgacaactngtgcccagccaccagcagtaaatttttgaggaacttaaactaccagccttatcttggtagataccccatcttctcaaccttgatgagccacaggattttgttgttactgttatttgaatttttataattccaagccatttaaagggnacaagtgtggtcagctttattangat

SEQ ID NO: 713143 - DNA, 1633 bp, Homo sapiens
agcggagtgacgcactagggacgcgccctgtgggggcatggcgtccgatcgaggcgggcgttcacgggcggccagggttgagtcccgggtcggggccgggggattgccggcgcatcagggccgagggctggggctggcggggccgctcgctgcctctcgctcgcagcagcggcggcaggcgcgggcgagggccacggggagaggagacgcagccccgcgggtggcacgctcggccgggccccggcccgcgctcaacgggcgcgatgctcttctcgctccgggagctggtgcagtggctaggcttcgccaccttcgagatcttcgtgcacctgctggccctgttggtgttctctgtgctgctggcactgcgtgtggatggcctggtcccgggcctctcctggtggaacgtgttcgtgcctttcttcgccgctgacgggctcagcacctacttcaccaccatcgtgtccgtgcgcctcttccaggatggagagaagcggctggcggtgctccgccttttctgggtacttacggtcctgagtctcaagttcgtcttcgagatgctgttgtgccagaagctggcggagcagactcgggagctctggttcggcctcattacgtccccgctcttcattctcctgcagctgctcatgatccgcgcctgtcgggtcaactagcctcaccgaggtgccggagagggagcgctggacaactagaatgttgacctcgagccgaggccctacttgcagcgcaccggaggagaggctctctagtctgaaggcaccgccggcttgcgccgagctgagtgccgggttccctattccaatcctgtttgaaatggttcttcagcagggcttaaaagagcagccttcatcctgaaaatgtatttccttttgtttaatgctttgagtagataatcctgaattgaggtcatgaggaggccccccaggccagacagtcctgaacccctctgacacttggaaactgaatataagtaaaatgtccaggtggactctgagtatttcctgtggatcctgggaaagtactgttgcacaaaggctgcaaagctggactcaggaatgtcctccaaccagcagcgctgacctaagagctccctgtgccgtctatccagaccagacttcggtagatgcctttgttagatctatcacatgtaaacgagcttgtatctccttccctgtgccacgagagagattggctttttattccagtctaggcagagacagaagaatgttgaataagagcacgattagagtcctgtctggttatctgttgcccaagaaaagaactctgctgtccaggcactgcttggcttactatcccagcaaagactgcagttttgtggacttttgaccaccttgggctggcactcttagcacacctgagacagatttaagcctccctaagagactgaagagaggaacaggtgtcagatactcataggcactgagatctacaaatgggaagcttgtgagtggcccatctttgttggcctacgaactttggtttgatgccagtcaggtgccacatgagaacctttgctgagatgcaaataaagtaagagaatgttttcccaaggaagaagtggtatcaagtaaataaaaaaagtcgtttcgat

SEQ ID NO: 713144 - DNA, 365 bp, Homo sapiens
  misc_feature (101)..(101): n is a, c, g, or t
gagttgaagtcagcagatagaaatgcttggggttaagataaggggggctgtggaagctgaggtacttgttatgtagatggagcctccaggtggcacgctcnagagagaatagatggtaactgtctcttatcagaccttaaaaggtgccagactcttaattaaatctctcctggatcaggaaaagacctggaaagggaaggggattttctacagagtgtagattttccccacaagaaatggctttgtgctgggcgttgtggcttacacctgtaatcccagcattttgggaggccaaggcaggtggatcacctgaggtcaggagttcaaggccagcctggccaacgtgatgaaatcccatctctact

SEQ ID NO: 713145 - DNA, 653 bp, Homo sapiens
taaaatccattctggcacttggtgatgaatgtgttggctggcagctaagaacttgctagaatgcaagtatgcaagtcttcaccatttatatcgacacttcctttccaggaaagagcctttctaatctttgaatcagtggatttatcaatttgcataaaatatgccatcctcaatgaacacatttatcatctaccacttaactttccttctgttaaaaaaaaaaaaaaagcaaattcacctttcctgttgattcagcagcttttaatttcagctgtgcttgggttgaagcttgtttaagggttagagaaggagccattcacttagaaagggggagaaagcaggaattaaaattgattctttttcttatttctccattgatttttttagtgtttctctgtttaaattggtttaaattacccaatttaggtttagattgctaatttaaattgttaaaatttactgggcttgttctccaattattgcttgtttaacagtttgtacttcttggttgtttcgtattttacctaactcttgagagatcttcagagcagcccagctgattttaaagaaggcttccaactgcccaggatatgcatcagcttcctgaacaaagaaaagaacaccccaggatcaacagaagctactatcaatcc

SEQ ID NO: 713146 - DNA, 124 bp, Homo sapiens
gctcgaattcaagcttctaacgatgtacggggacatgagaacctttgctgagatgcaaataaagtaagagaatgttttcccaaggaagaagtggtatcaagtaaataaaaaaagtcgtttcgat

SEQ ID NO: 713147 - DNA, 222 bp, Homo sapiens
cagcaagtttttagcagggccttcaaagtaaaaagaatttgagccccgcatagtgtcccgcccctgtgatcccagctacttaggaggttgaggctgggaggatcccttgagcccaggagtttgaggctttagtgatttaagatcatgcccctgccctccagcctgggcaacagagtgagaccctgtttttaaaaaaaaataaagataatttagctaccttta

SEQ ID NO: 713148 - DNA, 1693 bp, Homo sapiens
  misc_feature (1630)..(1630): n is a, c, g, or t
  misc_feature (1632)..(1632): n is a, c, g, or t
  misc_feature (1652)..(1652): n is a, c, g, or t
  misc_feature (1657)..(1657): n is a, c, g, or t
  misc_feature (1675)..(1676): n is a, c, g, or t
  misc_feature (1678)..(1680): n is a, c, g, or t
  misc_feature (1682)..(1682): n is a, c, g, or t
agcggagtgacgcactagggacgcgccctgtgggggcatggcgtccgatcgaggcgggcgttcacgggcggccagggttgagtcccgggtcggggccgggggattgccggcgcatcagggccgagggctggggctggcggggccgctcgctgcctctcgctcgcagcagcggcggcaggcgcgggcgagggccacggggagaggagacgcagccccgcgggtggcacgctcggccgggccccggcccgcgctcaacgggcgcgatgctcttctcgctccgggagctggtgcagtggctaggcttcgccaccttcgagatcttcgtgcacctgctggccctgttggtgttctctgtgctgctggcactgcgtgtggatggcctggtcccgggcctctcctggtggaacgtgttcgtgcctttcttcgccgctgacgggctcagcacctacttcaccaccatcgtgtccgtgcgcctcttccaggatggagagaagcggctggcggtgctccgccttttctgggtacttacggtcctgagtctcaagttcgtcttcgagatgctgttgtgccagaagctggcggagcagactcgggagctctggttcggcctcattacgtccccgctcttcattctcctgcagctgctcatgatccgcgcctgtcgggtcaactagcctcaccgaggtgccggagagggagcgctggacaactagaatgttgacctcgagccgaggccctacttgcagcgcaccggaggagaggctctctagtctgaaggcaccgccggcttgcgccgagctgagtgccgggttccctattccaatcctgtttgaaatggttcttcagcagggcttaaaagagcagccttcatcctgaaaatgtatttccttttgtttaatgctttgagtagataatcctgaattgaggtcatgaggaggccccccaggccagacagtcctgaacccctctgacacttggaaactgaatataagtaaaatgtccaggtggactctgagtatttcctgtggatcctgggaaagtactgttgcacaaaggctgcaaagctggactcaggaatgtcctccaaccagcagcgctgacctaagagctccctgtgccgtctatccagaccagacttcggtagatgcctttgttagatctatcacatgtaaacgagcttgtatctccttccctgtgccacgagagagattggctttttattccagtctaggcagagacagaagaatgttgaataagagcacgattagagtcctgtctggttatctgttgcccaagaaaagaactctgctgtccaggcactgcttggcttactatcccagcaaagactgcagttttgtggacttttgaccaccttgggctggcactcttagcacacctgagacagatttaagcctccctaagagactgaagagaggaacaggtgtcagatactcataggcactgagatctacaaatgggaagcttgtgagtggcccatctttgttggcctacgaactttggtttgatgccagtcaggtgccacatgagaacctttgctgagatgcaaatgggaagcttgtgagtggcccatctttgttggcctacgaactttggtttgatgccagtcagntnccacatgagaacctttgctnagatncaaataaagtaagagaanntnnncntgagaaaaggg

SEQ ID NO: 713149 - DNA, 107 bp, Homo sapiens
gcattgacaagctgacagagaaatcccaggtatcagaagatggtaccttgaggtccctagagcctgaatcccagtcaagttcagcggaaggcagcccgtctgaaggg

SEQ ID NO: 713150 - DNA, 1590 bp, Homo sapiens
  misc_feature (1527)..(1527): n is a, c, g, or t
  misc_feature (1529)..(1529): n is a, c, g, or t
  misc_feature (1549)..(1549): n is a, c, g, or t
  misc_feature (1554)..(1554): n is a, c, g, or t
  misc_feature (1572)..(1573): n is a, c, g, or t
  misc_feature (1575)..(1577): n is a, c, g, or t
  misc_feature (1579)..(1579): n is a, c, g, or t
agcggagtgacgcactagggacgcgccctgtgggggcatggcgtccgatcgaggcgggcgttcacgggcggccagggttgagtcccgggtcggggccgggggattgccggcgcatcagggccgagggctggggctggcggggccgctcgctgcctctcgctcgcagcagcggcggcaggcgcgggcgagggccacggggagaggagacgcagccccgcgggtggcacgctcggccgggccccggcccgcgctcaacgggcgcgatgctcttctcgctccgggagctggtgcagtggctaggcttcgccaccttcgagatcttcgtgcacctgctggccctgttggtgttctctgtgctgctggcactgcgtgtggatggcctggtcccgggcctctcctggtggaacgtgttcgtgcctttcttcgccgctgacgggctcagcacctacttcaccaccatcgtgtccgtgcgcctcttccaggatggagagaagcggctggcggtgctccgccttttctgggtacttacggtcctgagtctcaagttcgtcttcgagatgctgttgtgccagaagctggcggagcagactcgggagctctggttcggcctcattacgtccccgctcttcattctcctgcagctgctcatgatccgcgcctgtcgggtcaactagcctcaccgaggtgccggagagggagcgctggacaactagaatgttgacctcgagccgaggccctacttgcagcgcaccggaggagaggctctctagtctgaaggcaccgccggcttgcgccgagctgagtgccgggttccctattccaatcctgtttgaaatggttcttcagcagggcttaaaagagcagccttcatcctgaaaatgtatttccttttgtttaatgctttgagtagataatcctgaattgaggtcatgaggaggccccccaggccagacagtcctgaacccctctgacacttggaaactgaatataagtaaaatgtccaggtggactctgagtatttcctgtggatcctgggaaagtactgttgcacaaaggctgcaaagctggactcaggaatgtcctccaaccagcagcgctgacctaagagctccctgtgccgtctatccagaccagacttcggtagatgcctttgttagatctatcacatgtaaacgagcttgtatctccttccctgtgccacgagagagattggctttttattccagtctaggcagagacagaagaatgttgaataagagcacgattagagtcctgtctggttatctgttgcccaagaaaagaactctgctgtccaggcactgcttggcttactatcccagcaaagactgcagttttgtggacttttgaccaccttgggctggcactcttagcacacctgagacagatttaagcctccctaagagactgaagagaggaacaggtgtcagatactcataggcactgagatctacaaatgggaagcttgtgagtggcccatctttgttggcctacgagatgccagtcagntnccacatgagaacctttgctnagatncaaataaagtaagagaanntnnncntgagaaaaggg

SEQ ID NO: 713151 - DNA, 554 bp, Homo sapiens
gccaccacctgccccgggcaagcacgtgcggactacgctacaggcagccaggatgggcaaggagaagcgcgagagaagaacgatcaccgcagcgcggaaaggtagacgaagaccgtcgagaaatggcaacgaagaagaaggcgatcagtaggaaccatggatgatagaggtcatacttcagtatataggtggatctgatggagtatcatgcgaagtaaatccagaaattattcaaagatatcagggaatggggccatgatgaagatgacatgacgctgtaaggcatgttaacccaacatgctacacatgtggaaatttgtcaagctgtgagacctccaattgccggcagtgtatgagagtgacaccgtggatatgaaagaacaagttcacgttacaagcgatgccgtgacactcaggaagtgacctttccctaatcaatggccttcaatggttgatcaatatccaaaagggttatctttgcatgaggtcagttccaaagatatatctaagttccatgaccaacagatggcttgcaagacaaggaccagaatgac

SEQ ID NO: 713152 - DNA, 1157 bp, Homo sapiens
ggtctgacggtcagtggatcggtgggtttatctcaaggcctgagtagccggtaacaaacgagggttcccgtggattggaccgacgcagccatgctgggcatggtagcatgcgcctgtagtcccagctacttgggaggctgaggcaggagaatcgcttgaacccgggaagcagaggtttcagtgagcagagatcagcgccactgcactccagcctggacgacagagcgagacttcgccactgcactccagcctggacgacagagcgagacttcgtctcaaaagagaaaaaaacctctgcgacttgatatcaaaagaaagctaactgctagatctgatcgagttaagagtgtggatctgatcctacagagccatggatgtggcaagtctttacaatggacagtgtgtgtgtatggaatcatgaaacacagaactggtgcaagacatttgcacgtatgtgatcttcctgttcgaggctgcaaagtatgttgcagggacacgcaattggcgtgagacaggagcgggctgccatgcagatacagaggtgttcaactttacaataactctggagcagacgtccatatgtacggaaagcacaacatcagacagagcacttcagactgaaatgggctgtacccattacgaatcaccaggcacatttaccaatgctaaacatatgacaagaatgagagcacgagtggaggatcagtttcacagaccaccggagcaactaggggtataacacacatagagggaacttggcatacaacaaaaggtaggcaatatagaaagggacacagacacacagagcaatagtggagtcagatctgcaaggaaattatgcatgaaaaccacaagccccacgaaagcaattcaacgcaacactcagggctatggagccaagggagtgaccgtatccctatagtggagacgaggaggagctaaatcgacgggctgatagggcaaatgttaggtacatattgcttatcgggcatcaacacaatagcatcagtttacaagagagatgggcacggacacatactgaacaaataggagagagtagatacaacaatgagcagattggagaaaataccaaaagcaaggtgtagtagtgcaggagcatcaaaatgcagcagcaggagaccgtaaacagtattaag

SEQ ID NO: 713153 - DNA, 630 bp, Homo sapiens
ggcgtcataaggcttcggatctgttgctcttcctattgaccattacgcatccgcatcccgtcgccgcgtatcaagcgccgcagaggtttccggtaccgcatctagtagtcgtgccattgccattggtcttggtggtgccagttagatcaccacttagtgtgcgtatagtgtttgcgtcagcgtttacgatcgcgtcagcagacaattcgcgcattaatggtagcgcagcgtgaatatgtgcgtccggttcggtcatggcaaccggtggcagtgattcatcagccacagccggcggcatatgcacaaaggcaggcgcgtcgtcgtgtctcggtggtagggcagccgcagagggtggcggtattgccgccaccattgccgtcagtgggcgcatcgcctatgccatactacccctggcccccactagtcgtgccatcgtccgccgtattggtggtagtgaccgtcccttcttcctcgctaaatcctaaggccatcacacgttcttcctggacgatgttagcctatcgcttgaccaatcggttctgaagcagttgcagatcgtgggccgtgtgtaaaggtggagcctcgcacaaggccacacaacagactatccttaatcagaaatgtgaaatc

SEQ ID NO: 713154 - DNA, 633 bp, Homo sapiens
taggcatgggcgggactcgctgaggtgcgaaaactgtagccagggcagggcttttgaccatctacttgggcgtgaagggtgcggcgcccgcacgaaggggcgtcccagacttggaggcgtgggcccggatgggaggggcggggccgagtgcagtatccctcgcagtatggcgaggcctaggagtatcagagtgctgatcggactatatgtcatggtcgcgcgaagcaggcggagcggcggttagaaggcacccgggggaggatccctccagtaagttctgacccatctaggagcagccgggagccttgctttctagctgtgtggaggacaccttgtcccctcataaccacagtttcttcgccgttcgttcacctacattggcgccccaatggtctagcacgctgacaaggtgcgtactaagggagggggatgcacagccggtttaccattctttgtgccagactatgtctcacaacgtggcacatacacccagggggttaagacatcttatcactggaagtaactagccctgtggcacacagcatattaagaacgaaactttatctggccaattacatagaatataattgcacttcttacttcgtaacaatctcaattataaccaccacgcta

SEQ ID NO: 713155 - DNA, 1110 bp, Homo sapiens
ggagagaactagtctcaagtttttgtgtttttttttgggtcagaaaaaattttttaaataaaagagtaggtatccaggggttaagttttgggtaagcctcggtgtgggcccgtcgggcctcgggcacgctcgaacttccgggccctgggagcggactgtaagggtatgggggtgggctagtgggggggtccctgggggcctgtgcagagaaagtggccgggatacacactctctgtcgggcgcctggagagagggaccggagaaacgcaggagaacagggcgccacaaggcccttaagggggagaggtccaggggcacagcggggtcagaaagcgggaggagactctggcccctcgttggcctctggaggagataggcgggttggcggggcgcccggtgctgggtgtcacaccgcgcgcggtgggcactataactctatacagttggggggtgtaactcttctctggagaaccccgagaactataacatcacatgttatatggggtccccccacaaaaaaaccaaacggaggccgtctcgtggggtttaccccgcggacccaggaaagagatctactcaatactatccgcgggacataaaacacgcggggaaggggggaccagagagggcggacgcgggagagggaggcgaatctcccaataaaaaacaaaccctcacatatacaaaaacaacacacccctgggggtatgagaaatggtgggggcacgctggggcggaccctactaccagggggcccaaaaaacacccttggagaataaacttaggaccccacaaaaggccctcacaaggggagaaagaaaaatcccgcgggaggccacctggggggggcaacccatagggggagacacgaaaacccttaaaagagagcaccctagggagacaaaggcgcggagacatgtccacatctcccccaatgaaaaggcggggcctacctgagcatccgccggaggggcaagagagaggataaggagacaacaacgcattagtagcaccgagggggagaaccatcagcaacgacacaggcgaggaaacacgaaacagagtggccaccccaggggagccctctcacaagggggaccgcacatgagg

SEQ ID NO: 713156 - DNA, 519 bp, Homo sapiens
cgtgggtcgggatccgttaccgtcttccccggcagccgccattgtcgcgctcggagcccctcagctcaggcggcctgaggcggaggcagctgtgctggcgggattggctggactgccaacaatggccgaggtgcccggggccactggtggctgacagcccgcacctgtcggcccgcagagccgccgggcgagccgcggcgagagcctgcaccccgcggaggcggagaagcagcagccgcagcacagcagcagctccaagtggcgttaccttggcgaatgatgaatcagcaaaagaagagaaatctgacttaaccggaacaattctacaggacgtacgaaggccaatagatttcatccttattcaacaagacaagaattcgggcactggagacaaagaagggtccgaattcgtacacagagttccattagcaagcatcccatatgacatgacaatggcaagctattacaagcatctaatgagagcagaacgtcggagaggttacatacgtggagctcttg

SEQ ID NO: 713157 - DNA, 102 bp, Homo sapiens
ttcatatcgagagctttcagccttagggtccagaagagcaatggaggaagtgacagctaatgttgcagttcttattgtatggcatgaaggcgctggatatga

SEQ ID NO: 713158 - DNA, 908 bp, Homo sapiens
  misc_feature (188)..(188): n is a, c, g, or t
  misc_feature (270)..(270): n is a, c, g, or t
gctcctgtgaccccacctggtgcccacccggccccttagacggggttaacccccccaccgaataatggccgtattctaatcatttgcaaaacccttcatagtaaaatataacaccttaacaccgcgagtctttgacacaccgcctcaaatgtgagaatacattccttcaagaaatgttttattctcgnacaatattggtcgggaagtaaaaacttcttaacagagcagccccagcctgaaatatacctgcgtacaccccagacttttcancccggtaacatggtttacccactgcatcgtagtatttcccttgccaccaaagtatccgcccctcccccttcattcccccgccggggggtagaaaccctcggccccaatataatttgggcctcacctgtaaaaccccttgggcctgtgtctattgttaattcaggaagccttgtgtaactgcccacgaagcttctagcgtgtgttgcccggggcaaaaccgcggggtcccgccctccccctcgcccgccgcggtgttatctgtttaccatatatttattgagtgagagagagagcgggagggtcttacaccactccatggtaaccgcagtgtggtttgtggccatcccccgggccccctcgtttcccccctcccgctcacctctccccacagatctcgcgagatacacgcagtgtcaccccctgcacacgctggcgctctcaacatgcctattttaaaacatagtgaatactagaacccactattaaacccaccactgttagttatatctttgttccacatctccccttgctacacgcaccaactctatcatgcagaagtgtgccgcacaattcaacttatagcaccattcttcatagcagaaaaatccctcaaaaaaattaaagcgtcccccacatac

SEQ ID NO: 713159 - DNA, 581 bp, Homo sapiens
agcaacctccaataattcattaacccattttctttttcttttttcatttaaaaatttttatttattttttatccagacgggatttcaccgtgttgcccaggctgatcttgaatttttggtttgaagtgatctgcctgcctcagccttccaaggtgctggaattacaggcatgagacaccatgcccggccttttagtcctttattttattttattttatttttggagacagagtctctgttgcccaggctggagtgtggtggcatgatcacagctcagtgtagactctacctcctggactcaatcaatcctctcatctcagccttgcatagctgggtctacaggaacacgccaccacacctggctaatttatttgtattttttgtagagacagggttttgccacattgctcaggctggtcttgaactcctgagctcaagcgatctgcctgccttggcctcccaaagtgttggggttacaggcaagagcatgtcgcccaggctagagttgattggctccatcatagctcactgtagccttgaactcctgggctcaagcaatacttttccctcggccttccaag

SEQ ID NO: 713160 - DNA, 166 bp, Homo sapiens
cctgcattctctctccctggacacagtccgttcccgtggttcctagcttccaagctcgtacaagacttgcatttacagggctggctgggcaggtttggggctggagggcctggagttggggtcccctggactgagggtcatggattgtgtgtcttctccatgaaga

SEQ ID NO: 713161 - DNA, 217 bp, Homo sapiens
gatcgaccaccggtggaacgggtgctgagcctgcactggccagcctggaatcgaccattcgcgatgtgcagcaggcgttggctaaatacagctcatgtgggagcaggcttctccaaagtgggtcagttaatacatcaagtgactgacacaccgcgttccagcaacgcacaagcctgctcccacattggatttgcgccgctcgttacattgcgcttaa

SEQ ID NO: 713162 - DNA, 875 bp, Homo sapiens
  misc_feature (13)..(13): n is a, c, g, or t
  misc_feature (54)..(54): n is a, c, g, or t
  misc_feature (172)..(172): n is a, c, g, or t
  misc_feature (178)..(178): n is a, c, g, or t
  misc_feature (181)..(181): n is a, c, g, or t
  misc_feature (192)..(192): n is a, c, g, or t
  misc_feature (210)..(210): n is a, c, g, or t
  misc_feature (212)..(212): n is a, c, g, or t
  misc_feature (214)..(214): n is a, c, g, or t
  misc_feature (225)..(225): n is a, c, g, or t
  misc_feature (227)..(227): n is a, c, g, or t
  misc_feature (243)..(243): n is a, c, g, or t
  misc_feature (484)..(484): n is a, c, g, or t
  misc_feature (784)..(784): n is a, c, g, or t
  misc_feature (826)..(826): n is a, c, g, or t
ggcctagagtggnggcgggaggtagtgagggctgcctgggaagcaggatggcanggagggggctggaggtggtggcggtggcagcttggatggccctgggaggggcaggcccggggcaaagcgtcagagctcagctctggatctggggtcctggataccaggcacctttgangaggcnccnaaggagtcatnaaacgggcttgtagagtnantnccctgcatatnanggctcaggtggggcanagtgggcccgtcctgcaccccatggtcctggggccccacccccacgctggctcacgggccctggccatgttgcctgctgctggtcagcgtacagcttcccagggccagccacctcggcttcacacctgcccagagctggcttctgtctgcctggacactcctcccatggctctggggctagggacacccagggctgccttggacacctggggctctcgtccagccagagcctctggcagtncctggggtcggggtcggggccggggccgagtcaggcctgcctgtctcgtggagctcagcaggttgccctcctgttgcatgaacctgggcagccacacacagctggggggcccctcacgcccctctttgtcgctcagacaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtanagtcgctggtcagcggtggacctcagccctcctgcctggtgnctaccggccgaggaggatgcaacctggacgtggcgagcgcgccgggaga

SEQ ID NO: 713163 - DNA, 204 bp, Homo sapiens
tgcttcaacctggtgctatcgtccctatagcaggctgtgccgcgcctcatgctgcctggcggcccgagaggctcccttctgagcctctccttgctgctgatctgatcacctctggctttgtctcttgccgggccgtgctgtcctttgcgtccttcttgctcttccctccttcccttctctccttccctctcacatcaaagcgcg

SEQ ID NO: 713164 - DNA, 481 bp, Homo sapiens
taacataacatagctcattatatcggatgagaaaagggcttaatactgggtaatcatccacaccgtgatagagtacataaatcctggggaaagacatcagttccaaaaattagagggtaatgaatgacagtgacataaacttatctgaaaataatagtaaaatttccttataaaaatcaaataaccggacaggcgtggtggctcatgccggtaatcccagcacttttccaggtcaagggaggcagatcacttgaggtcaggagtccgagaccagctgggccaacatggtgaagtcccgtctctactgaaaatacaaaaataagcctggcgtggtggtgggcgccttgtaatcccagctactcgggagggtgaggcaggagaatcacttgaaccggggaggcagaggtggcagtgagctgagatcttgccatggcactccagccggggcgatagagtgagacccggtcttaaaaaaaaaaaa

SEQ ID NO: 713165 - DNA, 109 bp, Homo sapiens
ctcgagcattcctcccacttggctcccagagtgctggtatgcaggcaagagccaacataccggcgggaaagtttttctttatagaactttggtacctaaaaaaaaaaag

SEQ ID NO: 713166 - DNA, 315 bp, Homo sapiens
gtcgacgacatcaaaacccggttggcatccctccgtagagcagagaacctacggaaacacagaaggaataaagaacaaactagaactcgattctataaagatcccttcaagttccttaaaagtctcttcacgaaggaaaaaagtggagctctaaaaacaacaaagaaagacctagaggagcacctgagaacaacaaactctgatgacttaaagcgacatgaacatctggccatcccatcagatattccacccattgaacccccggaacataatattgagaccagcccttcgacatgataagaggtgaaagtcgac

SEQ ID NO: 713167 - DNA, 186 bp, Homo sapiens
gtcccatttgctcattagaatttcctctcacacaagtgggaaacagaaatcagtttctcccctgccaggtccttgggatggttgacccccgcctcagcagaagccttttgtgagtcggctaagggagctctcacacacctcggctctggggttgaaacctgagcctgcaatagagccctgaaatca

SEQ ID NO: 713168 - DNA, 137 bp, Homo sapiens
tcgatgagtaagtcactgcgttttgacacgacactttgctagatacgttcgcccgacagccgaccctacgttggtttcctccttttggctgctgtggttgatgctgctatcaacgtgggttacaagcatctcttcaa

SEQ ID NO: 713169 - DNA, 460 bp, Homo sapiens
ccgcccatagaagtgttccctgatcaccgcattcatgccaacatctactgtttattattattttttttattatggccatccttgcaggagcaacatggtatcacattgtggttttgattgcatttcccttatcattagtgatattgagcattttttcacatatttcttggccatttgtatatcttctttggagaatggccttagcccactttttgatgagactgcttgtttttttattttcttatagattggtttgagttggttatagattccagatattagtcctttttcagacgtatagatggtgaagatttttctcctactccgtgggttgcccatttactctgctgactgttccttttgctgtcgggctagtcggggctgtcgggctagtcgggggctgtcgggctagtcggggctgtcgggctagtcggggactgtcgggctagtcgggggggta

SEQ ID NO: 713170 - DNA, 854 bp, Homo sapiens
cagtgggttttccggaaggcctgggaacaggaggtcggagaagaaacaaggcctcctaaggtttcttggggcaacccaaaatttccagtgggattagacgttgacccccggcaattttcccctcccctcgcccataattcgtcggttatccccaccggcgtccaagtatttagctgacttcgcccacgactcccccggaagccatatgaaatgatctgcgtccaagtgcttctgaaccctaggatgtcatctttctgtttccaccgtaggtggcctgactggccatgtgtgattacgcccactcatccctagacctcgtatctacccgacacgtaatacgttgtagccccgatgtcccactatggcctatccataggagctgtatttgcccatcataggaggcttcattcactgatttcccctattctcaggcgtacaccctagacccaacctacgcccgaaatcccatttcactatctatattcatcggcgtataatctaactttctgtccccacaacactttctcggcctatccggaatgccccgacgttactcggactaccccgatgcatacaccacctggaacatcctatcatctgtaggctcattcatttctctacagccgtgatattaataattttcatgaattgagaagccttcgcttcgaagcggaaagtcctaatagtagaaggaccctccataaacctggagtgactatatggatgccccccaccctaccacacatttgaagacccgtatacattaatttagaccaaaaggaaggaatcgaacccccccaagctggtttcaagccaccccctggcctccatgacattttcaaaaagaaaaaaaa

SEQ ID NO: 713171 - DNA, 284 bp, Homo sapiens
  misc_feature (133)..(133): n is a, c, g, or t
ggggcccttttttccccccccgggccccggggcccccccccccaaaagggtttggggggggggggaatttaaaaaaggcccttttcctttcgggggggttttttaaaaaaaaatggcccggtcccggggttgngggaggggcccttttttccccccatttttaaccctaaaaaaaaggggcccccgggggggtcctgtttttaaaatttctggaaggaaacccccccccccccgggggcgggggcccggggggggggggggcccaaaaaatttttgggggggga

SEQ ID NO: 713172 - DNA, 147 bp, Homo sapiens
ggccgaggctaactagtcacagccctgatacgcccgctacatatttaccacgaacacaaagaggctcactcacccaccacagttaacaagctataagaaccctcattcacactgagaaaacaccctcatgttacatacaccaccccc

SEQ ID NO: 713173 - DNA, 185 bp, Homo sapiens
acgtcagcgagctgaagacggggggcggctgtatacttggcctgctcctaagtcttctgggtgggggcagtgttgcctgggcaagaactgcttcttcaattccttaacaactgcaaccaccatcacccagatctctctctctctttattttcagtttttttgctgttatccagcaacgaaccaca

SEQ ID NO: 713174 - DNA, 232 bp, Homo sapiens
acatgatacaatcgagctcggtaccttccaggctgattgcaggcgaatcacttgaacccaggagacacaggttgcagtgagctgagattgcgccactgtcactccatgccttgtgacagagcgagactccgtctcaaataaaaataaaaagatttactattaggcagggcatgctgtgctcactgcctgttaatcccaggcacgttgagatggccgagcacgcgacagatca

SEQ ID NO: 713175 - DNA, 496 bp, Homo sapiens
acccagcgtatggggatagcaacctctcaccctgggctaacctatcacaacccttggctgacaggctatgtggatgtggggctgatcccagccggcgcacgcgagatccagcatccaacacataaactaggcatgccaagcaaacacctgcgcggcactgattgagcacccgaagaattcttcctcaatggtggctgcaccatccagtgaagcggactaccacgtggcagggaacaccttcacatacgcacgcaggggcaactgggagaacctcacgtccccgggtcccaccaaggagcctgtctggatccaggtgcctgcctcccgtggcccaggcggggggagcagaggcggagtccccaggcccagcaccctccatggcaggtctcgtcctggaggagtgagccctggttcagtcacagagcctggctctgagccaggccctcctgctgcggcctctacctcagtttccccatctttaaaatggcccaatctt

SEQ ID NO: 713176 - DNA, 301 bp, Homo sapiens
gctctcaggtactccctagctccttgcaagacttgatcttggttacaaatttttcgtctatttatgcctttaaaatacttaatagaaactcattttgctcatgagtatttgattaggcatgcatacaattggagatatttacacatcagtattatgtcatgaggtaacattggtttggtactctcctcttcctggtcctctggtagcacacactggtaatctggatttctcagtttttctctgggactccccactggtttcacactgctctcctcccaaatggagtaatgtttatcccaga

SEQ ID NO: 713177 - DNA, 638 bp, Homo sapiens
  misc_feature (89)..(89): n is a, c, g, or t
  misc_feature (119)..(119): n is a, c, g, or t
  misc_feature (121)..(121): n is a, c, g, or t
  misc_feature (125)..(125): n is a, c, g, or t
  misc_feature (144)..(144): n is a, c, g, or t
  misc_feature (147)..(147): n is a, c, g, or t
  misc_feature (154)..(154): n is a, c, g, or t
  misc_feature (225)..(225): n is a, c, g, or t
  misc_feature (231)..(231): n is a, c, g, or t
  misc_feature (244)..(244): n is a, c, g, or t
  misc_feature (264)..(265): n is a, c, g, or t
  misc_feature (267)..(268): n is a, c, g, or t
  misc_feature (270)..(270): n is a, c, g, or t
  misc_feature (280)..(280): n is a, c, g, or t
  misc_feature (286)..(286): n is a, c, g, or t
  misc_feature (292)..(292): n is a, c, g, or t
  misc_feature (301)..(301): n is a, c, g, or t
  misc_feature (304)..(304): n is a, c, g, or t
  misc_feature (313)..(313): n is a, c, g, or t
  misc_feature (323)..(323): n is a, c, g, or t
  misc_feature (336)..(336): n is a, c, g, or t
  misc_feature (352)..(352): n is a, c, g, or t
  misc_feature (359)..(359): n is a, c, g, or t
  misc_feature (363)..(363): n is a, c, g, or t
  misc_feature (399)..(399): n is a, c, g, or t
  misc_feature (405)..(405): n is a, c, g, or t
  misc_feature (407)..(407): n is a, c, g, or t
  misc_feature (415)..(415): n is a, c, g, or t
  misc_feature (467)..(467): n is a, c, g, or t
  misc_feature (469)..(469): n is a, c, g, or t
  misc_feature (479)..(479): n is a, c, g, or t
  misc_feature (484)..(484): n is a, c, g, or t
  misc_feature (487)..(487): n is a, c, g, or t
  misc_feature (496)..(496): n is a, c, g, or t
aaaagttcctgctttattattccaaataatttttcccatgtaaaataaatgtccaatagttcctggtatgtgggaagataatgtttgtnaaagtcacaatgaagccttattgacggaancntggntatataaacagcacaagtnganaaaaggnttaatctccaaacctattagactggatgaagtaagatcagtaacggccaccttgcgaaattacaggaggtnaaaaanaacaataaaaaanaaaaaaaaacaaaactggtnngnngncacaattggnggtacntgcccntacgggggnatngcaccaggnaggtatactngcaagcaataaanatgaacaccatactgnccatgangtgncattgggggtctcattccttgtagatgtgggatgcntgactntngtggaatnatacctcaaattggtccaactggtggattaccgatgggggcctgtcctggcngnggaagattangttgntanttaggtaantgtggccttctctcttccagggatatatcctcatctggatggatcaacttactggttgcactagttgttgtaagtgtagcaggcttacttgttattgaaagccgctgaattaagctgaagtactatatatgattgtaactag

SEQ ID NO: 713178 - DNA, 831 bp, Homo sapiens
  misc_feature (271)..(271): n is a, c, g, or t
ctgaacgcatttctcttattcatttactatttctgagcatcggctaatggctcctgagtcccacttagtctgcagccacgatataagctatgtagatcctaatcacggacgttttgaacgaacgacttatagtccccattggtgcagcttacacaagtgcatgtgctgtgtcctttgccatgaacaccctgccataatcgtgcatcatctttgtggtcatccagcagtcttgcatatccggtacgactctccgaagtcaggggcagtgatnattgccattgaggactatcttgaagcctaagcaagcttggctcccgatatcgtcaccttggtttgattcaatccgaggatcattgtgctgtgagtcgccgaagacacgaagtcctcctatggagatagttctatctcgacactaatagacttgggttgttagtggacggccgtcctagaacaaatcaacagttctaatttaccctttcttataacgggaccctaatgacgtaaagagggatttctaaaaccggcctcgactgagggggatagcctggggtaaggactgtttcaacgcacctcgtggacatggggttcagcaattatttctaaggcaaggagccttaataagacccacagtatctgaaacagccacaacttcaaggactggaattcacgggcgctgtaagctccccaggacagactaactaggggcgtggacttcataacgtgggatattatgtgaaaggcggaccatttggaaccacgacgggtacctagggaaccgtagtccctctgctaccactcaggatgcgattgcccccgcgccctagatgttgg

SEQ ID NO: 713179 - DNA, 1857 bp, Homo sapiens
  misc_feature (864)..(864): n is a, c, g, or t
  misc_feature (1301)..(1301): n is a, c, g, or t
  misc_feature (1784)..(1784): n is a, c, g, or t
taggcccatttgaatatttggtttccaataagggaaatagtgggaattaggattagaattgtggtgaagtatagtccggatgctacttgtccaattgttgggtaaaaggggatagcttactgggtttgtccctcccgattacagtgttaaaatagaggaaggtctcgcggctagagagtccaataaatgtgattgggctacacgggggcagaaatattatggctctggttggtgtggggctactttatatcgcggagagaagagggggcattaattggctaagagaatagcagcgtattgcgtatcagctcatatgaggcgccaaggaaccgcccctccctaagattgggtcaaaggcacacaggaaactcggaaaaaattgggtgtaagcgcccatatcaaggaaatatatattccctctcgcgggggtctttgagattgttggcggagagagggggtgtgttaacaaagcggtgggtgggggcgctaccaaggggtagaataaacatatgtgttctgagggggtccccgcccctaaaagagaaagggttcctgtggggtgacagagcaaatacaatgtgtgttttacaagtgtgtccattttaaaggggcagcgaaacaacagggtgacaccgacacaaagtttataccgcgccggaaagggcagggctctcatttgagaacatcgtgtttccgtcccacacaacgggggcgttgtggacaccgcggcgtgtatagtacttacacctgcggagaaaaacttgttggcgaaaaggggtagagacaaccccccctaaaagaaggggggcggctaagtaaatatggaaaccccccccccgtttatctacgagtgactcgccaagnaacacacttatagagaaagggggatgtgagaacgagtgtgtcacagtctcactaaaacgaagggacgcggcagtgacaccacatcattagcaaaagacgcgggggcacaaacataacatctaaaactggttctatataataggagtggtgatacaaacccaacaccatctgtgtgttgtgagagcaacggttgttgtagcacagacagtttgtaccacaacttagtaggtagtatatcagccctcccctccccaacgaaagcaattcaaacttctagtgtgtactaaacaacaacaagaagttaggtttgtcgtcgccccccacaccacatgtattttagttgtctgagtgttttgagtcgggaggactatcaatctcataacacatactacgctagtgttatatatacacaagatagtgcgtgtaggcgcggaccncccacacaccataaatacgattagatatcttcgattaggtttggctccttctcgaccagcgtagaggcaggaaggagtataattcaatccctcctcacatatagacatgagaagagggtcgtgatgtcgtcgcgattccaatcgatcaatcaaagagcatggtatctagttatcataggacatcctatcgttcatcattagatatgtatagtgattaggatagactaaagataaaaaaaagtcgacactataatagatatgaaagcaaagcagaataacgtatagagaagagtaagagagagataaatacatacacaaataactaacagacacacagcaacataaaaacaaaatatatataatatcagtacaagaacaataagaagtagagtagcaaacttactacataagaatcacagacaacagcaagcatcatacgatatctatctttcttctctctctcttcttgttatctctctcctncccctcttcttcctcgcgtctcctcctcttccacctacatctcactactcctccctgcatacttcccacgtca

SEQ ID NO: 713180 - DNA, 1263 bp, Homo sapiens
gcgtccctggaccaaaagctgaagtatcaagatgacaagctgatcaagactgcagtgacaggcagccttagtgagaatgacccacttcgttttaagcctcatcccagcaatatgcatgcagcaagttgcagctctgcaggcatgcaggcaggcaagcatgcaagccagccaagcatgcacccagtctgcaggcttccagggcaaagaaatctgtgcaagggcagtgtctcaagcaacatcatgttcctccacgcgttggttcccagtaccattatgcatgaaacagaagctgcagcggcgcgcaagcacagcgtctagcacacggagcccaagcagacgggcattgcagcaagctctgtccattcagtgaactctaacacggagcagtaactccagaatgctcccaagaggcaaaatccgtgatggcgtcgggacatccaccaatggtataccacaggccaagaaaatcaggcagagcaccaaacaaccagggcatttcaacctcattggcagggcagcagcccattgcaatcgggttgcaggtgtatggcgaagccaggtccgaagtcaaaagacggcagcacgcacaagggggaccggggtgccaaaaacgggaggcaaacaactggttccaatagctagacctccaacaaaggtatccatataccccattaaaccagcacacttttcgaggttggcacccattgccgaggtcgcctctctaggacaccagaggagcgcacaactgtggtgatgccattacttggggcatggaagggattcacaggcatatcgcttaattgaacacacaaagctgggacacggaaaaggcaataaccccactcacagcaacaaaagcggtacgaggcgacacaagacaaaacaaccacaggggcacaacaccacgcgaaacggaccgggccggagcagaaaaatacaacgacgcagaagctgtagcaacgcatacttcgacgggcacgacaagtaatcatagtggggctacaatatccatggcaaggacattacgcgtagcgttagcatatgctcaaattatcggggtaataacatacagcatataggacaatataaaccaccggtgagtaagaaatcacacattaaacacaataggcattaaggtagactcataggggaacaacacatctgagattgacgaagaacaagagaaggagcaaatacaagtaaaacggatgaagaacacatagggagacgatgaaaccagtctgagagtagcaaatagataaa

SEQ ID NO: 713181 - DNA, 1061 bp, Homo sapiens
cccacgcgtacgaattatgtcaaaatgaaaactgttcgtttcatgacaaattatatagtctgataaatataaactggcaagtcaattattcactattaattgcagctacacaggcaggtttgctgcagggcagcggtgcagcacctaagcattgggcaacagtcaggccaccatgccaggcttccattccacgccacacatcatattggcttcatctcatagtcgtagtcgacatagctgcctagacaacagtaggagcaataacaaacggctaggccccacaacagaatccatcctcagaacgcaagtaggtatcacccagcacgggcgctagcgcgcaagcacaacgcatgtcttagccccccaccacagcgcacgcacaagcctaggactaacacacgaatgctgcgcacgcaccacccctgctctactgcgcacagcgcctgcgccgcgcgcctgctctagaacgacgcggactaacctataactgccaatgactatgctccacccctgcgccgcctgcgccatcgggtctcaattgcggccaccttgaacgaggtctcatatgaaagcgagactcccccatctccgctcgttaccactgggaaacctctcacgccctactgcgggcccacatgcgtgacacttgtgccccggtgtcgtaacatttctcgcagctttccgtggtctcatgacacccggcgcggagacaaacgcaccttttacccactgctaacacccacgccatcctatctggcttgcttacatactcatacgacagaaaaatatcctttggggcacgtgcttaggagtctcatcgcttcccccacaggtaacttccgaccgcacacaccagggccctccaacgctcctccttcttcggagatcccttcctatcattccgcgtttggggctgttattcctgaccttccaactcggtttggttctcattgggccactcgggtctcctatgctcttgcctctggcctggttggctacccttgaccctcggttgcccgcggacccttgggcatggttccgccggttgattctgccttggt

SEQ ID NO: 713182 - DNA, 898 bp, Homo sapiens
  misc_feature (302)..(302): n is a, c, g, or t
  misc_feature (760)..(760): n is a, c, g, or t
taacaacagtaccctgtttctacaaaattttaaaaatgacccgggcgcggggacccccccctgtatcccccgcatcttgggggggccaaagcagggggtatccatagaggtaccgggagtatccacgaccatcctctgggccttgtccaaaaatgtgtgtgtgttttctctccctatggggactcttattcccaggagcctcctattccgattatattcttggtccccacacagtgagaggacgtgttgaatgtcccccatccctctgtgtaacacctataacccattactcttgccccatnttatgtgaggccgggtgttgtgtggcgtggatctctcaaacgagcttgtgtgtggacttcttctcccctcattattgtgttgtgatctcacagaagtgtatatctcagaaccatctccgtggagtgcctctcttctctctcaacatctcccatataaatttttaaccctcctagcgtgagtcagcccctgtgtgtctgtgtgttgtccgcccaaagaattttgtgtgggctccctataacagcgtgtggggacgcaccccagcggaaacagcgggggcttaatatacttcgcgtgtggctctgtgtgtggcacgccccttgttttgacacatgtgtgtgtacacacacgagcggctctccccagaactctctcaagcgtctctaccacagagtttgttgctaccgttctggggggcctcccctctatagtcttcaccccatctgtgtcttcccccaancacctgtttgcttggtgggtgcggacaccctgtggggcgcacccatatttggagtagcacttatttaacaccgtggtgctcccctccacacaatttaaaacttaccattcgtggacgggtcggcacaacgtgggctcc

SEQ ID NO: 713183 - DNA, 960 bp, Homo sapiens
  misc_feature (912)..(912): n is a, c, g, or t
aaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcaccccngtgattttggaggtgtggagaaggggaagggagggacagctcactggt

SEQ ID NO: 713184 - DNA, 445 bp, Homo sapiens
gaggatatttaaatctagcacatcaagcccattactagagcgagaaatacacccaagctactattactacaacaaccataaattacagttaagaagtcatctgcaacaaccaaacatctaatcaaatatcgcaacaactcacgaattactgagcaaagggcattactacagtatacagagatgctatgcagttttctaacttaaaacagcctatgataactggcagcaaagaaggttcttgcagtagactgcctctgctagagaacatatgacgtaattatcgcatgctgctaatatactatctaaacactaaagatactcctaaaatatttgatggtagactatgaataagacattacactacagaaaaactttatgcagaaggaaatcctaactgacgagcttctgctttaaatattgtgaaaacattacagcgttatgaatt

SEQ ID NO: 713185 - DNA, 1005 bp, Homo sapiens
  misc_feature (583)..(584): n is a, c, g, or t
  misc_feature (587)..(587): n is a, c, g, or t
  misc_feature (957)..(957): n is a, c, g, or t
aaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaggcccccaaaaaaaggggaaaaatttggggggggggnnaancccgaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcaccccngtgattttggaggtgtggagaaggggaagggagggacagctcactggt

SEQ ID NO: 713186 - DNA, 743 bp, Homo sapiens
gctattgagtggtggtggaccacgcctgacatccccactcaagaaatctgacccggtcgtctcgtaccgtgagacggtcagtgaagagtcgaacgtgctctgcctctaccaaggtcccccaaacaagcacaaccggctgtacatgaaggcgctggcccattccccagacggcctgtgccgaagaacatcgagtaaagcgcgaggtgtccgccccgtcaggagactcaagcagacgcggcgccgctatcctggcccgagcaagtacgagctgggacgctggcctgagagcccgcaaagactcttggtcgcttatgaggcccagacggcaccctgggccccaaacatcctacaccgactatacaccaaagggtagtgcagtagctacaaccgaggatacaaggacaacgcttgttgactggcaccgggactctcccccagtggggccacccaaggaaagggacgcactagtagatagagggaagaacaattcgccggacggtgtagcagctctcagaacggatacaaaagaacggtccaaccccctgacacagcatcgatcggccaataacaaacacaaacgtgaaaagaggaggcccaaggaatccagtacgactgaaacaagcacacgagaaggcttagcaccctcttacggccgaagtagtggcatagaacctagcccaacaacaaaaccacgtccagtgggcagtcagccaatcgataacattggatagggcagaatcaca

SEQ ID NO: 713187 - DNA, 1243 bp, Homo sapiens
  misc_feature (436)..(436): n is a, c, g, or t
  misc_feature (641)..(641): n is a, c, g, or t
gcgctaacctttccgaggtgagtggttgtgtgatcgccagtcttagggaagagatgttcgtcgtctcggtgggggcacgctgggcagcaggggtgaactcgcacattcgaatcgacggctcgagaatctggagctggtgcgacggagtggctctcgagggaccatccgacagtgagcatccgcgcatgggacccacggggccaagccccgaacggctctcggcaatccgtgggcaagtccgtccgaccggtggaaagaagtacagatccgatgagactttggctaccgacgaaaagtatggaatgacaactgtgatgggctataggctagaggagtcgtgtagagatctagtaggctactgagcataacaactggctgatggctgcgcctcgtgggagtttgtacgatgaatattgccgttgtgcaaggctggaanccctgaagaatgctactagagggagcgattagtctttaactggaattatctttctagattagcaccttttagagagggatggaaatgtggtaggctacagctgggttatagagattaaataggggagtggaggcctgccgaacatgtgtcctttggcctaactgccattgtgcacgcggtaactcatgcaagggtctggcacttntgtatgacatgttgctttagacagctccttgggaatagcccaatggaatggccttgggagaaggaagagataactctagttctctgtgaggcgcaatcaacatatgacctttgcagcagtagacggtagtttgccaaaggtggctggaaactgcctagtgtggctcggacatttggcccccatggggaatctctatgggaaagggctcgggtaaagcgagtcctgaaatccagagactgcaatggcaccggttaatttggcgcatggactgcttgagtgggacttgctacgttcccgcgacatagtggctgtttcacagggagaccgaaagggggctaattagaaggcatttggcaggacacacggggggggtgtcggttccccaccataggggggagtggacggacctgtggggatcactatgcccacaggaattgcacaaaggtttgccgcctgccttttgagaacacgtcacttcgatgagaagagcccctgggccaacaagttgtggggggcgctccaaaaagccccgcgaaagagagtggtggctaaacgccaaagagagcgcgtggatggaccatttggacacaaggcgtgaaaaa

SEQ ID NO: 713188 - DNA, 534 bp, Homo sapiens
agatggagtttcactcttgttgcccaggctggagagcaatggcatgatctcggctcaccacaacctccgcctcctgggttcaagcgattctcctgcctcagcctcccgagcagctgggattacaggcatgtgccaccatgcctggctaattttgtatctttagcagagacgggattcctccatgttggtcagactggtcttgaactcccaacctcaggtgatctgcctgcctcaaccttccaaagtgctgaggcagacagatggcttgagctcaagagtttgagatcagcctgagcaacatggcaaaactctgtctctacaaaaaatataaaaatcagccaggtatgttggtgtgcacctgtagtcccagctactggggaggtcgaggcaggaggatcgcttgagccctggaggcttaggctgcattgagccatgattgtgccactggattcttgcctggtccactgtcttacacataatgggaacaaactggtttccccttttaacaagcttaaacagctaacaaacttggtc

SEQ ID NO: 713189 - DNA, 1216 bp, Homo sapiens
  misc_feature (1216)..(1216): n is a, c, g, or t
gcccggctcgcgtcccagctccttccgcgcggctctgcgatgcgtgcctgcagggtgaccctggtgcgggagtcctggggaccctgcgatcatgccccggaggacggggtggggtcggcgccaaacatggagcgccgtggacctgctgtggacccctgcactactgtgcgatcctgcctgtcctgcctggtgtagctctgtgtgcatgtgtgagtgtccctgtgatgatgtgctgacaaatatttatcctgtgccccgctgcgtccgcatgtccgcagccgaccattatcctgtgtggcctgcccagcttacagcttaacgtacttcctgcgctgaatgcctgactcctcacatatgctagaaggaaacttgtgggtgccatctcctggtgatggacgatgaaggggctttttgcccttttgagaatccctgtgtgagctgcctatcgtgggtgccttgcttacacgcgcgaaaggcattggggggggatccgtacccgtgtaggaaactcaatgggcatgggtgtctcgcctgggccttgggcgcttgggtggtaccctgtgtggcgggttaccctatttccccctccgtacttatccctttacccgcaacccttactggctttgtggttaccccgggtgtataccgctaacccttggccggcccccaagttggctggggacgctatgctactacctgaagcggccccggccgtatgccaccatcatccaaacccctgagcccaccaaggcaggctaaggctggaaatccgccgggggccccgttggggattcaagcacctgtgggtgcgccatagagtggtttgcactttggcctattctccactagaagatttggaccctgcggtggttggcagcaatggttgaatgtgcaaacaaccaaccaactggtgcccttatggagagggccttgacatgcccccaggaaagaggcccagacgagcgatgggagcccttggggactttggaagcatataggggcttcccattggtgtaacatcacccatgggacctactataccccccaaatttgttgaacaccccgagacagtcggtaagcgagctattgccccaaacgtgaaccgggcagccagggggtaacaccccctccccaaagtgtggcggggacaattggttgggacaacaaagggccaaaccggcccccaggaaattaggggacttgacacacagccacn

SEQ ID NO: 713190 - DNA, 306 bp, Homo sapiens
cgggttgtcagcgacccttctctatctcagtttctgactagctgggtctataggtgcacactatgtgcacctaattcttaaatttttcatagacagagggtcttgctatgtggcccaggctggtcttgaactccagcctcaagcaatcctcccaccttggcctcccaaagtactaggattacaggcgcaagccactgccccttagtccatttcagtggttttttctttttttttttggagacggagtcttagtctgtctctcagcctagagtgcattggcatgatctgggctcactgcagcctccc

SEQ ID NO: 713191 - DNA, 108 bp, Homo sapiens
actacatacttccggggggcagtgccgtttcacgggaggaaggcagagctccttggcgatatctgcgttttggagagtcaaggcttcctccaccgcggaagtatgtag

SEQ ID NO: 713192 - DNA, 1144 bp, Homo sapiens
  misc_feature (127)..(127): n is a, c, g, or t
cgtgatgtcgcctgtccgtctctacgtcccatcggggtgtactgtcttccccactctggtctcctggcctcgctgggtttgttttctccccctgctatgtttctatactatgtgtgcctatgcatcnctcatgtggtcgtgcgtcctttctctatattgtttcgggtccgcttcgtcttatggtcgctgcgattgcccctcttatgtccctcggtctttgtgtccgtgcctcattctctctattggctgcggtccccggggttcacgtcctgcgttatatcgtcgttgtggtaatgtcctcgtccatttctggtggtggctcgccccctttggtgaacggtgtatcatacggtgtttgtatttcgtcccggttctttttaattggttccttcgagcgatatgtctgttctgtgcctgtgtcttccatgccgctcagttttgtctctgccctggggcatcgtttctctttgcttcgcggtgtacgtcgtactgtgttgtgtgtcgcaccatggccttccttcatagcagtggtatatcggcggttccttttggtatttcccctacccgtttccacgtccatagtcggtcgtggtttccagtctgtcctgtcctttgtggggttttagatggtgacattctgtcctttgctgtaatcgctccccgtgcctccctttttgattggtagcatcctcctttttgtctttggtatcggctctggttgcaccatcgtccgttcctcaccttggggtttctcactgggatgtctggtggtgtggggcaccccaccctgggacctaggtggcgcctgctaaaccacactggactccggccctcagtaaccctagcgcccaagtccgtccacctcgacgttgtacaagcccccccttccactgttttccttgtgatggtgtgtcttctttgctgataggaaacagactcgattcatagtgaatattatatatttgggtattgtaacagggaggggaagagggggcgtatcgcggcggcgttggcccctgccgcctggtactcaagcccgtcggggacattgggacaggggacccccgcccgcttgccctcccctctctgcaacgtactgtggattaagaaacatgcacttagtctctaaagagtttatcgatta

SEQ ID NO: 713193 - DNA, 89 bp, Homo sapiens
aagacagcagcatatatctctgcagcgtattcgcagggacagctagaaccggggagctgttttttggagaaggctctaggctgaccgta

SEQ ID NO: 713194 - DNA, 1528 bp, Homo sapiens
  misc_feature (271)..(271): n is a, c, g, or t
  misc_feature (275)..(275): n is a, c, g, or t
  misc_feature (277)..(277): n is a, c, g, or t
  misc_feature (314)..(314): n is a, c, g, or t
  misc_feature (362)..(362): n is a, c, g, or t
  misc_feature (376)..(376): n is a, c, g, or t
  misc_feature (423)..(423): n is a, c, g, or t
tacctcgcatatcagtagaaagagcttagcactctttcatgatcacgcaccacttcatttagtctattgattgccttgactcttgctctcacttgagtgctcgtgtagtcgcccttcttctctcttaatcgactcactaatcgatagacttatacataagtgatcataatcaattctcaagacagcctcaggagaattcagagaactcggtgccatgcaactatcacctcgcacgggcgcaagtcactcgcgtagcgctcctctctagtcncgcncncatctcgccatgcgcctactgctactctcctcttacnagtgaagcgatcgaccggaaggtcacaatcgcgactcacgcgtctccntatactcaactcanagaaaatcgagagtgtaggtgcctatcgcgaattgcgttactcaganacacatatacccgaatgtgaacgagcacggagctagtccgtgacgaaggatctgggaattctatgcgagagcgtcctctcacctatggacgtgtactccgccaatgttcatatccgctcatgtatatcctatgtgtcgaaacccttgcagtgatctcccatgtgaagccgagtgtgtacgacactgcgcatggtgaggctaagcttcctcggtatggtgacaaggcgccagcccgattgtccggtaaacttagatgatatatgatcgatacaacgtagagcagcgcttgttggcttaccttccacgttgacggcgttggtgcgcacgcaatcgagtattacgcgcttcctaataacacatccgcggcatttggtccttattgttccccctgtgccaccagattactaaaaaaacgccaagaaaccccaaacttatttcaaacccggacttaaccaaacggaaacccgcggcgggcggttctattgaccttcaaacaggggtacacaaattctgccatacctacggcaataacatttccctgggtggcggaagcccaaaatagcgcggaacaaagttgttctgcccaatggggcacacggaatacgcggtatccctttcaggcccaaattccatatctttccccccccttctcagatacaaacaatacgtattatcggcacacattcaaagggggccccccccgtgcctaacttcttctaacccaccccttatacttaaaggaccagaacacgagccccgccgttagcggtaaaaggacaccccccccattacggtcaaaggaaagtccccaagaagagaagaaggagcgaccacacaccacacacaggggcggggcgcagcagcagaccgcaacctcccaaggaaaggagtatccttcacccgcctccaaaagcggcgggggacccccaacacgccatattagagcggcagcgggttagcgccccagagagcaatacatagctcgtcggcgtcgcaccacacggagtggggcgaccgcccccgaacataaacgggcaagacagcagcccgcgcctactagacatacaagcggccgaccgaaccacccaactgttgtaggcccgcg

SEQ ID NO: 713195 - DNA, 640 bp, Homo sapiens
  misc_feature (190)..(190): n is a, c, g, or t
  misc_feature (194)..(194): n is a, c, g, or t
  misc_feature (572)..(572): n is a, c, g, or t
  misc_feature (609)..(609): n is a, c, g, or t
gtctgaagatctagaagagcaatcagtgctcttaaccactgagccacctcttcatcccttatttttttcttatatttggtattatatgttttctctctatcctaggttctcaataatgttttacaacttctatgaaaattcaaagagtctaactcaaatattttaatattgtctcgtgccgaattcgganagtntgtgactgagcagccatggacagcggcttcggctcggattttggcggcacgggtggcgggaagctggacccgggggccattatggagcaggtgaaagtgcagatcgccgtggccaacgcgcaggagctgctccagagaatgacggacaagtgtttccggaagtgcatcgggaagcccgggggctccttggataactcggagcagaaatgcatcgccatgtgcatggaccgctacatggacgcctggaataccgtgtcccgcgcctacaactctcgactgcagcgggaacgagccaacatgtgaccgggaccctgtgcctcgggacaccgtgcttatggtctgaacttgttttccctgccagttagggtgtctccttcntagccgccctgaagtcttggcagcatggaagggcttnggggattcgaaggcctcttccctggggttaa

SEQ ID NO: 713196 - DNA, 372 bp, Homo sapiens
  misc_feature (42)..(42): n is a, c, g, or t
  misc_feature (102)..(102): n is a, c, g, or t
  misc_feature (241)..(241): n is a, c, g, or t
  misc_feature (280)..(280): n is a, c, g, or t
tgttgggtccgccgaggatctatgtctggctggaagacgaancctctggcaatgtgctgcctgcaaaataacgtcaacgtcgaagtgattttcgcttgccgncgaaacctcatgccgagtcgtcggggtgaactcgctaatgcgtcgatcaccgctgttagtcaccctgcatgtcaaacgtaacccgtcgtaagcccatgctcgtcctaagcgttcaggtcaacgaagagccccccgtggngggtggcgccgacgatctcggcgtcctgaatgtgatcgnggcggcggcaggaaaacttggcgaagccgcgcgtccaggacgacccgatgaaccgcccgacattcatctttcggttggtgggctgacgtcgc

SEQ ID NO: 713197 - DNA, 368 bp, Homo sapiens
actgacggggtaattgtatgagtactttgctatgaccagatagataaccaagggtggatgctggggatagactattctttatcctgagatgctgttctttcacttctttccttttattcagcaggttggggtaatttacgcgtcccttctttaatggaatgatggcaatagtacgtggcagttgcctctcctaaaatgtcctcaatggaccagatcaccagtgggcaattcggtgttgatttctcaattctcggccctcgctgatcttatccgtgtagttttaggggcaccaagacctagatgatcttaatgaagctttccgagttatgtgtgattgaggggaagaggaaggagaacactgtatcacg

SEQ ID NO: 713198 - DNA, 147 bp, Homo sapiens
acctcttctcccctgcacagaaaccgcatggcatgagaagtgtcacgtttcccgcactcgtcccttcccctcaggctccgtggccaccacacattgcttgctggtgtctatatgatctgcctaatcctgcggcagccttatatgaat

SEQ ID NO: 713199 - DNA, 126 bp, Homo sapiens
gcaggcctgcccccgatgctagtccatggtacattctgggaagcactggccatccagcctactcaaaggcctgtcctggcagggaaggacgcacattcacctggccccaggaatgcctggagaccc

SEQ ID NO: 713200 - DNA, 407 bp, Homo sapiens
ggtctcttgggttccggataggtggcagatgaggaactcccagtagaggggccggtgggacgctctggcttgacaatcgtcctggccactgcagtgcttgtactgaccgctctgggcatggcactcaggatggcaaaccagaggtaccagtggcccagtgattatgtaatgcacatatgtttacacttgaatatgctatgctctaggactgcatgaattacgggttacaacagcggtcaaagtcaagcctcaaactatgagctgatacgagctcggaagtctgccataaagatcttacatcacatagtgccaagtaggttatcgagtcgtgcattctctatgagtggtatgcttaagagagccttggaggcattctcttacctgactttacctcatgtctgatttct

SEQ ID NO: 713201 - DNA, 443 bp, Homo sapiens
aataccagcaactccgaagacatcttgtcctcggcctgctacacttgaggaacctgatgcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatatcttggaacctttacttgggccaacaaccttcagaaattcaacttccgatttttaggaggaaattttcaagcaaatttaggtttcaggaagatatgacccagctgagaaacccttaagccttcgttgaatgggttttttggtcattcttgtccattatttgggaaagttcccaggaaactgagaggaaacctaaaaactgtg

SEQ ID NO: 713202 - DNA, 201 bp, Homo sapiens
ccggggcccgggggttttttttttttcccgggggggccgggggcggggggggcggtgggtttcccttggggggggtcccggggccccccttggcccccccttgtccccccctggttttgggggggccccccaacctttgccttttgggggaataaaaaagggccccccccccgcccccccggtttttttggggtttttcca

SEQ ID NO: 713203 - DNA, 823 bp, Homo sapiens
accgctgtgtctcaagttacagcgtgaaaattgctccctcacaagtctcggctcagctgtatctttcaaggagcatgcgtctgttcttcgtctgtgttcccgtcccacggtgactttcggacccataatttgcagaaaattcatccgcgtggtcgatcaacacggcgcagcttttgattgtgtgattctttgaggtcctagaggatctttatcaatcttttgccagaggatatgggttcgcatgtcagaggtaaggatgcgttcctgtatcgatctgcagacacccagaaggtggctgcacactgcatgctcggggattctcaagggattacgagacctccaacatactagtctgaaggcgatgattctgaccatggcccctctgccaagcatgtgtgcgatgcccttggtgtctttagtgcatagaagcctaggctcagatagcacagcagcgccatctttccgtttcaggggttgtgatgaaggccaaggaaaaacatttatctcttactatgttacctacgtataaagttttagttcattgggtgtccgatacaccctttgtatcactttgaaatggcacttctattcttttttcttccatgctctgttctcttggacatttggggatgtgagtgtgtagagtctggtgagagaggagatcaggtggccttcccaccgatggtcctggcctccacctgcccatctcctccatgcctgatcaccgcatttccaatgttgcccttcaagagaacttaagtcaaggagagttgaaattcacaggccagggcacatcttttatttacttcagttatgttgggcg

SEQ ID NO: 713204 - DNA, 571 bp, Homo sapiens
ccaccgtctcatcttgctgaatcagtcagagctgctcccaagtataataggtaaactggtacagggaggtattctgggaagtttcggaggcatggagttggcaaagctaaggagtgacaagcattgtcggccgtctctgtagctggggcagcggccactaatgttttctgatagagggattgtgacagtggacttgagcacccatggcaggttagcgggatagatggagctcgttctgcgcttgtcggaaagatacttcagcaggccccgtaaaataggacctatgattaaacgtgtggtaaccaccaggcaaggataccaggcatttccaccatttcactcacccgccccgaccctgtttccttcccacaataaactagaaagaccatagtctctttcttcctttgattttgcccaaataacagctgctcagtttgttacataggtattatccagctaaagtgacttctctcccttaacagagagaagaggggacaaatttggttgtgaagtaaacaagaaacacaagacggctaaaactctccaggggcaggtaaagccctgctgggct

SEQ ID NO: 713205 - DNA, 143 bp, Homo sapiens
tgctgaatggctgagcgacttccctatctccccagatgtcgtgcctttccctgtgtgaatgttgtatctagcctaaagtttccctaggctttcctgttccagagaggtggggctggatgtctacatctcgtctcttccttgta

SEQ ID NO: 713206 - DNA, 1389 bp, Homo sapiens
  misc_feature (208)..(208): n is a, c, g, or t
  misc_feature (259)..(259): n is a, c, g, or t
  misc_feature (820)..(820): n is a, c, g, or t
gggtcatggagaaaggtgaccctgatcccaagaactgtgcctccgcaagtctctggtgttggggagcggcccgtgatgtcagtgtagagcttgggtgtgcgtgtaggtctatcggtgtggatactcctgttgttccagggtctagtgctagatgtcgcatagtgcatcacatgactaccgtgcgagactcatcacaccacctaggttnagccgtcgtcgaccatgatgggaccatactgctcatacgtgcggaattaanatggaggtggtgatcacttactttcatgggtgatgatagaggacgagtggctcacgcgttgcgacaggaagtgggagtggggtgtggtaagctaatagatggagggaggaaggagatcaccttcttgagtggactcataattcgcctgaaggatgtcctgtttccgtgaggtgccacaatgttagctgacaagaccatgcatctacctcccgttgatcgttgtgagtgacgcggcatcccacaaggacgcgtagcagcttagggccaccgagttgacatctcgaatgaccacgccgacttgtgcaatcatgttcctggggggcgattggggactcgggatcgacgaatggcttcgaagtgaaattgtatgcgcatgggctttgtgccactccagtacttaagtggttcctctcggggaaaccaataggctacttggcttttaggtgagggactctggggggtttaagcacatttgtgttaaatacactcatgctggaataggctcccttgggaaattatctgggagttaacataaactgtgccggggtggtggtgggaacntgaagcggaaaacccctttcatattccttgtgtgcccttgtttggtcccccctggggccttatccaaaacccgtagaagctccgtaaggcaaatggtttctccgtaaggctaccggcccatgtaccacgtatggtttgacaagcccctttggagtggggcttgggacaagaaaggcggggtttcaagcggaagagcgttgggaaccctcccagaagagaatctcccccttatccagcgttcttttaggcgtcttcccattgtaaccccccttgtgtcccagtggaagcataccgagagaacccgcgggcccgcagaattgggttgggttggcccccaagagaaacgcccaggttctggcgagccccaatattgaaggcgcgaaagggggcaaaaacccggggaaacttcgggtccaaggaaacaaccgatgggggcgctgcgagagaaaggcacaaacaagagcagcgccaagaaggaaaccgcgtgcaccaaagctagggacgacggtatagcgcaacagcgaacgagggagagagccaagagcaccagagagcaccaacacaatagc

SEQ ID NO: 713207 - DNA, 881 bp, Homo sapiens
  misc_feature (1)..(1): n is a, c, g, or t
  misc_feature (25)..(25): n is a, c, g, or t
  misc_feature (82)..(83): n is a, c, g, or t
  misc_feature (104)..(104): n is a, c, g, or t
  misc_feature (259)..(259): n is a, c, g, or t
ntgtgggaacttggctgagcagtgntggaagccacagttctcgcattgaccgcacaaacttttctaatgataaaaccatctnngggggttgggtacctctaatntataggattagatactaatagaagagaaaaattgtaacacactgaacaatagatactgtatgttcttaagactatgtatactagaataatagtagcagagtagggtgaaaaggaactttctgttctgtttgtaagcgactgggggggctactaanaatgtctgacactgaaaaaaaaaaaataaaatatgttttcaacaagcaaaaatatagtattctaagattaaaatgtgattacaaaatatttagtgtgaacatttaatttaaacttgtctcatggaatctttaatttcaatgaacattaccgcttatatatgttatttggggagacatcagatacagttaaccatttaaaaattatataagaaaaaataaaaagaagaaaaaaaaaaagatgaatggtagatagaattgtaggtacaaaggggagtggcttggggtgtaattggggtttatgtgatgagggggtttgaaagatactggctcgatggcggggttgggcatgtgagcgcgagagttgtgtgtaatagaaatagagtagtcgaaattgatttttttagtctgattgtcgacatcggaatgagataagagtatggggggggcgaagacattactcatgttgagttttcggctgttgtttcgcggtgtgagagatagtatggtaagatcgtgagacgagtgaggggggcgcgcacggtatgattggatcgtgtggcaccagagtagtggattacgtgtgggtgtagagtcattagacgccccggtggatgtagagcac

SEQ ID NO: 713208 - DNA, 223 bp, Homo sapiens
acacataggtgaattctttgccctagctccaagtacagctatctagtactatacgagacttaaatcgtccaacaaatactatgcgatcatttaggagcattccattcatttttttcaatagctctataaagctgctatactgcgtctcaaagtgtacaaatccatagccctaggcaacattttcatcacaaaccaccttacatgacaggatgttaccaaaagc

SEQ ID NO: 713209 - DNA, 201 bp, Homo sapiens
caagctcttaaggagccagtagtaaataaaacaagccgattatacacaatgccatatcccattgctgcctgcctgcaaaagtgaacgaacccaacaagaattccatatggcaggagctgcagaagtgtgatgccaatcattacatcatactgtttcgtgatgctggctgccaattcagcgccgcataactagctactatac

SEQ ID NO: 713210 - DNA, 226 bp, Homo sapiens
catgaatgggctctcacgtaagagcttctgcagacactgggccaatggggagggaacagccagtgagaaaccatgccaccaacagggctgtccaggtccaccaagttattcctcacattccagcttggcagctgtgctggcgggcctaaagagtaaataacggctgcagccaggtccaggagtcttcctcacacgcttcagcgaagagtccagagctttgctcctg

SEQ ID NO: 713211 - DNA, 298 bp, Homo sapiens
tccatccaggtttttatcccccggccaaaaaaaaccaaattttaaggctaaacctttttaaaaagaaaagggggatttgggggcccgcggctttaaaaaaacggcccccggtttaaggggcaccccaaaaggggtttccccggtccccaggggggaaaaaaaccccaaatttcccataaggtttcccctaaggaggggggggggggaaaataccccttggaatttcccggcccaaaaaaagggggcgggctcctttattttaactttttccggcaaaagggaaaaacccccggggggg

SEQ ID NO: 713212 - DNA, 968 bp, Homo sapiens
aataataacatgatggccaaaactttggaagagtgtagagttaccttggaagggctaaaaatggagaatggctctttgaagtctcatttgcagggtgagaagcagaaagccacagaggccagtgctgtggagcagacggcagagcagctgcgacagttccagcaacatgttgacacagtagcccgcagcagcagaaagatctactggcaactgtcttgcaaatgagctcagcacgaagcaattcactcaaaggccaaacggtgcaacattaaaccatgtttccaagtctgctggccaaggtggcaaaaggattattcatacctgaaggcagatcatgtgatcaccaaagccgaaccagcttgagcagaaccagcctacaagctgcaagcaaacaccgccatccagagcagtgcatgcagaggatcgaaagacatgaaagaaaccagtatttgacattggcaagatcagtgtggcaacagcaccgggctgtcaagttacacaataatcaactcatcagtgagctagaacagtagtgtgactcaagctggaggaacaggaagtcaagacctggagaggcagctgaagactctgaccaagcagatgaaggaggagcacgaggaatggcaggcggcccaggcggatctgcagaccgcagaggtggtggccaatgacatcaagtgtgaggcccagcagggagctgcggcagccggtgaacgacgtgaaacctggcgtgggagcgagcgacggagcacgaaatggccccggcatgcaaaacggagactgcgggggcaatgactgacaggggcacaagggcaagggatgggagcccaaggaaacagcagggcaccgtaccacgctggcggccagcccgcaggcagaaggaccacgtgaaggaccgaaaggaggcaggaacggacgggccgggagcgcacaagaaagcggaacagaagacaaggagacacgaggag

SEQ ID NO: 713213 - DNA, 261 bp, Homo sapiens
gaggaccattgcagtaatccaggcaagagatgctgggggcttgggtcatatgctggcaggggaggtgctgagagttgataaggttctggacataacgaaaacacaacagtgcaaaccctgtgggatgcagcagaagcagttctaagaggaaagtttataacaatgcaagacttaggaaataagaagaatctcaaataaacaacctaaccttaacctaaaggagctagaaaaagaataaacaaaacccaaagttagtcgaag

SEQ ID NO: 713214 - DNA, 277 bp, Homo sapiens
ccttctttatcttgtggaatagtgtcagaaagattggtaacaactcttctttgaatgtctggtagaattctgctgtgaagccatctggtcctggactttttttgttggtaatttttaaattaccatttcaatcttgctgcttgttattggtctgttcagggtatccaattcctcctgatttaagctaggagggttgtattttccctaaacccatttattttacaatactctcctattatctaaatactcaattatggacaaatgattaactaatggc

SEQ ID NO: 713215 - DNA, 444 bp, Homo sapiens
ggggttagtgaagggcttattaagttgtaggggaagcaagctgggaagaatcagatcagatattttcctgacaaaaaaaaatgaccctgtagacagcatcaaaatgtggtgttcttgttaagtaattgatcgtggtctttgctttaatcttagttccgccaggcacggtggctcacacctgtaatcccagcactttgggaggccgaggcgggcagatcacctgaggtcaggagttcgagaccagcgtggccaacatggtgaaacccgtctctactaaagataaaaaaattagctgggtgtgttggtgggtgcctgtagtccagctactcgggaggctgaggcaggagaatcacttgaacccaggaggcagaggttgcagtgagctgagattgcgccactgtactccagcctgggcaacaaagcaagactctgtctcaaaaaaat

SEQ ID NO: 713216 - DNA, 213 bp, Homo sapiens
ttgagaccaccctggcgtacatggtgagactctaactctaccataaatttttaaaatgttggccaggtgtcgtgacgtcgtgatcatagctcttcccgagctgctcgggaaactgaggcaggaggctctcttgggcccaggagattgagggtgcggtgaaccacagttgtaccactgcactgcagcctgggcaacagagcaagaccctgactc

SEQ ID NO: 713217 - DNA, 489 bp, Homo sapiens
  misc_feature (182)..(182): n is a, c, g, or t
  misc_feature (204)..(204): n is a, c, g, or t
  misc_feature (225)..(225): n is a, c, g, or t
  misc_feature (227)..(227): n is a, c, g, or t
  misc_feature (231)..(231): n is a, c, g, or t
  misc_feature (245)..(245): n is a, c, g, or t
  misc_feature (249)..(249): n is a, c, g, or t
  misc_feature (259)..(259): n is a, c, g, or t
  misc_feature (263)..(263): n is a, c, g, or t
  misc_feature (273)..(273): n is a, c, g, or t
  misc_feature (285)..(285): n is a, c, g, or t
  misc_feature (407)..(407): n is a, c, g, or t
tcctttttggaatggaggctcccaccagaagaaggttccggcaagaatcccatctccacgtttgggcagagaaagcagcccgggtccggaaggtgtagagagtcccggcctcactcagctcacagggcgtgccaggcggcaaacccaaaattttcagaaggcccagctccaccggcacacgnagcttcccatccagtccttaangtcaatttttacccaacacgngnttcngttgttttgagacnaatnaccacctgtnaaanggcaggtggntccagaggggtnaagacccccccccgcccccgctccacctggagcccacccccatgggcaccgcgtgccgcctgcacgtgggctgtcttcacaggtctgatgtgaaaattcaatcagacgttaaccggctcganagagcgccggctagaggcttcattatctattatttaccaacgcgattgagacggacttaaccacagcgaaaggtaaaattgg

SEQ ID NO: 713218 - DNA, 1108 bp, Homo sapiens
ggcgtgctgcagtgcgtgccgagcgggactggctgggtcggctgggctgctggtgcgaggagccgcggggctgtgctcgtgctggccaaggtggacatgctgctgtgggtggcctgatggatcgcttgctgtgggctggtagctccgtgctgccccgtagctcggtgacttgctgctgcctgtgcctcacacatgccgatgtgcgtggctcgtgtgcacagtcgcttgctcctgctgctgctgctgccctggctgtgctgctccatgtgttgcttgacatgctgctgagatgatgctggctggccctcatgggatgcaatggcgacatgtatagacaacgattgtacagcaagtggtgtacgataaccagggaagaccaagtttggaggaaagcttaccacagggactgaaacttacgtttctagacgacaaaaggcaaggtaagtttcaggggcgccttggagcggcgtttaggagagaattgaagcagcaagttgccagtgttttaccgagaagggttttggctggagggagcactgaaggttggtctctgcaggcggcacagccagacactgccctttccaacgccggttacacctctgtgcggggggtgcgcacgcgggcagccagctcaatgcgcgatgagcgttgcgagtgcgcggggcaacggcacccacatgtgccacgacactcgcatgaagagcaggcgttccggccgcgtgcacgcctggccgccgcccaccacgcgcatctagcgcccacgtggccagttattgcatcgcaggcgaatcacgcgccgtgccagcggtgtggcgaggagggaggaagcatcccggggagacaagacgcctgtgcaacacacgtagcggcgattggagcacgaaggaagagttcgggctttcggcacacttggtttgcaccaggctggtgaacacatcgaggaaccagggcgcaagcgcgaggtcatctagagcggtggcgaccacaggcggtcgaccagacgcgccaacaaagctagcacacgaaaaccgaagactggctgctgcgcgccgcttgttgggcgacgtcccactcgtgggtaatgagtaaggcagacgcaaaggcaaat

SEQ ID NO: 713219 - DNA, 251 bp, Homo sapiens
cttatgtgatggttgtgggtagctagacgaaggagttagagtggagcacgagctagggatgcgcactgattgtcactgacgaagcccagctcatccggccgctcccccagctctggtgggctgcgcacagaggttggccacagactggggcgcggcataccataggtggtgtcattgtacaccagtgcagccgttctcccttctcaatgcctccactacttgtgcccgcgattcgcgggttcactggacag

SEQ ID NO: 713220 - DNA, 877 bp, Homo sapiens
  misc_feature (231)..(231): n is a, c, g, or t
  misc_feature (492)..(492): n is a, c, g, or t
gacattgcattctgcaatcacgggaatctgcttgtgagaggctgcacgaacaatgacttgacaagatatgtctgattacaacaacgcgcttcactggagtgagaagacccaagcaactccttccggaaggatgtgtagcacctacaggcatgccggatcagcatgatatgtcaaaggtcgacgatccaaggatagtaatgcaatcggagtatcgctttcggtgatgagagnaaagaactagcatacttatgctggagaatctaggctatccagagatcgttacaggactacttgctaatgtcctgatgtatgaaacgccttgggtcgtcgtcacatcatacaatacaagcttgtcagaccaatcacgaggcgtgggctgtctgctaacaaaaggtgactggaccaataggttcatgtgataactcacttgcacgcagattacataccctgacttctactactaggacgactataggttctacccagctgtgnctagtacgcgttgtagaagtgatgcaatgactgagtagcgcatgtatgacactgcgacagaaactataaggctctgtcgtctcgatctgtatagttagtgctcttttcaggatagatatgtgaggtggacgtacgatgttcgatcttgatatgcttgcatgttgaaacgagctgtgatttgatgcgactcgatgtggatcgtgctgtgcatgaatgggaagatgctcaaattagttagtgtcatgaatctgtgaagctgaagcaaaaatgatggttgctaacaaagcagataaaatacagcaagctaaaaatgaaataagagagtgggaggcgaaagtgcaacaaggggaaagagattttgaacagatatctaaaaagattcgaa

SEQ ID NO: 713221 - DNA, 830 bp, Homo sapiens
  misc_feature (337)..(337): n is a, c, g, or t
gcctttccggcggtgacgacctacgcgcacgagaacatgcctcctcgcaaaggatctccttcatccctctccagaagaggagaagaggaatacaacaagaagaaacgcctggtgcagagccccaattcctactgcatggatgtgaaatgcccaggatgcttatacaaatcaccacggtctttagccatgcacaaacgggtagtggttgttggtggtggggctgctccacgtgtcctctgccagcctacgaggaggaaagagcgagaggtttacagtaacggatgttccttcagggaggaagcaagcactgggaagcactctgagtcaagactgaagntgcggaaaccattctccaataaacagcatttgggcatggactcacataagagaacacacggtggaaacaaaagtttggtggcacgcaggggactccttcgtaaaagagattaatgcaacgcacttttggttggggcgcgaaagacacccggaggcacgtgatgaagaaaatcgcatcaatgggacctttcgcaagagagataaccgagagtgcaaggagcacccgcgcgtggggttaacagcgcggtacaaaaaaaaacgcacgggggaaccccgcatggcctgcgggagcaacataacaaatcaggggacaagggggaggtccaagaagggggaaaattacaacagagaaagcaaggaaccagttgctgaaaatggccgcgccgcgggggagaatctcaaacagggtcggacccaaaaccaacttgaccgggcacgctcgtaccgggggaatagcccagtcggacacacgacagcgatggcaccacaacgtc

SEQ ID NO: 713222 - DNA, 326 bp, Homo sapiens
cgaaaaaaaaaaaaaaaaaaaaaaaaaaaaaaaaaaaaaaaaaaaaaaaaaaaaaaaaaaaaaaaaaaaaaaaaaaaaaaaaaaaattttttccccccctttgggggccccccccttttcccccctttttggggggggggggggggaaaatttttttccccccccggggggggggtggggggggggggtatccccccccccccccccccccggggggggggggggggtttttttttaaaaaaaaaaaaaaaaaaagatttttttttgcccctttaagggggaaaaaattttttttttcccccccggttgtttttgtgggggggcgc

SEQ ID NO: 713223 - DNA, 416 bp, Homo sapiens
  misc_feature (40)..(40): n is a, c, g, or t
  misc_feature (253)..(253): n is a, c, g, or t
tgctcctcttcatgattagttataaatatattgctataanatcatcataaatctactccctacgtagtggaatagcaagtcaagggtaaaaggtcatgcataaaatagatcccaccagatattatataatagtctttaattcttcaacaaatcataaaacattaatttatacttcactatacagcacttcaaggtttttctttatatattaatgtttatatatcacagacaattttacaaaaagataatcatntttttcataaaataggaaaagaaagccacagtactaaaaaaaaaaaatcaatctgcagagtgtaaacattttttataagaatacaaactaaaagaacaatgaaactcaagtacattatcagaaacagtggttgacctccctcttttttcctttactccctttt

SEQ ID NO: 713224 - DNA, 1446 bp, Homo sapiens
gtgcttggacggaaccctggcgctcgttccccaccccgtggcggcctgaccatagccatgccctccgtcacctcttcaccgcaccctcggactgccccaaggaccccgccgacgctccagcgccgcgacagccaccgaccgcgccgccgcactactcctatagtcgacgccatgacgacacgcgatccacctcgcaggtgcgccagaactaccaccaggactcagaggccgacatcaaccgacagatcaacctggatgctctacgcctccatacgtatacactgtccatgtcttactactttgaccagcgatgatgtggctcttgcaagaacttgagccacaatcactttcttcacccaatctacctgagtgcagcagggcaaccatgcatgcagcacaactgcaatgcaagctgcaagaaccgaacgcaggttggccgcaatctcaccattccggcatcatcaaggcaaacccagcacactgttgatgcacctggcgcgaggcgcggctgacatgcacacttggcagtgttgccatgaccatctttcggcgcacaccaccacatcgtcgcacatccacgtccctcagctggacacctggcgacccaaacctgggcccaccgggaaccaaaccacatcgcacgacaccactaccggcgacgcgcacccacacgcagacccacgcaacgccctgcaccagacgccccgctgcccaggcccgcacacggcaaatccgccctggcccaccgttgaacacacacatggcagcgacgacaaggcacagcggcccgcgcaaactcagggaatcagagcggaaacgactctacttcggccacctcccacacaccctcgagccagcacacccgtggaaacactcaacaccgccaaaagccagacagcgcatacaacagcccccccgatcagccgccgattggagcgatggaacgacccgctgaggtcaaccacaacggccgagcgaacgcccactgttgtgcgaggataccacaacacaacggtggacacacacaaggtcgaacgagcaacacacaccacaccgagcagggccacgacggaacaagggcacacgagagcccgtcgcaaccgctacacggacacactgtcgtaggcccaacagcgagtacgcacagcttggcggacaccgcaacacgacaaaacccacgagcagggcacgaagacagcgccaacacgcgacaccgcgacaacgcagcacaagagggacacgcaagacgcagcgccgcccgcgaaccacccgtgaccaccacaacccgcgccaacaggacaccacccacgctgcacgcaacactcgccctcacccccacaccacccacagccaggcccgaccgcgagcgcaaggctcacaagcctacagacccacgcacaccgacccgcaggacacaccagcaccgctagcgcgccaactgcacga

SEQ ID NO: 713225 - DNA, 150 bp, Homo sapiens
gctgccagctcctttaatttaaatttggcctaattgctgctattgcgatgggcagcacaaaactcctgtgttttaaagagcacggtgttgccatggcactcccccacagggtgagcagggtgtggaggagcatacagatgaggtccggtg

SEQ ID NO: 713226 - DNA, 1118 bp, Homo sapiens
  misc_feature (130)..(130): n is a, c, g, or t
  misc_feature (393)..(393): n is a, c, g, or t
  misc_feature (509)..(509): n is a, c, g, or t
  misc_feature (642)..(642): n is a, c, g, or t
ggtggtcccagtccctgttaatgggctccgattgtccaacttcaggctcacgctctgtcactgtcgctatagtgagtgtctagccgcaggccatgcggttgctggtcgtcgcaatatgattttcgttaancagcatgagtcgtgaattatagaccaggagccagactctgcgacgcacatatacctgcagactgatcaagaagagccatcgttccaagaccatcaattagtgcgggtgcgatgtgagaccttggcactacgagcctggtggtactcccagacgtctcgcacagccatcgcataggtgaaggctcgcctagtgagggcctggcgcagcggctttggtccacgcaacgtctatcctcgattggctgccatagatggtagactggntgggctctcctatggctgccaaccctgctgcgcatggctgatcggtgacgtatgtcatggcacatggcctgtgggcgcgtggcggcagtccgctcatcgcatctgctccgcacggntgctctatagtgctgacctgggctgtgaggtccttccaagagagggtcttcaagtcataggacttgataacgaagggtagggccgaggaaaggggcatccgatagcgactgggaattgcgggagaacggtctngcagcgtggattacccaaggcctcggcggtttaactagcgtagtctccgtacgcttgacgaccagcatgctacgatgacatgggcttctgtggcgagctgaaatagaacctcagtttcatcctggattcacccgattactctagaggccctgtaaggctgcagcttcggtattaggtgtaccctccattggcagtgggagctttctaagtgaatcgagactacaactccctccgatgggattttgaatcatattgaaaggacattcgcagggggggaaaagcagtcctgcaaagggctaccacagggggacaccagggttcgccggtcggccccacaagaagctggtccccgttgggtagactccacgcaggctgttgccctgttgagtccggattgtgggctgttggtcctgctggttgtccccatcgcgacgcgggcgtctaggtataaagggctaccaaatccaccaggtgcg

SEQ ID NO: 713227 - DNA, 918 bp, Homo sapiens
  misc_feature (2)..(2): n is a, c, g, or t
  misc_feature (67)..(67): n is a, c, g, or t
  misc_feature (74)..(74): n is a, c, g, or t
  misc_feature (149)..(149): n is a, c, g, or t
  misc_feature (184)..(184): n is a, c, g, or t
  misc_feature (193)..(193): n is a, c, g, or t
  misc_feature (258)..(258): n is a, c, g, or t
  misc_feature (261)..(261): n is a, c, g, or t
  misc_feature (322)..(322): n is a, c, g, or t
  misc_feature (343)..(343): n is a, c, g, or t
  misc_feature (351)..(351): n is a, c, g, or t
  misc_feature (365)..(365): n is a, c, g, or t
  misc_feature (432)..(432): n is a, c, g, or t
  misc_feature (436)..(436): n is a, c, g, or t
  misc_feature (532)..(532): n is a, c, g, or t
  misc_feature (536)..(536): n is a, c, g, or t
  misc_feature (564)..(564): n is a, c, g, or t
  misc_feature (568)..(568): n is a, c, g, or t
  misc_feature (571)..(571): n is a, c, g, or t
  misc_feature (576)..(576): n is a, c, g, or t
  misc_feature (579)..(579): n is a, c, g, or t
  misc_feature (583)..(583): n is a, c, g, or t
  misc_feature (586)..(586): n is a, c, g, or t
  misc_feature (624)..(624): n is a, c, g, or t
  misc_feature (781)..(781): n is a, c, g, or t
  misc_feature (798)..(798): n is a, c, g, or t
  misc_feature (800)..(800): n is a, c, g, or t
  misc_feature (807)..(807): n is a, c, g, or t
  misc_feature (830)..(830): n is a, c, g, or t
  misc_feature (832)..(835): n is a, c, g, or t
  misc_feature (837)..(839): n is a, c, g, or t
  misc_feature (844)..(844): n is a, c, g, or t
  misc_feature (850)..(850): n is a, c, g, or t
  misc_feature (906)..(906): n is a, c, g, or t
cnaacatcaggtcatgatgtagcttctattaaaagggaacagaaaagagggtacaaaatggatttangtgatcnaggggattcagaaaaggtaattttaagacaaaaaagtaaattctactttacagagaaagcactaagtgtgtagtngaggttgggctatgaaattatatattatggaaatnttaccaaanagtaaaggtatttttttaatgacagtggccatagaatagctttttaaaggaaattacgaggggcnggngtgcaacttcctgctggggctggtgggggggggggcggccttccgccattctgcatcaggncttgttggtgccacataagcngggatgtngtacttcagggggnggaccttccatctgattcagcatggtgggttatgtctggggtgctcctggtgctgttcggcctgggnggcnggcggggctttcccccgctccctttctctcgggatgggctgtgatgctcaccttgctcatgaatggcctgggattctggattttcccatttaagcngtcntttcattggcgggggagggatggttggnggcnccngtgcngcntggnganggtattctgagtgcagtcccattccatatgcactggcngcggcttggggcaattaggtatggcgggcgcgtgtgaaagacgcgatgcgggaaccacagttactatctttaaaagacatcttagagaacacatctcagggcatagaatagagaaagaatgctgacacagtcttcttccacccttaagaagttaggngctaaccagaaaggatnanagtacgnaacatatatacttacatatcaancnnnngnnngtgtntatttntctcttcaacctttcttccctttttttatttcttcttctttccctttctatttttntcattttccttt

SEQ ID NO: 713228 - DNA, 853 bp, Homo sapiens
  misc_feature (528)..(528): n is a, c, g, or t
tcatccattgatttcacctattctcaggctatactctagaccaagacctacgccaagagatctcattctcagctattcatacttcatcgaggtaaatctaactttacttcccgacataaacttttctcggggcatatccggaatgcccgcagatgttactcggattaccccagatgcatagaccacatgaaatactcctatctagtctgtaggctctattcattgtctctacatcagcagatacactactttaataagtctcttcagtgatactgacgaagcctctcgtctcacgcatgtcgaagaagtcctaatagtagaagaactcctcccattaaaccatgggagtgactaatagtggatgccgctccactactctgagctacacattcggatagaacctcgtatacataaaagtctagacatataaaggcaaggacttgaaccccatcaaagctgggtttcaagccagaccgccatggtctcgatgacttgtcatagtggtaagactatttctgtaatagactnccagtcctagtggggactgacgcggtcttaaaaaaaaaggtttttaagaaccacattttgttgtatagagcgccaggggccccaaaaaggggatattgtgcaccgcggtgggacaaaacagggtggtaccaaaggagaaaccccgcgacacatagacaagagggcgggaggagtcgcacaacaattataaaaagcgccgcggcggagacacagagcgttttgaacacattccgaaaggaaatccagagggcaatacacgggagtaaaacgggcgggccaagcggcgcatattcaaataccgggccgtgtgtgcaccagggagaaa

SEQ ID NO: 713229 - DNA, 248 bp, Homo sapiens
ctcgaagaaagcagttgaaggagcttagggctgagactatgggtatatgagatataggaatgaagtcatctgcaacagagacgtagttcgacttccctcttcctatttgaataccctttatttctctctcttacctgactgccctggccaggacttccagtactatgttgaataggagtggtgggagacagcattctggtcttgtgtcagttttcaaagggaatgtttccagctttaggttatttcag

SEQ ID NO: 713230 - DNA, 192 bp, Homo sapiens
  misc_feature (188)..(188): n is a, c, g, or t
cattttaaggagggagagcacccactattgatgaaactgttatggcaacccccaacccagggtgaaccgtatgtaaaccaggctgaactctccacatcgccggcctcaccatcctgggatacaattctgactataaactcagcatcagataaacctagatattaccagcaatgcagcaggaaaattanattt

SEQ ID NO: 713231 - DNA, 695 bp, Homo sapiens
gccctccgtgttcgttgctcgtctttccggtgacctgagggtaccttgtcgggccgtcatctgctcgtgctctacggtgctgtcagcagcctggctgctcgccgcttcggccgctgctgctccatcctcagcgtctcacctagcatggctctcccgtcatggcgggacgttctgcccaagtggcctagctggaacaaggtctgtcacctcgtgccatcaacggtgcaagtctgcgccatcaacctctaaggtcgtggtcatgctatcatgcccagccgtgccccagccctgcctactgtcggccgttgcagccttcgactggccgcagctctactctgggcactcagcatcctaccgtggttctggaccgtgttgcgcttgctccacaggagcacacctttactggcccatcagctcccatccagccatcttcctgtactgggcttccttgatacgaggaccagaaacggggagaccctgctggctaggcccacatcgagggcctggctgggagtggcatgtatgacgtgactggcctgctggatcgtggagggggcgcgctgtcaggcagcaggatagagtgggactagttcctgagaccagccaacctgggggctttagggacctgccccttcctagcgcagccatgtgattaccctcatgggtctcagtgtcctcatctgtaaaatggagaa

SEQ ID NO: 713232 - DNA, 920 bp, Homo sapiens
tagtgtgtgggggcgcgcggaggggggagggggggggttcgaggctgccgacccaggagattctacccagtggaaactcccacagcaacgcaggtagatggggctgacctggcctctccatggggcggggggtagcaaaaacctcatgtccatgaagctgcgtcgttcctctggctcagccaataaatcctaaggagacaagcagcccagcagggatcagcagtggccaccttagcacgaacatagggttaaccctttcaagccttcatgtctgccatggggggggggtgtttcttcctgtacatttatttaagaaaacactggatttaaataattgtaaataattgggagctgaatattaaagatttaagttatttattgggtgcatttttttgccacaatgcaagctggcatattttgagggcagggggagttttattctacaccctgtaccttgctacataataatggctaaggagggggatctgtagcgtgatggggaacggggagcgcaagacggtgggcgattagtatcgttatcaattgggcccgatcgcagacttatggggcagtaagggagtaagcggtgtaaagagggaaatttagcatggaagcgtgagggggggggcctgaaggggtggagctcttactacagtgtagtgggacggagggatgctggacgaacagagaaggggttaagggcggggcgtgcgggagaggtgtgggaggcgcaggacgaagggggacgccggtgcgcgatggagggggaagcgtgtatactgctaatgacagggtggctggggtaggggcggcgcgcgggggttgcggcgcatagaatggtgtgtgctgggtgtgagtgaggtggagggagggttgtgcggagggtggcgcgatgatagagatggtggcgacgtgggcgg

SEQ ID NO: 713233 - DNA, 380 bp, Homo sapiens
  misc_feature (320)..(320): n is a, c, g, or t
  misc_feature (349)..(349): n is a, c, g, or t
  misc_feature (357)..(357): n is a, c, g, or t
agaggttgcagtcagccgagatcgcaccactgtacttcagccagcctgggtgacagagcgagactctgtttcaaaaataaataaataaataaaatagaattctgaattttatttttaataattattttagtaaagagaatgtcttgttttttggagttgttgaatttattgaattggcaaaaattatgtataagaggttatacaaaatgaccgtgattgaagtatgtatacattacagaaatggctaaatcaagttaaataacacttcacaattcaagattccctcatttatataataccttcatgattcaagattcccntatttttataattgtgggtaattgtgccnttcccccntgaatgttggtgggatttttgga

SEQ ID NO: 713234 - DNA, 880 bp, Homo sapiens
  misc_feature (465)..(465): n is a, c, g, or t
ggcagaagtccggggctggcagggcgcttcctgcgcagcgccgaggcgacctggagtttgtgacgctgtgatggtctagaggctggagattcaagatctgggtgccatcatttctggttctgttgatgaccctcttccagtgtcagaataaattatcacttatgggaactggaaacactcaccgattcaaatgctcagctatcatgtgttaattatgcaagtaacaatgtttaaccgcgtgaactcagtcaagtggcagaaacaaaaaacacctgaaacaattccctgggatgaagacgttctcataacattaggacacagaagagttccaaaagtctgagacaagatcttgaaagggttacgtgtccactagagggagtcaaaggaatgacacagttaaggggaacgacttagaagtgggaacaacgggtggtgggatgaacaggcaacagataatggaatctncttaatgtactacaccagtgaattggaacaattagggttgaaaccattttctgaatccaagactctttactgaactgaaaactaaaatgtttatatacacgaatataaggagcaactctttgagtacccttggggcgagtttctaagaagaacatttccttctggcctgatagaagggtgctaacacacgaaaagatcacaccttccagaattcatctgtaaacctgataacactggctgacatggtaggagattcttactacctagatattgatgtccccatggatccaatgtcaaattaggatcctttgacactttagtaggctgttcggtatggacagcccggacactcgaagataccggatagattgaggtccacgaagggtctgttcacacggacactcctcacgacggg

SEQ ID NO: 713235 - DNA, 412 bp, Homo sapiens
  misc_feature (17)..(17): n is a, c, g, or t
  misc_feature (31)..(31): n is a, c, g, or t
  misc_feature (187)..(187): n is a, c, g, or t
ccttttccatttggttnatatatttacaaanccccttcacaccttagaaaatacctccccccggaaatgccttttttgaaagtgtgaattaaataagaaatgggggtaaaatagaaaagaaatttattgcctgattggccccaggtgcggtggttcgtgccctgtaatccccagctctttgggaggnccaaggcaggtagatcacaaggtcaggaaattgagacccatccctggcctaatacagtgaaacccccatgtctgcctaaaattacaaaaaattagctgggcgtggtggtgcacgcctgtagtctcagctactcaggaggctgaggcaggagaatcgcttgaacccgggaggcagaggtagtagtgagctgaagtcccgccactgcactccagcctgggcaacaga

SEQ ID NO: 713236 - DNA, 128 bp, Homo sapiens
gacagattaaagtgtccccgttgcaagcctgttgtctggcatatataaccacaaattccttttgctttcctcttgactcgtactctactcacgttatacaaagtggctggtctgcaaactatttttat

SEQ ID NO: 713237 - DNA, 987 bp, Homo sapiens
  misc_feature (6)..(7): n is a, c, g, or t
ttctgnnacacagagatgccgacgctcctgtttttgtttctgtctaccttctctgcctcgcccggtgtgggcgccttttgtgacctgattgtgtcgctaatccggattccttcccgggttcgggactccccttttataagggctccggtttaacctacgtccccttgtggcacgaaccgttggtgacgcaggccgccccaatgtataacgcccccctcgggccgtccgcccgggggtattatccgccctcgcttcaggaggacacacaccttggtctcgggacaccacgcctcgtgtttcccctcccccctgggaggccacgccttttttcgcggtggtgaacgtcccccccggggctcctgtgtcgttttcgcccccgtccgcccgtagtgacacaccgccgggcagttgggtctcctccttcactcggggggcgcacacctagttcttgctcctccttgatggactccggggcgagggcgcacccgcaaatcccacaatgtctctcctgtctttgtaggctggcagagtgggtgcacaattgtgcggccgctgcacttttcatgtgtaggctgctgcctcatagaggccacccggtcccctcgggggtggtttctcctactgagttatggattcgtgtctctctcttcccccctggaggatggatgttggcccccccctggcgttggaatacaacaatgatgccggaccccctgcgaggcctcccgctcgaaaggcggaggccacaggggggcggggtggtcaccttgatcgtgcctcccccccgtgcgcctggctgaccgaggcacgcgggggcgtagccccttgggccacccccctcggcaccctaggggttccacgcacgagtttgcgcacgctcctcagtgtgcctcctaagtacgccttgttttgtcttgcgggtaccccagaacaggaagacaagatgaaaacagaacaataaataaaaaactataacaaatgatcaaa

SEQ ID NO: 713238 - DNA, 447 bp, Homo sapiens
  misc_feature (93)..(93): n is a, c, g, or t
  misc_feature (96)..(96): n is a, c, g, or t
  misc_feature (101)..(101): n is a, c, g, or t
  misc_feature (129)..(129): n is a, c, g, or t
  misc_feature (143)..(143): n is a, c, g, or t
  misc_feature (199)..(199): n is a, c, g, or t
  misc_feature (203)..(203): n is a, c, g, or t
  misc_feature (209)..(209): n is a, c, g, or t
  misc_feature (224)..(224): n is a, c, g, or t
  misc_feature (227)..(227): n is a, c, g, or t
  misc_feature (251)..(251): n is a, c, g, or t
  misc_feature (289)..(289): n is a, c, g, or t
  misc_feature (312)..(312): n is a, c, g, or t
  misc_feature (317)..(318): n is a, c, g, or t
  misc_feature (348)..(348): n is a, c, g, or t
  misc_feature (356)..(356): n is a, c, g, or t
  misc_feature (364)..(364): n is a, c, g, or t
  misc_feature (429)..(429): n is a, c, g, or t
  misc_feature (432)..(432): n is a, c, g, or t
  misc_feature (439)..(440): n is a, c, g, or t
  misc_feature (442)..(442): n is a, c, g, or t
  misc_feature (445)..(446): n is a, c, g, or t
gggggggggggggggggggggggggggggggggggggggggggagggggggggggggggggggggggggggggggggggggggcggggggggnggnggggngcgggggggcggcgcggggggggctgcngggggccatcagcntcccagcgggggggcacgtctttcattcagacgctccaatgcttttgatttcagtntgtnaaaggncgggttttacagggngtnctttacagtaatttcatgccaganaccaggtttcttcgatggtacacagctccatgaaattngtgtttccatccagttgacaggnataannggggatttttatttttgtctttttttgggncgttgtgncgtaaaanggtcagattcctttaggaataaatgaggaaaaggagaggaaagagaagatctgggctgtgctggngcnggtttcnncncgnnt

SEQ ID NO: 713239 - DNA, 414 bp, Homo sapiens
gcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggactatgtctctggaataattttaccaaaacaagctatttgagtctcgacttgacaaggcaaaacatgccactggattccctttacaactcgacaacaaaaatccttattctctacaaaggacttcccttttcgtaacctaatcctttctattgctaaaaatcgtaacttaaaatgcgcaacttcaaaacaacaaaaaacaac

SEQ ID NO: 713240 - DNA, 349 bp, Homo sapiens
ccccctccccgggtatctatagctgcttttgcattaaaatgacatagtgagtagttggaccagagagaactatttgcctgtttacagaaggtttgcccacctttactctaaaataatagaaataattttcacaagaggcaaacttacaaaaatcacaaggcatgttactagaaggcaaaagtgactagataaattcaatctactggggaatttgtctcatcaaactttcttcacacacacacccattaggcaaatggaatcaacttctttgttgtgctggaaaaagtaggtacatcttggccaggcgcggtggctcacgcctgtaatcccagtacccggggaggggggg

SEQ ID NO: 713241 - DNA, 142 bp, Homo sapiens
cagataactctcatctgtacctatatatctcatcaatttcttgtatattttatgtcagtcgctctcgctgtttattgtctttaaaataacatgtcaacttcaatgttctatctggaagcagactacaatatttccatagact

SEQ ID NO: 713242 - DNA, 873 bp, Homo sapiens
  misc_feature (579)..(579): n is a, c, g, or t
taaaaacaaaattgtttaatgttgtctccttggttttaagcccttcccatggtaaaatcaactgaaacttaggttctcgccatctatataaaaactgaaaaaggaggccccagattggtatatgcagggccacgggaaagcactggtggtggcctattatatttacctggcgaatacaagatacttatcagctttaattttaaaacaaaacctcaagaaatctttatctccaccaaagaaaagcatacacgcatttggctatgatcataatacgttgtgcgggtaccgcagtcagtgggaaaaacacagatacacaggccacatagacagcagtattgttaaaggggaagaaaccgtgttcaaacccaatctctgtaatctacatctatgaggtgttcaggtgataaggagaggcaaaaggggtaaaaaatacgagtatatttcagcgaaaacatcagtccagcctcaccaaacaagggttcgtgggtaaaaagtacaggaggagaggaatgtggaacaccatttcgcaaaactggtgaaaaacccatttgttctccacgcggcaaaacagtattgcangctgtcctcaacagtgccgaggtatacgctataagggaaacaattgacgtttttcggacaaattgggactcggtggacttcgtcaatatctaaactcatcgggggtggtctattactcccaacagttggctcacgatagcgcgatttatcataagatccctttatcccacaaattatggggggccaagtcaagccttaaatatacaccccttatatttacagaaaggggcaaagtgtaccccatttaaacaacggctgaattaatttctgaggtaatcaacacaaaagggtaag

SEQ ID NO: 713243 - DNA, 2152 bp, Homo sapiens
gaggctcaggaaaaagatgaactggtcccattcctgcatctccttttgctggatctactttgctgcttccagactgagagctgcagagacggcagatggaaaatatgctcagaagttgtttaatgacctttttgaagattattctaatgctcttcgtccagtggaagatacagataaagtcctgaatgtgaccctgcagattacgctctctcagattaaggatatggatgaaagaaaccaaattctgactgcttatttgtggatccgccaaatctggcacgatgcctatctcacgtgggaccgagatcagtacgatggcctagactccatcaggatccccagtgacctcgtgtggaggccagacatcgtcttatataacaaggctgatgatgaatcttcagagcctgtgaacaccaatgtggtcctgcggtatgatgggctgatcacctgggatgcaccggccatcaccaaaagctcctgtgtggtggatgtcacctacttcccttttgacaaccagcagtgcaacctgacttttggttcctggacctacaatggcaatcaggtggacatattcaacgccttggacagcggagatctctctgacttcattgaagatgtggaatgggaggtccatggcatgcccgctgtgaagaatgtgatctcctatggctgctgctctgagccttacccggatgtcacattcaccctccttctgaagaggaggtcctcgttctatatcgtcaacctcctcatcccatgcgtcctcatatcttttctggctcctctgagtttttatctcccagcagcctccggagaaaaggtctccctgggagtgaccatcctgttggccatgactgtatttcagctaatggtggcagaaatcatgccggcctcagaaaatgtgcccctgataggtaaatactacatagccacgatggccctgatcacagcctccactgcgttgaccatcatggtgatgaatatccacttctgtggggccgaggcccggccggtgccacactgggccagggtggtcatcctgaaatacatgtccagggtcttgtttgtctatgatgtgggtgaaagctgcctcagcccgcaccacagtagagagcgggaccacctcacgaaagtttatagcaaactcccagagtctaacctgaaagcagccaggaacaaagacctttccagaaagaaggacatgaacaaacgcttaaagaacgacctgggctgccagggtaagaaccctcaggaggccgagagttactgtgcacagtacaaagtgctgacgaggaatattgagtacatcgccaagtgcctcaaagaccacaaggccaccagttccaaggggagtgaatggaagaaggtggcgaaagtcatagaccgattcttcatgtggatttttttcattatggtgtttgtgatgactattttgatcatagcaagagcggattagtcacagatattggctttgctatctgggtagaaattaatacaattccctgtgatctattccaatgttcttccaagatttttgttcatctataatttaggggttatgttgtctgtgctttttatttttagcttcaaatgaatgtcgaagctatctgctctgttaaattaagcagaagatccaaaatttcaagggtaggaagatggaagaaatagggaaagagcccttttatagcccaccgtagtggtgggtgactggcctctagtttatataattatttacctctttggcagtacagataacaaaatacactttactggtaaaatttaaaacaaaaaaggcaaaacaaaacaaactcattttccccttagttcccattaaaatatgcatttgaaaaatgaaatagtcatatatatattagtgtgatttaagtctcaatggtaccttattcaggcatagtgcatttgaagtcatatctcaaatagtggaataaaaggttttgtcccatgtaaagaaagtctaagcatcagctgtttaatggggaaaagaactttcttcataatggtgatgtcgtatatgttggttatgttttatataaacccaaaagatgaagtcattcctgcatttaccctttgattaaaatatgatagatgaagctgttcctgcatttagtcttgtattaaaataaggtgattagca

SEQ ID NO: 713244 - DNA, 1584 bp, Homo sapiens
tgcaatcaaaactggtcttatggtctctgggtttacacgaaagagcaatgaaagacattatactttagagcagtagttctcaaagtggtggtccccagatgcacagcatcggcatcccctgggaacttatagaaacacaaaacctcagggcccaccggaagcctactgaatcagacattctggagataaggccctggcatcctgttttaacaaggcttatgggtgattctgatgcattttctgttgaagtctgaaatccactgacccagaggttaagacctgattttgaagtcaaagaaacttgcatttgaacgctgacttcactgctcactccttgatcaaacaggtaaatactacatagccacgatggccctgatcacagcctccactgcgttgaccatcatggtgatgaatatccacttctgtggggccgaggcccggccggtgccacactgggccagggtggtcatcctgaaatacatgtccagggtcttgtttgtctatgatgtgggtgaaagctgcctcagcccgcaccacagtagagagcgggaccacctcacgaaagtttatagcaaactcccagagtctaacctgaaagcagccaggaacaaagacctttccagaaagaaggacatgaacaaacgcttaaagaacgacctgggctgccagggtaagaaccctcaggaggccgagagttactgtgcacagtacaaagtgctgacgaggaatattgagtacatcgccaagtgcctcaaagaccacaaggccaccagttccaaggggagtgaatggaagaaggtggcgaaagtcatagaccgattcttcatgtggatttttttcattatggtgtttgtgatgactattttgatcatagcaagagcggattagtcacagatattggctttgctatctgggtagaaattaatacaattccctgtgatctattccaatgttcttccaagatttttgttcatctataatttaggggttatgttgtctgtgctttttatttttagcttcaaatgaatgtcgaagctatctgctctgttaaattaagcagaagatccaaaatttcaagggtaggaagatggaagaaatagggaaagagcccttttatagcccaccgtagtggtgggtgactggcctctagtttatataattatttacctctttggcagtacagataacaaaatacactttactggtaaaatttaaaacaaaaaaggcaaaacaaaacaaactcattttccccttagttcccattaaaatatgcatttgaaaaatgaaatagtcatatatatattagtgtgatttaagtctcaatggtaccttattcaggcatagtgcatttgaagtcatatctcaaatagtggaataaaaggttttgtcccatgtaaagaaagtctaagcatcagctgtttaatggggaaaagaactttcttcataatggtgatgtcgtatatgttggttatgttttatataaacccaaaagatgaagtcattcctgcatttaccctttgattaaaatatgatagatgaagctgttcctgcatttagtcttgtattaaaataaggtgattagca

SEQ ID NO: 713245 - DNA, 510 bp, Homo sapiens
caggaattggaagtactgactgcaaatatccaggatcttaaggaagaatattctaggaagaaggaaactatttctactgctaataaagcgaatgcagagaggttgaaaaggctgcagaaatacgcagacttgcataaagatcgacttggactagaaattctaaaaatttatggtgagaaattgcagttgattatcactaatattgaccctaagaatcctgagagcccatttatgtattccttacatctcaatgaagcaagggactatgaagtgtcagatagtgcccctcatcttgagggcctagcataatttcaagagaatgtaaggaagaccaacaatttttcagatgttcctgccacagatcggaaagcatctactgccacgagctataattaacatacagatagtgtatataataaacggaatatatatcttctatattacatagtctgttgcttctctcgtgactattatgattatactttaagttttagggtacatgtgcacaat

SEQ ID NO: 713246 - DNA, 129 bp, Homo sapiens
tctcctgctcactatggtaagacagcagccactaggtactgccagaaagaagagggcggagcaggaggctcttactgggtgagtgcaatgagcttggaaaagaagaatgaggctctaaaagtggggagg

SEQ ID NO: 713247 - DNA, 190 bp, Homo sapiens
tagtctcagctgctcaggaggctgagatgagagaatctcttgagcccagtaattcagggctgcagtgagctatgatcatgccactgcattccagcctggtcaacagagcaagacccagtctcaaaaataaaaaataaaatgaaataaaacacaaagtaaatatacaagtagcggacctgttggaactttg

SEQ ID NO: 713248 - DNA, 916 bp, Homo sapiens
gcgcgtctgagtgcagagctgctgtcatggcggccgtctgtggagcttctttcccgtcctgtgctgtgctgtatcgggggatgtccagagctcggaggtgcccgggttgtgctgagggatcgggaggggaggtggggtcggcataggagatcgttacaagatgtgaggggcgtgcagttgtccaagggtgtggaagccctccagggatggtatctcgggggcccagagtgctggtaacaggagaaagagccagtgtcggtttcctttaagaacagatgggagtttggggggtacatgataataccttgctgattcttaatgtagggtggaaaggtgtgtatctcccagtttacagatttgggatcccggtcgagtgatatcactttcgaaggggaaaactggaaggagcaaggtttttgtgatttacttcaaaaacatcaagaaggtggtcaagatgtgccttatctctctccaaattgaaatcttcagcgtcccaccttcttacttttattaaaagggaaatcgtgggggtgtggaaaaggatttctaatggaccccaagtgtattgatgaatggttctcccttgatttgatatgtgtgctttctgcataaaaggtgttcaacaacaatgtgatcctgacttgagagggaaatgagcagtcaaatgaatatgtgaatcaacatgagtggctggtgttctgagtttgacaagatttttttcaaatatttggggatttagagggagagttaaagggaaatggtggcacagaggggtcggcgcaaatgggttggacaatcgacctgtgggccacttgggacggtggaataatatggccaggggtaaggtgtttctaagtgtgttggccaacctctttgttggaggtgaagtaaggaatatttttttaaaaagaggggg

SEQ ID NO: 713249 - DNA, 1292 bp, Homo sapiens
  misc_feature (1204)..(1204): n is a, c, g, or t
  misc_feature (1211)..(1211): n is a, c, g, or t
agcggagcgcccggcggccacctctttcccgcgggcgggccggggcggggcactgaagggggcggtccaggaccctgacttgtctcgcggttactgggccggcgcgagcacgcgaggctcgggggcggcacggggcggggtttagcctgtggtgggcgctgcgggtgtttgcaggaggttgcagtactcgctgggctgaggtcgtctcgggtgaggaggtcgcgccggaagtggctctagccgtggcgcctcggcgtagtaaggagcctgcaacagagttttgttgtttagggggcgcggcaccgcaccgctcccttcaccttgcagcagccatggcgaaaggcagagtcgccgaacgatcgcagttgggcgctcaccacacgacccccgtgggggacggggcagcggggacgcggggtctcgcggcgcctggcagcagagaccaccagaaggaaaaatcctgggtagaagctggatcagcaagaatgtcactccttatattggtgtccattttcttatctgcagcttttgttatgtttttggtatataaaaattttcctcagcttagtgaagaagaaagagtgaatatgaaggttcccagagatatggatgatgccaaggctctaggaaaagttttatccaaatacaaggacaccttttatgttcaagtacttgtagcttattttgctacatatattttcttgcaaacatttgctattccaggctctatatttctcagtatactctcagggtttctttatccctttccactagccttatttcttgtttgtttgtgttctggacttggtgcctctttctgttatatgctttcctatttagttgggagaccagttgtatacaaatacctaacagagaaagcagtaaaatggtcacagcaggttgaacgtcatagagaacatctcattaactacattatatttttgagaataacaccatttctgcctaattggtttattaatatcacatctcctgtgataaaaaaacaacaaacgcaaaaaaaaaaacaaacaaacaaaacaaaaaactgtgtgggggggccgcggcccccgaaaaaagttttcacagcaccactttcgttgggacgcgggggccccagtaggtagtgggacatgggcaaaacgcgctcccaagggaaacccgggcagacacaggggcgtgagttttccaacaaaaaaacaccccncggcggnaccggcggtctggaacactcccagggcgtgggagcctcacggcttcacaggagccacatcgtacaccgcgcggggggcgaa

SEQ ID NO: 713250 - DNA, 867 bp, Homo sapiens
agcggagcgcccggcggccacctctttcccgcgggcgggccggggcggggcactgaagggggcggtccaggaccctgacttgtctcgcggttactgggccggcgcgagcacgcgaggctcgggggcggcacggggcggggtttagcctgtggtgggcgctgcgggtgtttgcaggaggttgcagtactcgctgggctgaggtcgtctcgggtgaggaggtcgcgccggaagtggctctagccgtggcgcctcggcgtagtaaggagcctgcaacagagttttgttgtttagggggcgcggcaccgcaccgctcccttcaccttgcagcagccatggcgaaaggcagagtcgccgaacgatcgcagttgggcgctcaccacacgacccccgtgggggacggggcagcggggacgcggggtctcgcggcgcctggcagcagagaccaccagaaggaaaaatcctgggtagaagctggatcagcaagaatgtcactccttatattggtgtccattttcttatctgcagcttttgttatgtttttggtatataaaaattttcctcagcttagtgaagaagaaagagtgaatatgaaggttcccagagatatggatgatgccaaggctctaggaaaagttttatccaaatacaaggacaccttttatgttcaagtacttgtagcttattttgctacatatattttgtatccttttaactgaaaaaatgttttctaattttgttcaagaaaaagtgtaaaaggtctgctcttcatttatacataactattttccttttaaaatttgttattgcagtgtgacaatattaaataattgaaaaattaaaatggaaaaaaattatcactttaatcct

SEQ ID NO: 713251 - DNA, 296 bp, Homo sapiens
gtactcataatcaaagacaacagatcctggacctgagtgtttagtaaagggagaaagctcaggacatgtttcatctcttacactatttgaaatagacctcttttccccaggctcctgcaagtgctcagggtaaacatacccattaccctgggaagccccgtgtagcagaatgtactccccatccaacccgggggtggctcgtgctggcccagtgaggccctgtttttctggtgtcctgctggccaaggcgggagtcctgcctttattcggagtgtagtgttccctagtgttcccta

SEQ ID NO: 713252 - DNA, 1067 bp, Homo sapiens
agcggagcgcccggcggccacctctttcccgcgggcgggccggggcggggcactgaagggggcggtccaggaccctgacttgtctcgcggttactgggccggcgcgagcacgcgaggctcgggggcggcacggggcggggtttagcctgtggtgggcgctgcgggtgtttgcaggaggttgcagtactcgctgggctgaggtcgtctcgggtgaggaggtcgcgccggaagtggctctagccgtggcgcctcggcgtagtaaggagcctgcaacagagttttgttgtttagggggcgcggcaccgcaccgctcccttcaccttgcagcagccatggcgaaaggcagagtcgccgaacgatcgcagttgggcgctcaccacacgacccccgtgggggacggggcagcggggacgcggggtctcgcggcgcctggcagcagagaccaccagaaggaaaaatcctgggtagaagctggatcagcaagaatgtcactccttatattggtgtccattttcttatctgcagcttttgttatgtttttggtatataaaaattttcctcagcttagtgaagaagaaagagtgaatatgaaggttcccagagatatggatgatgccaaggctctaggaaaagttttatccaaatacaaggacaccttttatgttcaagtacttgtagcttattttgctacatatattttgtatccttttaactgaaaaaatgttttctaattttgttcaagaaaaagtgtaaaaggtctgctcttcatttatacataactattttccttttaaaatttgttattgcagtgtgacaatattaaataattgaaaaattaaaaaaaaaaaaaaaaaaaaaaaaaaaaaaaaaaaaaaaaaaaaaaaaaaaaaaaaaaaaaaaaaaaaaaaaaaaaaaaaaaaaactaagaaacaaaaaacccaagacaccaatttggaaacaaggaaatattcaaaaaggaaacctgttacatttgtctccccgtggcaaaaatttccacagaattttttaacccgctttgaaaaagttcttccccggggcatttccca

SEQ ID NO: 713253 - DNA, 4186 bp, Homo sapiens
agcggagcgcccggcggccacctctttcccgcgggcgggccggggcggggcactgaagggggcggtccaggaccctgacttgtctcgcggttactgggccggcgcgagcacgcgaggctcgggggcggcacggggcggggtttagcctgtggtgggcgctgcgggtgtttgcaggaggttgcagtactcgctgggctgaggtcgtctcgggtgaggaggtcgcgccggaagtggctctagccgtggcgcctcggcgtagtaaggagcctgcaacagagttttgttgtttagggggcgcggcaccgcaccgctcccttcaccttgcagcagccatggcgaaaggcagagtcgccgaacgatcgcagttgggcgctcaccacacgacccccgtgggggacggggcagcggggacgcggggtctcgcggcgcctggcagcagagaccaccagaaggaaaaatcctgggtagaagctggatcagcaagaatgtcactccttatattggtgtccattttcttatctgcagcttttgttatgtttttggtatataaaaattttcctcagcttagtgaagaagaaagagtgaatatgaaggttcccagagatatggatgatgccaaggctctaggaaaagttttatccaaatacaaggacaccttttatgttcaagtacttgtagcttattttgctacatatattttcttgcaaacatttgctattccaggctctatatttctcagtatactctcagggtttctttatccctttccactagccttatttcttgtttgtttgtgttctggacttggtgcctctttctgttatatgctttcctatttagttgggagaccagttgtatacaaatacctaacagagaaagcagtaaaatggtcacagcaggttgaacgtcatagagaacatctcattaactacattatatttttgagaataacaccatttctgcctaattggtttattaatatcacatctcctgtgataaacgtgccattgaaagttttttttattggtacttttctaggtgtcgcacctccttcttttgtagccattaaggcaggaacaacactgtatcaacttacaacagcaggagaagctgtttcctggaactcaatatttattctgatgatcttggctgttctttctattctgccagccatcttccaaaaaaaactaaagcagaaatttgagtaaaaataatcatctgatttttagttttgctgtcatcaccatctcaggattaacaggtgcatccatttatgttttaaaatcacctcttcagtaattaaacaaggaatttgtaaaataaaatttcctatcagatagttaaagtaatacatttaagtgacaaggggagaagaaagtaaaaatggaaattggtatactgtgaaaagtgctatcaatagttaaggtagacatcttagacatcttataaattattataccaagggtagctgtagataatagtagtgtggtaggaaattgttgatccagctaattcattcaatttaattgaatattttttatctttaataactaaaatagatatttttaaattctagattttttaaagtagtgttgcaggttttgttaatgttaggcttttttcagagcataaactggaaaacttaaaaagagatttacattttcttcctctttttttttttttttttttctgttttgagacggagtctagctctgccgcccaggctggagtgcagtggcgcgatctccgctcattgcaagctccacctcctgggttcacgccattctcctgtctcagcctcctgagtagctgggactacaggcgcccgccaccatgcccagctaatttttttgtatttttagtagagacggggtttcaccgtgttagccaggatggtctcgatctcctgacctcgtgatctgcccgccttggcctcccaaagtgctgggattacaggcatgagccaccgcgcctggcccattttcttcctcttttgaggtaatggatttgtttggagatggcatgttagtagacgactgaatatggaaaggatatcgagttatctattttgttaattttatttttgttttttatcatctagatttttatcatggattagtctgaaatttaaagttctggccagtcggttttctttcatcttgtagtttttacagtatttccactgtgcatatgcaaaatgggtattacataactgtatcatatttggtattgataatttttttttttttttgagacggagtcttgctgttgcccaggctggagtggagtgcgtggtgtgatctcggctcactgcaaactccgcctcctgggttcaagcgattctcctggcccagcctcctgagtagctgggattacaggtgtgtgccaccatgcccagctaatttttgtgtttttagtagagacggggtttcaccatgttggccgggctggtcttgaactcctgacctcaggctatatgcccacttccacctcccaaagtgctgggattacaggcatgagccactgtgcccagcctggtattgataatttatattcagataatttgttatggctctttaatatcccacaaggggctctaaaaagcaaacattcaagagtatgtagtttttagacattaagttaattattttaaacagtgacagcaaaacacaagtgattaaatatagtttatttgttccaatgactaaattttacctcatttattaatctggtcattaaggaatatatttaataatattatgtaattattctttttatgcatgatacacctagaaaaatgccttttgtttctattgatggctttgttgtttggagctacttttgattacttattgcagtttcccaatttagtctttactttatctaactcacaaagtaaaattaactgatcacatggcaactactgtatttaaatagttctggaaaaatgaaagtgctttttgctgcttggtaaatgggtaatgcccttgattccttgactgtaggacatagctgatctaaagtactctgtcagttttaccttcacccatgactgtcattagttgtcaaagttgaaaagtactttagctgtgagaaatccttgtatgtttttattataagaggtataatcatcctcaaagcctgtttttattacatgatgtggactgattattttttctatcacagtgttaacagatggattttattgtaaatacaaagaaaacatattgattattgtagtattcttatgtcacctggccttttgcgtgagattatttattatttctagcaaggctttcttcctttcttattgcccagagactgactgatacatcttttgttatttttacacataaattaaacatagcctttttggacaaattcactaaatattaatgtataaaatgtaattgagtaaatttttatcagaattttaaaaataaaagagcttagactcagtagaactcagtagaagcttcactatttactccagcgtgtgtaaattgtacttactctattctcagagtatatttactgtccttaccattgattctttccctttgctaatttttttttttgttaatggtagctgcgactttaggtggggtatattttcttctcctaagagaatagacagtttttccagattcatcatcattgactgtcaagaaaggacccttcagcaaggctgtaccctcaatgcagttgatggcctgtcttcacggatttacagacttggcctgatgcccatgtaaattcaagctttggcttgtggtaacaaccacaagaagacaagcatctgtggtgcggaggcaagcaggctaactaggagttgacaagctaagaaagtgaaactgttctttcttagttaactgtctttctctggagctctgttattttgagtataatatttccacgacacttagtaaatgcaagctaaaatgtaataataataaattgtattggagaaacctaaaaaaaaaagaaaacacgagacagaacagacgacaaaaacacaaaaaacacagaacaacacagacgcagaacacaacagaccaagaacacgcagaaaaacacagacagaggaagagaacagaaacaaaacacccagaaaccacataagaacagaaacagagaaaagcacaaacaagcaaacagcgcaaaataaagcagaaaaaagaaacag

SEQ ID NO: 713254 - DNA, 325 bp, Homo sapiens
cctataccactgaaacacaggtcaactgttgcatgtcattgaaaaaattccagttcttcacttggacccttaaagaatactgaagagcagccactgtatgtctctaaatcccttttctacatcctaaccttctttcaccagcacaaactctggagctaacaaaaagataccaacttctcctcgtcgtcctggcctttccctgttggtggttttttttaagacagggtctcgctctgtcacccaggctggagtacagtggctcgatcacagctcactgcagcctcgacctcctgggctcaagtgatcctcccaccggtggtatcag

SEQ ID NO: 713255 - DNA, 4046 bp, Homo sapiens
agcggagcgcccggcggccacctctttcccgcgggcgggccggggcggggcactgaagggggcggtccaggaccctgacttgtctcgcggttactgggccggcgcgagcacgcgaggctcgggggcggcacggggcggggtttagcctgtggtgggcgctgcgggtgtttgcaggaggttgcagtactcgctgggctgaggtcgtctcgggtgaggaggtcgcgccggaagtggctctagccgtggcgcctcggcgtagtaaggagcctgcaacagagttttgttgtttagggggcgcggcaccgcaccgctcccttcaccttgcagcagccatggcgaaaggcagagtcgccgaacgatcgcagttgggcgctcaccacacgacccccgtgggggacggggcagcggggacgcggggtctcgcggcgcctggcagcagagaccaccagaaggaaaaatcctgggtagaagctggatcagcaagaatgtcactccttatattggtgtccattttcttatctgcagcttttgttatgtttttggtatataaaaattttcctcagcttagtgaagaagaaagagtgaatatgaaggttcccagagatatggatgatgccaaggctctaggaaaagttttatccaaatacaaggacaccttttatgttcaagtacttgtagcttattttgctacatatattttcttgcaaacatttgctattccaggctctatatttctcagtatactctcagggtttctttatccctttccactagccttatttcttgtttgtttgtgttctggacttggtgcctctttctgttatatgctttcctatttagttgggagaccagttgtatacaaatacctaacagagaaagcagtaaaatggtcacagcagtgtcgcacctccttcttttgtagccattaaggcaggaacaacactgtatcaacttacaacagcaggagaagctgtttcctggaactcaatatttattctgatgatcttggctgttctttctattctgccagccatcttccaaaaaaaactaaagcagaaatttgagtaaaaataatcatctgatttttagttttgctgtcatcaccatctcaggattaacaggtgcatccatttatgttttaaaatcacctcttcagtaattaaacaaggaatttgtaaaataaaatttcctatcagatagttaaagtaatacatttaagtgacaaggggagaagaaagtaaaaatggaaattggtatactgtgaaaagtgctatcaatagttaaggtagacatcttagacatcttataaattattataccaagggtagctgtagataatagtagtgtggtaggaaattgttgatccagctaattcattcaatttaattgaatattttttatctttaataactaaaatagatatttttaaattctagattttttaaagtagtgttgcaggttttgttaatgttaggcttttttcagagcataaactggaaaacttaaaaagagatttacattttcttcctctttttttttttttttttttctgttttgagacggagtctagctctgccgcccaggctggagtgcagtggcgcgatctccgctcattgcaagctccacctcctgggttcacgccattctcctgtctcagcctcctgagtagctgggactacaggcgcccgccaccatgcccagctaatttttttgtatttttagtagagacggggtttcaccgtgttagccaggatggtctcgatctcctgacctcgtgatctgcccgccttggcctcccaaagtgctgggattacaggcatgagccaccgcgcctggcccattttcttcctcttttgaggtaatggatttgtttggagatggcatgttagtagacgactgaatatggaaaggatatcgagttatctattttgttaattttatttttgttttttatcatctagatttttatcatggattagtctgaaatttaaagttctggccagtcggttttctttcatcttgtagtttttacagtatttccactgtgcatatgcaaaatgggtattacataactgtatcatatttggtattgataatttttttttttttttgagacggagtcttgctgttgcccaggctggagtggagtgcgtggtgtgatctcggctcactgcaaactccgcctcctgggttcaagcgattctcctggcccagcctcctgagtagctgggattacaggtgtgtgccaccatgcccagctaatttttgtgtttttagtagagacggggtttcaccatgttggccgggctggtcttgaactcctgacctcaggctatatgcccacttccacctcccaaagtgctgggattacaggcatgagccactgtgcccagcctggtattgataatttatattcagataatttgttatggctctttaatatcccacaaggggctctaaaaagcaaacattcaagagtatgtagtttttagacattaagttaattattttaaacagtgacagcaaaacacaagtgattaaatatagtttatttgttccaatgactaaattttacctcatttattaatctggtcattaaggaatatatttaataatattatgtaattattctttttatgcatgatacacctagaaaaatgccttttgtttctattgatggctttgttgtttggagctacttttgattacttattgcagtttcccaatttagtctttactttatctaactcacaaagtaaaattaactgatcacatggcaactactgtatttaaatagttctggaaaaatgaaagtgctttttgctgcttggtaaatgggtaatgcccttgattccttgactgtaggacatagctgatctaaagtactctgtcagttttaccttcacccatgactgtcattagttgtcaaagttgaaaagtactttagctgtgagaaatccttgtatgtttttattataagaggtataatcatcctcaaagcctgtttttattacatgatgtggactgattattttttctatcacagtgttaacagatggattttattgtaaatacaaagaaaacatattgattattgtagtattcttatgtcacctggccttttgcgtgagattatttattatttctagcaaggctttcttcctttcttattgcccagagactgactgatacatcttttgttatttttacacataaattaaacatagcctttttggacaaattcactaaatattaatgtataaaatgtaattgagtaaatttttatcagaattttaaaaataaaagagcttagactcagtagaactcagtagaagcttcactatttactccagcgtgtgtaaattgtacttactctattctcagagtatatttactgtccttaccattgattctttccctttgctaatttttttttttgttaatggtagctgcgactttaggtggggtatattttcttctcctaagagaatagacagtttttccagattcatcatcattgactgtcaagaaaggacccttcagcaaggctgtaccctcaatgcagttgatggcctgtcttcacggatttacagacttggcctgatgcccatgtaaattcaagctttggcttgtggtaacaaccacaagaagacaagcatctgtggtgcggaggcaagcaggctaactaggagttgacaagctaagaaagtgaaactgttctttcttagttaactgtctttctctggagctctgttattttgagtataatatttccacgacacttagtaaatgcaagctaaaatgtaataataataaattgtattggagaaacctaaaaaaaaaagaaaacacgagacagaacagacgacaaaaacacaaaaaacacagaacaacacagacgcagaacacaacagaccaagaacacgcagaaaaacacagacagaggaagagaacagaaacaaaacacccagaaaccacataagaacagaaacagagaaaagcacaaacaagcaaacagcgcaaaataaagcagaaaaaagaaacag

SEQ ID NO: 713256 - DNA, 153 bp, Homo sapiens
agctaactagacagatagatcaatgggacggatacagagtccagaaagacagccacatagtcttgtgggctatgtgtctactccgtgctgtgcatccatgcttgggtgctttacactacaagcagtgcagacaacgacagtcccgtgtatgca

SEQ ID NO: 713257 - DNA, 4241 bp, Homo sapiens
agcggagcgcccggcggccacctctttcccgcgggcgggccggggcggggcactgaagggggcggtccaggaccctgacttgtctcgcggttactgggccggcgcgagcacgcgaggctcgggggcggcacggggcggggtttagcctgtggtgggcgctgcgggtgtttgcaggaggttgcagtactcgctgggctgaggtcgtctcgggtgaggaggtcgcgccggaagtggctctagccgtggcgcctcggcgtagtaaggagcctgcaacagagttttgttgtttagggggcgcggcaccgcaccgctcccttcaccttgcagcagccatggcgaaaggcagagtcgccgaacgatcgcagttgggcgctcaccacacgacccccgtgggggacggggcagcggggacgcggggtctcgcggcgcctggcagcagagaccaccagaaggaaaaatcctgggtagaagctggatcagcaagaatgtcactccttatattggtgtccattttcttatctgcagcttttgttatgtttttggtatataaaaattttcctcagcttagtgaagaagaaagagtgaatatgaaggttcccagagatatggatgatgccaaggctctaggaaaagttttatccaaatacaaggacaccttttatgttcaagtacttgtagcttattttgctacatatattttcttgcaaacatttgctattccaggctctatatttctcagtatactctcagggtttctttatccctttccactagccttatttcttgtttgtttgtgttctggacttggtgcctctttctgttatatgctttcctatttagttgggagaccagttgtatacaaatacctaacagagaaagcagtaaaatggtcacagcaggttgaacgtcatagagaacatctcattaactacattatatttttgagaataacaccatttctgcctaattggtttattaatatcacatctcctgtgataaacgtgccattgaaagttttttttattggtacttttctaggtgtcgcacctccttcttttgtagccattaaggcaggaacaacactgtatcaacttacaacagcaggagaagctgtttcctggaactcaatatttattctgatgatcttggctgttctttctattctgccagccatcttccaaaaaaaactaaagcagaaatttgagtaaaaataatcatctgatttttagttttgctgtcatcaccatctcaggattaacaggtgcatccatttatgttttaaaatcacctcttcagtaattaaacaaggaatttgtaaaataaaatttcctatcagatagttaaagtaatacatttaagtgacaaggggagaagaaagtaaaaatggaaattggtatactgtgaaaagtgctatcaatagttaaggtagacatcttagacatcttataaattattataccaagggtagctgtagataatagtagtgtggtaggaaattgttgatccagctaattcattcaatttaattgaatattttttatctttaataactaaaatagatatttttaaattctagattttttaaagtagtgttgcaggttttgttaatgttaggcttttttcagagcataaactggaaaacttaaaaagagatttacattttcttcctctttttttttttttttttttctgttttgagacggagtctagctctgccgcccaggctggagtgcagtggcgcgatctccgctcattgcaagctccacctcctgggttcacgccattctcctgtctcagcctcctgagtagctgggactacaggcgcccgccaccatgcccagctaatttttttgtatttttagtagagacggggtttcaccgtgttagccaggatggtctcgatctcctgacctcgtgatctgcccgccttggcctcccaaagtgctgggattacaggcatgagccaccgcgcctggcccattttcttcctcttttgaggtaatggatttgtttggagatggcatgttagtagacgactgaatatggaaaggatatcgagttatctattttgttaattttatttttgttttttatcatctagatttttatcatggattagtctgaaatttaaagttctggccagtcggttttctttcatcttgtagtttttacagtatttccactgtgcatatgcaaaatgggtattacataactgtatcatatttggtattgataatttttttttttttttgagacggagtcttgctgttgcccaggctggagtggagtgcgtggtgtgatctcggctcactgcaaactccgcctcctgggttcaagcgattctcctggcccagcctcctgagtagctgggattacaggtgtgtgccaccatgcccagctaatttttgtgtttttagtagagacggggtttcaccatgttggccgggctggtcttgaactcctgacctcaggctatatgcccacttccacctcccaaagtgctgggattacaggcatgagccactgtgcccagcctggtattgataatttatattcagataatttgttatggctctttaatatcccacaaggggctctaaaaagcaaacattcaagagtatgtagtttttagacattaagttaattattttaaacagtgacagcaaaacacaagtgattaaatatagtttatttgttccaatgactaaattttacctcatttattaatctggtcattaaggaatatatttaataatattatgtaattattctttttatgcatgatacacctagaaaaatgccttttgtttctattgatggctttgttgtttggagctacttttgattacttattgcagtttcccaatttagtctttactttatctaactcacaaagtaaaattaactgatcacatggcaactactgtatttaaatagttctggaaaaatgaaagtgctttttgctgcttggtaaatgggtaatgcccttgattccttgactgaaggtaaaactgacagagtactttagatcagctatgtcctacagtcaaggaatcataggacatagctgatctaaagtactctgtcagttttaccttcacccatgactgtcattagttgtcaaagttgaaaagtactttagctgtgagaaatccttgtatgtttttattataagaggtataatcatcctcaaagcctgtttttattacatgatgtggactgattattttttctatcacagtgttaacagatggattttattgtaaatacaaagaaaacatattgattattgtagtattcttatgtcacctggccttttgcgtgagattatttattatttctagcaaggctttcttcctttcttattgcccagagactgactgatacatcttttgttatttttacacataaattaaacatagcctttttggacaaattcactaaatattaatgtataaaatgtaattgagtaaatttttatcagaattttaaaaataaaagagcttagactcagtagaactcagtagaagcttcactatttactccagcgtgtgtaaattgtacttactctattctcagagtatatttactgtccttaccattgattctttccctttgctaatttttttttttgttaatggtagctgcgactttaggtggggtatattttcttctcctaagagaatagacagtttttccagattcatcatcattgactgtcaagaaaggacccttcagcaaggctgtaccctcaatgcagttgatggcctgtcttcacggatttacagacttggcctgatgcccatgtaaattcaagctttggcttgtggtaacaaccacaagaagacaagcatctgtggtgcggaggcaagcaggctaactaggagttgacaagctaagaaagtgaaactgttctttcttagttaactgtctttctctggagctctgttattttgagtataatatttccacgacacttagtaaatgcaagctaaaatgtaataataataaattgtattggagaaacctaaaaaaaaaagaaaacacgagacagaacagacgacaaaaacacaaaaaacacagaacaacacagacgcagaacacaacagaccaagaacacgcagaaaaacacagacagaggaagagaacagaaacaaaacacccagaaaccacataagaacagaaacagagaaaagcacaaacaagcaaacagcgcaaaataaagcagaaaaaagaaacag

SEQ ID NO: 713258 - DNA, 4132 bp, Homo sapiens
agcggagcgcccggcggccacctctttcccgcgggcgggccggggcggggcactgaagggggcggtccaggaccctgacttgtctcgcggttactgggccggcgcgagcacgcgaggctcgggggcggcacggggcggggtttagcctgtggtgggcgctgcgggtgtttgcaggaggttgcagtactcgctgggctgaggtcgtctcgggtgaggaggtcgcgccggaagtggctctagccgtggcgcctcggcgtagtaaggagcctgcaacagagttttgttgtttagggggcgcggcaccgcaccgctcccttcaccttgcagcagccatggcgaaaggcagagtcgccgaacgatcgcagttgggcgctcaccacacgacccccgtgggggacggggcagcggggacgcggggtctcgcggcgcctggcagcagagaccaccagaaggaaaaatcctgggtagaagctggatcagcaagaatgtcactccttatattggtgtccattttcttatctgcagcttttgttatgtttttggtatataaaaattttcctcagcttagtgaagaagaaagagtgaatatgaaggttcccagagatatggatgatgccaaggctctaggaaaagttttatccaaatacaaggacaccttttatgttcaagtacttgtagcttattttgctacatatattttcttgcaaacatttgctattccaggctctatatttctcagtatactctcagggtttctttatccctttccactagccttatttcttgtttgtttgtgttctggacttggtgcctctttctgttatatgctttcctatttagttgggagaccagttgtatacaaatacctaacagagaaagcagtaaaatggtcacagcaggttgaacgtcatagagaacatctcattaactacattatatttttgagaataacaccatttctgcctaattggtttattaatatcacatctcctgtgataaacgtgccattgaaagttttttttattggtacttttctaggtgtcgcacctccttcttttgtagccattaaggcaggaacaacactgtatcaacttacaacagcaggagaagctgtttcctggaactcaatatttattctgatgatcttggctgttctttctattctgccagccatcttccaaaaaaaactaaagcagaaatttgagtaaaaataatcatctgatttttagttttgctgtcatcaccatctcaggattaacaggtgcatccatttatgttttaaaatcacctcttcagtaattaaacaaggaatttgtaaaataaaatttcctatcagatagttaaagtaatacatttaagtgacaaggggagaagaaagtaaaaatggaaattggtatactgtgaaaagtgctatcaatagttaaggtagacatcttagacatcttataaattattataccaagggtagctgtagataatagtagtgtggtaggaaattgttgatccagctaattcattcaatttaattgaatattttttatctttaataactaaaatagatatttttaaattctagattttttaaagtagtgttgcaggttttgttaatgttaggcttttttcagagcataaactggaaaacttaaaaagagatttacattttcttcctctttttttttttttttttttctgttttgagacggagtctagctctgccgcccaggctggagtgcagtggcgcgatctccgctcattgcaagctccacctcctgggttcacgccattctcctgtctcagcctcctgagtagctgggactacaggcgcccgccaccatgcccagctaatttttttgtatttttagtagagacggggtttcaccgtgttagccaggatggtctcgatctcctgacctcgtgatctgcccgccttggcctcccaaagtgctgggattacaggcatgagccaccgcgcctggcccattttcttcctcttttgaggtaatggatttgtttggagatggcatgttagtagacgactgaatatggaaaggatatcgagttatctattttgttaattttatttttgttttttatcatctagatttttatcatggattagtctgaaatttaaagttctggccagtcggttttctttcatcttgtagtttttacagtatttccactgtgcatatgcaaaatgggtattacataactgtatcatatttggtattgataatttttttttttttttgagacggagtcttgctgttgcccaggctggagtggagtgcgtggtgtgatctcggctcactgcaaactccgcctcctgggttcaagcgattctcctggcccagcctcctgagtagctgggattacaggtgtgtgccaccatgcccagctaatttttgtgtttttagtagagacggggtttcaccatgttggccgggctggtcttgaactcctgacctcaggctatatgcccacttccacctcccaaagtgctgggattacaggcatgagccactgtgcccagcctggtattgataatttatattcagataatttgttatggctctttaatatcccacaaggggctctaaaaagcaaacattcaagagtatgtagtttttagacattaagttaattattttaaacagtgacagcaaaacacaagtgattaaatatagtttatttgttccaatgactaaattttacctcatttattaatctggtcattaaggaatatatttaataatattatgtaattattctttttatgcatgatacacctagaaaaatgccttttgtttctattgatggctttgttgtttggagctacttttgattacttattgcagtttcccaatttagtctttactttatctaactcacaaagtaaaattaactgatcacatggcaactactgtatttaaatagttctggaaaaatgaaagtgctttttgctgcttggtaaatgggtaatgcccttgattccttgactgtaggacatagctgatctaaagtactctgtcagttttaccttcacccatgactgtcattagttgtcaaagttgaaaagtactttagctgtgagaaatccttgtatgtttttattataagaggtataatcatcctcaaagcctgtttttattacatgatgtggactgattattttttctatcacagtgttaacagatggattttattgtaaatacaaagaaaacatattgattattgtagtattcttatgtcacctggccttttgcgtgagattatttattatttctagcaaggctttcttcctttcttattgcccagagactgactgatacatcttttgttatttttacacataaattaaacatagcctttttggacaaattcactaaatattaatgtataaaatgtaattgagtaaatttttatcagaattttaaaaattgtgtaaattgtacttactctattctcagagtatatttactgtccttaccattgattctttccctttgctaatttttttttttgttaatggtagctgcgactttaggtggggtatattttcttctcctaagagaatagacagtttttccagattcatcatcattgactgtcaagaaaggacccttcagcaaggctgtaccctcaatgcagttgatggcctgtcttcacggatttacagacttggcctgatgcccatgtaaattcaagctttggcttgtggtaacaaccacaagaagacaagcatctgtggtgcggaggcaagcaggctaactaggagttgacaagctaagaaagtgaaactgttctttcttagttaactgtctttctctggagctctgttattttgagtataatatttccacgacacttagtaaatgcaagctaaaatgtaataataataaattgtattggagaaacctaaaaaaaaaagaaaacacgagacagaacagacgacaaaaacacaaaaaacacagaacaacacagacgcagaacacaacagaccaagaacacgcagaaaaacacagacagaggaagagaacagaaacaaaacacccagaaaccacataagaacagaaacagagaaaagcacaaacaagcaaacagcgcaaaataaagcagaaaaaagaaacag

SEQ ID NO: 713259 - DNA, 178 bp, Homo sapiens
cgagcacagttggagaagcgatgtaatgttgaagaggcccgtcacccaagtaggaccttaggtcctgcctgaggatagactggaaccatgagcttgcaggaggaaccaacttcagcgacacagttcaggctgatccccaaacggttacccgcctgctctatgggttcctgattaaagc

SEQ ID NO: 713260 - DNA, 1833 bp, Homo sapiens
tgcagatattttaggttgtcacacatagagggggtgctactgcccatctagtaggtagagagaccaaggatgttgctaacatcctatagggcacaggacagcccccacaataaagaatcaacgtggcctaaaacatcagtagtgctggctgggattacaggcatgagccactgtgcccagcctggtattgataatttatattcagataatttgttatggctctttaatatcccacaaggggctctaaaaagcaaacattcaagagtatgtagtttttagacattaagttaattattttaaacagtgacagcaaaacacaagtgattaaatatagtttatttgttccaatgactaaattttacctcatttattaatctggtcattaaggaatatatttaataatattatgtaattattctttttatgcatgatacacctagaaaaatgccttttgtttctattgatggctttgttgtttggagctacttttgattacttattgcagtttcccaatttagtctttactttatctaactcacaaagtaaaattaactgatcacatggcaactactgtatttaaatagttctggaaaaatgaaagtgctttttgctgcttggtaaatgggtaatgcccttgattccttgactgtaggacatagctgatctaaagtactctgtcagttttaccttcacccatgactgtcattagttgtcaaagttgaaaagtactttagctgtgagaaatccttgtatgtttttattataagaggtataatcatcctcaaagcctgtttttattacatgatgtggactgattattttttctatcacagtgttaacagatggattttattgtaaatacaaagaaaacatattgattattgtagtattcttatgtcacctggccttttgcgtgagattatttattatttctagcaaggctttcttcctttcttattgcccagagactgactgatacatcttttgttatttttacacataaattaaacatagcctttttggacaaattcactaaatattaatgtataaaatgtaattgagtaaatttttatcagaattttaaaaataaaagagcttagactcagtagaactcagtagaagcttcactatttactccagcgtgtgtaaattgtacttactctattctcagagtatatttactgtccttaccattgattctttccctttgctaatttttttttttgttaatggtagctgcgactttaggtggggtatattttcttctcctaagagaatagacagtttttccagattcatcatcattgactgtcaagaaaggacccttcagcaaggctgtaccctcaatgcagttgatggcctgtcttcacggatttacagacttggcctgatgcccatgtaaattcaagctttggcttgtggtaacaaccacaagaagacaagcatctgtggtgcggaggcaagcaggctaactaggagttgacaagctaagaaagtgaaactgttctttcttagttaactgtctttctctggagctctgttattttgagtataatatttccacgacacttagtaaatgcaagctaaaatgtaataataataaattgtattggagaaacctaaaaaaaaaagaaaacacgagacagaacagacgacaaaaacacaaaaaacacagaacaacacagacgcagaacacaacagaccaagaacacgcagaaaaacacagacagaggaagagaacagaaacaaaacacccagaaaccacataagaacagaaacagagaaaagcacaaacaagcaaacagcgcaaaataaagcagaaaaaagaaacag

SEQ ID NO: 713261 - DNA, 1858 bp, Homo sapiens
agcggagcgcccggcggccacctctttcccgcgggcgggccggggcggggcactgaagggggcggtccaggaccctgacttgtctcgcggttactgggccggcgcgagcacgcgaggctcgggggcggcacggggcggggtttagcctgtggtgggcgctgcgggtgtttgcaggaggttgcagtactcgctgggctgaggtcgtctcgggtgaggaggtcgcgccggaagtggctctagccgtggcgcctcggcgtagtaaggagcctgcaacagagttttgttgtttagggggcgcggcaccgcaccgctcccttcaccttgcagcagccatggcgaaaggcagagtcgccgaacgatcgcagttgggcgctcaccacacgacccccgtgggggacggggcagcggggacgcggggtctcgcggcgcctggcagcagagaccaccagaaggaaaaatcctgggtagaagctggatcagcaagaatgtcactccttatattggtgtccattttcttatctgcagcttttgttatgtttttggtatataaaaattttcctcagcttagtgaagaagaaagagtgaatatgaaggttcccagagatatggatgatgccaaggctctaggaaaagttttatccaaatacaaggacaccttttatgttcaagtacttgtagcttattttgctacatatattttcttgcaaacatttgctattccaggctctatatttctcagtatactctcagggtttctttatccctttccactagccttatttcttgtttgtttgtgttctggacttggtgcctctttctgttatatgctttcctatttagttgggagaccagttgtatacaaatacctaacagagaaagcagtaaaatggtcacagcaggttgaacgtcatagagaacatctcattaactacattatatttttgagaataacaccatttctgcctaattggtttattaatatcacatctcctgtgataaacgtgccattgaaagttttttttattggtacttttctaggtgtcgcacctccttcttttgtagccattaaggcaggaacaacactgtatcaacttacaacagcaggagaagctgtttcctggaactcaatatttattctgatgatcttggctgttctttctattctgccagccatcttccaaaaaaaactaaagcagaaatttgagtaaaaataatcatctgatttttagttttgctgtcatcaccatctcaggattaacagctgcgactttaggtggggtatattttcttctcctaagagaatagacagtttttccagattcatcatcattgactgtcaagaaaggacccttcagcaaggctgtaccctcaatgcagttgatggcctgtcttcacggatttacagacttggcctgatgcccatgtaaattcaagctttggcttgtggtaacaaccacaagaagacaagcatctgtggtgcggaggcaagcaggctaactaggagttgacaagctaagaaagtgaaactgttctttcttagttaactgtctttctctggagctctgttattttgagtataatatttccacgacacttagtaaatgcaagctaaaatgtaataataataaattgtattggagaaacctaaaaaaaaaagaaaacacgagacagaacagacgacaaaaacacaaaaaacacagaacaacacagacgcagaacacaacagaccaagaacacgcagaaaaacacagacagaggaagagaacagaaacaaaacacccagaaaccacataagaacagaaacagagaaaagcacaaacaagcaaacagcgcaaaataaagcagaaaaaagaaacag

SEQ ID NO: 713262 - DNA, 147 bp, Homo sapiens
caggttctggctcacagtcttggtgcctgctccttgcagcagggtccacttggtgtccagaaccttgtgctgctgctccaggaaccgcaccttgtcgatgaatgaggcaaacttattgttgggggtcttgatggaagcgtcgcgcat

SEQ ID NO: 713263 - DNA, 694 bp, Homo sapiens
cggcgccggcgcaggcgcagagagacaacgacgtctacttgttccttgggttacacatttcctgagagtatctacatattcataggcaacaccgatgtgaatgtgacagattagctccagaaagaaagcagtgtgaaaaagatgaaacacagatttgaaagcaatcttgaagatcagacagaaaaccagcctatgaatcaaagaagaaaatcaaaatcagacttcataactgcttcagtaacccttggcaacagacaacacactggattttggcgaataacactaaaatttttgctggtgaggtcttcagaaactggatagatgtgaaaccaccagaacagaagtggagcgggcatggtatctgtttcttcaatttgtagttttatagtcaaaaactggcatgtatatacttaattggtaacatgtaagtcacgtgcctctatcccaactctaagagaggttgagaacttaatttctggcttctaccttgggaaggatcaggcttataagctggaaaattagccaacatacacaggatattcaaagcttctaggcagtcaaaatactgtcaagtggtaaaacagacatgaaaaaacctttttctctctcctaaatttaaaaaaatataatttttgtaaaacactgtatgtggctttccataaaaattaaaagagtcttgggagacagaacatcc

SEQ ID NO: 713264 - DNA, 1175 bp, Homo sapiens
gttacctcaccctattttcaagcagtgatcattgtcgtaattcgacctgaactgggcgagagcggtacactggaggatagctgtgctgacgtaagtctagggaccctcctacatctggggctacaggtattaggaacattctgacgaattcaaagaactgtgagaaactatttccgtacagaccagtactcttataagcttgtcttccactctcgtaccttgggccctgtgagagtgtagatgtggaccctgatagtcccgagttccttggccctctttgcgtttagtatgatcagctattgcatattgaattgaacatgagtgaagcgctacacatgctgtgggatcccttcgcgttatgaaaccataatagggggagacgcatttgaattgtaaacactcaagagatgtgcgaagcgagctcattatgctactctagttcatttgggcacttgggttgacgcaatcgcggaaagcggtaagaacggccgttggtcctacttcgttggcccatcgtacaatcaatgtaggggtccgtctgagggaccagtgcgcaaaatggcggaggtcacttgtaccgcgagttgctattctcaaactaaggaatgggacgtctggaccatccttgcaagccgtgagacgagacgccattctatggtgcgcctcgtctaggcttcgttaggccaaaacgtggcgggggcgacttgtagaaaggtgcgttgttcgatcccttgctggtgagggcgtcacgcaattgcctggagccttgtcaagtaccagccctaggttaaaggcccgccggaaaggtgatacactgctgggtccccgaggtaatgagacgacagggcttttggtaactatgaaatcgattgccctcgtatatgcgttgttcatcccacttacctgacatcactctttatatggggacattgggttcttcccgaatcgtccttctatggggcaagaggatgccgtttttggccccatgtggggccctttaatgacttgtgtgaaacagccccatcccaagtggataattttactggctcacaagtttcgtccttcacaattgcgtggtcaattcattgtaacgggaggacaggcgggcgtccagtattgatagtcggttgggtagagaccgttgcgaatataagtattgcaccggttggttgacg

SEQ ID NO: 713265 - DNA, 218 bp, Homo sapiens
ctcacatgtacactctgcatttctggaacaatgaacagagcacatacagacgcattgccatcattgaccaataccttcatacctggctattgtactcggctcaggcaacatgggcaatactgtggctctttgctgcgtgtgactgacaccaattggccatactgtagcggccggatgataagtgtaatcatacagagaatgctgttcttcgaggcagc

SEQ ID NO: 713266 - DNA, 561 bp, Homo sapiens
tctccacaccacaatactatgcacactacacatacataccactacacgcacacaccattacacacacactacacacaccactatgcacacactacacatacacgccactacacacaccactacacacacgcaacacacaccactatgcacacaccactacacacactacacacaccactacactacacacacaccactatgcacactacacatacacaccacacacacatacaccacaaacacagcacttatacacaccatgcaccacccacataccacacacagtatacacacataacactcacaatacactccacacacacatatacataccccaggtacctactacacacacagaccacacacacatatcaggcatacacctgcacacacctcacagaatacctacaatcctcatatgtagaactcaattgggctttcaaggagcctggatagtaaagtatctcatgggcgtgtgagtgagccaagaaaatgcgtataaatacacatacagcaccacacacattccactggctatacactgtatgtggaggtagcact

SEQ ID NO: 713267 - DNA, 178 bp, Homo sapiens
ggggcccctgggggggccccttggggcccctgccttggggtcccgggtcaagggcctgccctgcctggccgggcggggggttttccctgttgtggggggtgttggcgttgggttttgggtttttttttgtttaaatttttccgggttggcccttttatttttacccctgccttccgga

SEQ ID NO: 713268 - DNA, 105 bp, Homo sapiens
tggcgagtaaggggcacgtgtggctgccttcccttgccaccatggcattgttgctgctgcgcttttcctgcatgcgggttgcagtttactgaccggctggagagg

SEQ ID NO: 713269 - DNA, 135 bp, Homo sapiens
aggcaagctcgggtacgttgacacgagaggacgagcgctcaatcatgcttcgatggaggagcgggccagctgtccttcaacacggacactgctctgatgaccacccatgagctgtgccagtggaggacactgctc

SEQ ID NO: 713270 - DNA, 168 bp, Homo sapiens
tgctggctgtccagaggacccagcggcctctttactactgcgcggactcttactaatggccggtatctctcctcatgagcggatctttactaatggcatctttactcatgcccggcatctttactaatgagcggatctttactaatgtacggcatcattactaatgaa

SEQ ID NO: 713271 - DNA, 315 bp, Homo sapiens
gggcgtgcacgccaagcagctttgtaggagtggaggaagtgcatgcctatccctatctcagtgatacgcagaattttacgggagaaacaggtgggctgccggcagcagtggctgcccaggaataagagcatggggcataaaacagcagtttattcgagcatggaagagcagcttgctgcagcggtgcgtcatgtgagctgctttgcagctagagctgaggtgaggcctggcagggctgtattccccaccctaaggtgggtggtctatcttgcaggtagaaggaagcccctgaatgatgtagacagaggggcgata

SEQ ID NO: 713272 - DNA, 347 bp, Homo sapiens
gtagcatgccatgctcgcagcggccgcccagtgtgatggcatcttctgccagcacattcgtgcttttgtgatgtttccagactgcgggcacagggccaggcaacactttgtatcaacagcagcctggttgctcaggcagtgcagggggcacttttcccacacatcagggcacacaggttcaccaggtgcagcattggcccggcagcaagttgtttcatcagcacacggtgtcaacctcggccagccaggcacaggtcatgaggcacagttccacctataagcaaccaaagcacaccacaggcacagttcaaacactttgcacagggcaaatcccatagtcatctcaa

SEQ ID NO: 713273 - DNA, 889 bp, Homo sapiens
attaatcccctggcccaacccgtcatctactctaccatctttgcaggcacactcatcacagcgctaatgctcgtcaactgattttttacctgcaggtaggcctagagataaacactgctagctttgattccagtctctacaccaaaacaaataaaccctcgttccagcatgagagctgccatcgagagtatttccgtctacgcaaggcaaccggtgtccataaagtctcgttctatagtagctatccttcttcaacaagatatagcgtctcgcggacagagtgaagcctagtaaccgaatagctaaccgaatcatatactcatcaattagagtaatcgatattggcgtattaggcaagattaaaaactagggatataagcccgcctttcatctttcctgatgtcccgatgaaggttacccgagatggcaccctgtcgtgactattcgcgggtctgcttcttctcagcatgacaagagatacgtagccgccgcatctcaggtcatatacctaatatctcgtccctcactaaagctgtaagggcttctccttcatttctcatcaatcttattgcatcatagcaggcaggttgaggtgttattaaaccataatcccagcgtaggcaagatcttgagcagtagtcctcaattacccacagtaggatgaattaatcaggcagtgctaccgtacaagccttaagataacattgcttaatgttaactatttatattattcctaactactaaccggattcctaataatcaattaaaatcccgggcccagaacctaatattatttggacctggaacaagttaatgtttaacaccttatttctcaacctctttcctaaagggtgcccgaaaccggtttgccaaggctttcggaatccaa

SEQ ID NO: 713274 - DNA, 334 bp, Homo sapiens
aaatcagaaacctagaaatccccttagatttttcaagggggtttaacttcctttgggtgcgggcccccaaggcattttcatttttttgggaaagggccctttatttccccccgggtttttccccttttccaggatattcaaaagaaaagcaagttttcttttttttttttttggggtattacatttttttggggtttggtggcctctagttttacccccccccaaggttgtttaacattttttttttttaaaaataccccccatgggtttttccccaacaggccgctttccgggggtgaacccctcccggggggttattattttttgttattta

SEQ ID NO: 713275 - DNA, 275 bp, Homo sapiens
tcgatctctagcaggatccccaagttcatctgggatcaaccagatagcttcactagattttatttgttattctaccttgcagtaaactaagtgtgaagcttgccagtatgcttggaatcatcttttgttttaaaaatcataatgcccaattgctaacttcttatctctttatttcctacatatggaaggagctacctcctaccagatgtcttgctaagtataaccacctatagcttctactcaactgatctacgttcaagatagggtttcgatga

SEQ ID NO: 713276 - DNA, 195 bp, Homo sapiens
  misc_feature (6)..(6): n is a, c, g, or t
  misc_feature (38)..(38): n is a, c, g, or t
  misc_feature (73)..(73): n is a, c, g, or t
  misc_feature (91)..(91): n is a, c, g, or t
  misc_feature (96)..(96): n is a, c, g, or t
  misc_feature (106)..(106): n is a, c, g, or t
  misc_feature (112)..(112): n is a, c, g, or t
gcacancatcattggctcgccagttccacaggaccagntacagatcatcattgcagtgacagacatgttgcancatgcagttcactcatcnatcanattgcagacnatcccnactcgacgtggctttccagtggccacagcatctatggcaatccatctgtcatccaattctgccaatcagtgtcatttcttggc

SEQ ID NO: 713277 - DNA, 259 bp, Homo sapiens
gttcagaaacgggagggagggagcgcaggagaaacagaggaatggtagggacgacagtgtagaagggcaaaaatgggaaaaaagaaaagatacatatgtacaacttttatgcatccataaaacataagaaagaaaaaaaaagaaaagagagacgcggagggagagagggagagaaagaagagtaaacacagcacagacatactgtacaagaaggaagtgactttcaccattgtcttacattcagctgtgctgacctgca

SEQ ID NO: 713278 - DNA, 382 bp, Homo sapiens
aaggtcctgctgcgtgagcattgacgtgtttggagctggagacggcctgggtgctggcgaagcggaggccggagtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaa

SEQ ID NO: 713279 - DNA, 151 bp, Homo sapiens
ctgtgaaagacggtgcattatcgaggatgtagctgacagtcgatattcgtcgttgcaatgtcatagccttaccctgtgtgacattagtgctcctgcaagggtaaatagagacccagtaaaattgtaataagcagtgcttgaattatttggt

SEQ ID NO: 713280 - DNA, 1660 bp, Homo sapiens
aaggtcctgctgcgtgagcattgacgtgtttggagctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactggtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttccaaaa

SEQ ID NO: 713281 - DNA, 901 bp, Homo sapiens
agttttttcctttttagatctcacttactggaaaagacagaagatatgtgtgggatcatctataaaggccgtttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttggaaaaaccacaaagctacaaatttgaccctctttttttttggagacggagtttggctctggtaacccaggctggagtgcaggggcgtgatctgggttcactgcaattccgtctcccgggtccaggtgattctccgggcctcagcctcccaagtgggctgggttaatagggtgcccgccaccagacccggttaatttataagttataagtagagacggggttccaccaggtggggccaggctggtcttaaagtgaccctcttatttttaacttggatacctgtattctgcaaaagacaattcctagagtagtttggatgtgggtggatttcccccactcccaaaatctgaagccagtgtctagcttactaaaaacaagagttgtctctaatatttacagatgttgagtatacataggaaaacgtgatgtcgttgtaaggtgtcttaaagtctttgtgttttatccccttctattgattggacttcgggaatccggggaccagagtgggttggggtgacacctgtgtggttaacactttcgttggaaaccaggtggggattaaaagggggaattgtgcatgaaaattggaacgaaatgatgcctaggttggaattaaataggtcgttgtcacggcgttaaggaggctggaatggagaac

SEQ ID NO: 713282 - DNA, 105 bp, Homo sapiens
gaacaggtcaaaaagaacctttattaccttttatgattgccacttatgctttcctgccagaagcctttggaagcaaggtgcctttttgggctggggcttttttga

SEQ ID NO: 713283 - DNA, 530 bp, Homo sapiens
aaggtcctgctgcgtgagcattgacgtgtttggagctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactgggtatatgtgatgttacctagtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaa

SEQ ID NO: 713284 - DNA, 426 bp, Homo sapiens
aaggtcctgctgcgtgagcattgacgtgtttggagctggagacggcctgggtgctggcgaagcggaggccggagtaagaagactgttagaatgccctcggtaacacagaggctgagagatcctgacataaatccttgtttgtcgatcctgttctaccttttaaatgatgcctctcttatatctgtaaggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaa

SEQ ID NO: 713285 - DNA, 574 bp, Homo sapiens
aaggtcctgctgcgtgagcattgacgtgtttggagctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactgggtatatgtgatgttacctagtaagaagactgttagaatgccctcggtaacacagaggctgagagatcctgacataaatccttgtttgtcgatcctgttctaccttttaaatgatgcctctcttatatctgtaaggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaa

SEQ ID NO: 713286 - DNA, 442 bp, Homo sapiens
  misc_feature (7)..(7): n is a, c, g, or t
gaaaacnacgttcaagtttttattcacaaagtacagagaatacatgaagttcctcactaagtgatcattatgccaaaatcaaaatttcagtaagaagactgttagaatgccctcggtaacacagaggctgagagatcctgacataaatccttgtttgtcgatcctgttctaccttttaaatgatgcctctcttatatctgtaaggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaa

SEQ ID NO: 713287 - DNA, 268 bp, Homo sapiens
gaaaaaaaagaaacaaaagcccccaaaacaaaccagaagcaaagtagggagattaaaatgaggcttccagaacagtgtgcaaatagggagtgtcattaagtgtcagtgcttgtccatcttagcctcatttggccctgttttccccatctctctgcagtgcccttcatctcttgcatatcctctctggatatctctcggggggacatcttcttctaggatatctctgcgggggtcttctccttctggatatctctctggtagctatcat

SEQ ID NO: 713288 - DNA, 1532 bp, Homo sapiens
aaggtcctgctgcgtgagcattgacgtgtttggagctggagacggcctgggtgctggcgaagcggaggccggagtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttccaaaa

SEQ ID NO: 713289 - DNA, 151 bp, Homo sapiens
gactctagagaacccccggaggcgttgaatgccattcaacgccggaggcgtttgaatggccactacagacctgacagccaacgggatcagtttatgtctcagctcagtatccctctttgccggccctgagctgacttccaccaggcctccg

SEQ ID NO: 713290 - DNA, 1576 bp, Homo sapiens
aaggtcctgctgcgtgagcattgacgtgtttggagctggagacggcctgggtgctggcgaagcggaggccggagtaagaagactgttagaatgccctcggtaacacagaggctgagagatcctgacataaatccttgtttgtcgatcctgttctaccttttaaatgatgcctctcttatatctgtaaggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttccaaaa

SEQ ID NO: 713291 - DNA, 1704 bp, Homo sapiens
aaggtcctgctgcgtgagcattgacgtgtttggagctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactggtaagaagactgttagaatgccctcggtaacacagaggctgagagatcctgacataaatccttgtttgtcgatcctgttctaccttttaaatgatgcctctcttatatctgtaaggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttccaaaa

SEQ ID NO: 713292 - DNA, 418 bp, Homo sapiens
ggggtgagcagaacagggggctagtctatatcgtcggagtgagactacgggggcatgccactttggcggaggttagtcgatcttatctaggttcaaatttatatacagaaattgctaataatatgccatatttccttaagggtatacctcatgatgtctcctctttgagtcctaatactggtaaatggtgtctatttcctttttttactagatcattctacttagaggtttataaaaaactcgcttgggtttctttcctttgcacgacttatttttctgttcttaatttcatggattttcgttcattatgatgtcttctgcttccttggggtttaattgggtctccaattttagtttcttaggtggaagtttaatggattggaggtctttcttcttccctaatacaagctttaatgct

SEQ ID NO: 713293 - DNA, 1783 bp, Homo sapiens
  misc_feature (593)..(593): n is a, c, g, or t
  misc_feature (670)..(670): n is a, c, g, or t
tggccaagggaacaggactatcatttaattggcctctagggtcctccggggaaagggatctgggggggccttgggcaaagtctctctgtggcgtgatgtggaaccaacagagggtgcccattcagccagtgtgccaggcaggatgtgggggccccaatgtgcttgggcgtgggggcagccagcatttgggggcgtggtggctataaaacaatttctttgaggacataatgtgggttaaggaaatgtggtgtgcctttatgaagtggggggaagaggggacttacatttatagaaggaggaaattgcacgagggagagtgtgggtctcaaagaggggtcctttacagtgggccgaggtgtgaaaggctgtgggtggtaaagttgtgtgtgggtgaagtgcgggagtctcccacagacagaggggggaaaactctctgtgggacacacgagcgtcgtgtgacaactctcaaagacgccagagagcttctcagaggtgaaacactctccctgtgtgcaagccgggtgtggtttgtggtgctctccccacacaagagcgctctctcataggaaaagagagcggctcactataaatgntccccccacaagcagtgtaaatgtgggtgtcgccccctccggatttgaggaaccaaaatccctcgggggcgtggtgnggcgggtgtgggaggctcttatggggggtggtttggcgcccctgtgccccaaaaggtggtctctccggggggatctagggggggcgagaggagtgtggcgaaaccgtgtcgagaacgcgtgggggagcataacattcgacggcggggggagggccataaagagatcatattcctcggagaggccacaaaaaatcggtactttgtggtgcgggggcgtagcaacaggggccgccgggaaggattttaaaaaagagaggggcggttttataaaaactcctcgtcggggtggtggagaaaaagagacaccttcttctcttcatatggtggaggaacaaagaagtggttttctaaagacaagggggggggctgttgagaaaaagttttttttgaaaaaatgggctttttggacccgtggtgggtgggcaaccaactcgggttgcgggtgcgctgaggaattgtgtgcacaccatattggctacccgtggagaggagtttagaacactctcgagatgaaaacaggatggcccaacaaggcggcttcccgagaaaaactacttgggcgggcgttggagagaagaaccccgggtttataatttggtgggcccacaggggagggcgcgaccaagaaaacatttgggagtggaggcgccacccaggggagagatatgttccccttatgaaagcggagggcgcggcggggaaaaaaaccccacccatttaaattggtgggcggcgcagagacgggcagcagacagattatataatgaaaacgccacgcaggggggcgccctttcatctacacaacaggtgggggggaaggagcgccaccgcgcggcagcgggagggagatggtattaacacacaagtggggtgaaacgcacccgtccctccgcgtgctttagtagtacaatcatgagtccagcttctcaacaaaacggggcgtgctggctgacttaacacacgcgccaatcaacaagcgaggggagagagcagctgacggcttgggtgcgaaacacacacctccctgctgtgcgatagttactcacatcgagacaaaggataatcataaacaacgaacatctgatcgagaaaacaatagacactcacttcagc

SEQ ID NO: 713294 - DNA, 1680 bp, Homo sapiens
aaggtcctgctgcgtgagcattgacgtgtttggagctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactgggtatatgtgatgttacctagtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttccaaaa

SEQ ID NO: 713295 - DNA, 214 bp, Homo sapiens
tgcttcagttcgtgcatggtgcgctgcaccgactgtcctgcatccactatctggcactccctagtgagatgaacccggtacctcagatggaatgcagaaatcacccgtcttctgtgtcctcacgctgggagctgtagacgggagctgttcctattctgccatcttggctccacctatactgatgatttctaagaggtgaacatattcagacgtc

SEQ ID NO: 713296 - DNA, 830 bp, Homo sapiens
gacgggagtcgggtgggatcccaggctggccccgcggcggctgattctcttccctggcaagtctctgagatcttctcccaggcgatgcaaagtactcgtaccagcttggacctgtctgcagtatctcctctggacctgccatgctgaggacccattctcacctctgagggactcctgtcctaggactaaggtggagcctgggccattggtacagctggctcctgcggcagcaatgacgagttcaccttaaggagcgacactgtgcctgtcgagatgtccaccttataccccgaaccatagacatctcattgtacggtgaacagccgtggggcagccagttttcctgtccaaattcaagcttctatggagcaagaatcttgacagatcaggagccagggttggccgtcacagagatgttcccacaaaagggagcctccttctgctgagacaggcagcacaggtccctccaggatgtgccatggtaatgagggttctccctccaggccggaactgacacacactgccaggaatggctgaaggtacagtggatgaggatgggatttgacgtcggtgagaagaccacgagccggctctgatccaaaccaaggaggcctcttagagacagggtcctcccttggttagcccaggaagagccgcgtctgggaaaggaacgcaagggcggggttctagaaaatcgcgcgatctcttgccggtgccagaattgccaaagactcgtgccggggtgtttgcaactggcgcagcggctctgaaccgccctgccacgttggggccccccttgccggaacggttaccccatagggggcataatc

SEQ ID NO: 713297 - DNA, 460 bp, Homo sapiens
agagctgcacggtttcttccaactgcatctattgtctgagactgcgtctcattttccctgtcttctgcactgagcaatcactaaccactctgtgggcctcttggcaggttattagtcaggttctctagagggacagaactaataggacaggtgtatatatgcaagggagtttattaaggagtattgactcacatgatcacaaggtaaagtcccacaataggccatctgcaaggctgaggagcaagaaagccaatcctagtcccaaaacctcaaaagtagggaaggagtgcagccttcagtctgtggccaaaagcctgagagcccctgggaaaccactggtgtaagtctaagagcccaaaagctgaagaacttggagtctgatgtttgggtgcaggaagcatccagcatgggagacagatgaagggcagaagactcagcaagtctgctctttccaccttct

SEQ ID NO: 713298 - DNA, 879 bp, Homo sapiens
ggcccaggcttccccgcagccgggcccggcaccccagccgcactcctgaccgctggccaagcaggaggagctggatgcgggactggcccagcgctccgaggagcggtgcaatgtggttttgaggccacagacagcaggacccagaggtgcctgctggtgagtgggcctgtgccggtggcctgggtgcccccctgactgaggaccagcaaaactggcttagtgaggagatctgagaagaagtggcttggagctggagaagctgcccctgctgggagaataagcgggtgcccctcactgccctgtcaaccaaagccgctggagagcgcctgagggcccccaagtgacgggcacgaggccactggagaaggaggttcaggctcttcggtgcccagactggaggcgttggctgtctccaagggtggaggctcctcagagatgcactgaagatcccatggacgggattggccacatcccccccggggatacatctcacaaggagcgcatgtgacgcgcagcctggcagacgatggatcgtcctcgcacatgcaggttcatggaggagctgcaagaggaccaacgaagcgggagcatgcacgcgacctgcagccacggagacagggaggtggcgtcctggactgcggagaacggcaaggcaccgggcctcagacccatatgaacggcccagacagcagggcctagtccaggacaggagcttgagacagcggaggctgacgcaaggagacggacttctccagcatgtggcccgggcttgcactccggggaagccgaacgcagtcagatgtggggtcactgacaacgagagctggagggatgctatcgcaagcagccctctgcaggggctgcttggggaatgggcca

SEQ ID NO: 713299 - DNA, 118 bp, Homo sapiens
aactgcgttggtgaagtaaggggtgccacttaagggcaccgggtttctggttaagatgcgacactgcgccctccagtgcaccgacactaggacagagcgcagctcggcagtcgcttgc

SEQ ID NO: 713300 - DNA, 283 bp, Homo sapiens
ccccctccccgggtagctgtgattacaggcatgagccaccatgcccggctaattttgtatttttagtacagacggggtttctccatactggtcaggctggtcttgaactcctgacctcaggtgatccatccacctcggcctcccaaagttctgggattacaggcgtgagccaccatgcccgtcccccttgttctttcttaaacgtcctctttactttctctatcatttgtcagactattcttatcttttttaaatgtgtgttacccggggaggggggggtacc

SEQ ID NO: 713301 - DNA, 659 bp, Homo sapiens
  misc_feature (457)..(457): n is a, c, g, or t
tggggggactggcttttggtcttaaatccaatctactcagtaacactggcagggtccaggggctggggaagaggttctggtggggcacaacgggggtgggacggacctggatgggtcccagcccactgggggtaacgcaggggatgtgattggacgcgggggaccaatgtcgcattcttctcaccaaagtgttctctctggtgggcgcttgggcttctctaaaacaatctccaagaaagggcttggagtgtccaggcaccagcaaggtggagcaggttcttacatctggaaaaagagggccagagaacggggaaccatctggtgtgtgggggggagaacaccacccgagcccccgagggacaccaccactgggggagagtggtgcacgagtctgggagtctcccgaggacacacacagagtctgggtgacactctctggggggtgtgtgccccaccnaagagggcgagaactggtgcccctattctctctttccacccagagaggaacaaggagaacctctccacctgtgtgggcgtggagcgaagtagcccaagaccgaggcgagagggttaaggaagaggggtagccccgaggggcgcccactgggcgaggcccaaactcgtgggtgaagtgcgcgtggcctttggggaaaccaggc

SEQ ID NO: 713302 - DNA, 329 bp, Homo sapiens
agggactccggacccacgccaccctgctcaccggtcgtgggctggcctgtccactcctcttgagctgcccgtgtcacgcacttctcacctcctctccacctcctggtccaggcccggccttggcccctgggctcctgcactgtctcctcttggcctccccacccctagtcttgcccccgacggtggattgtccatgcagagctcaaagcgatctttaaaaatgtggatctgatcacatcagttcctgctcaggatgttccactggcctccctccctgtaaagtaaaacccagagtctgtgttgtggcctttcaggtccgcccagcatga

SEQ ID NO: 713303 - DNA, 921 bp, Homo sapiens
gggccttgtgacggggcggggcagggggcggggccgggcgagcttcggggtgggaggggcaggtgggcggggcttccgcggacccctcccgctgcgccgccttgcgtgtcctcttcgctccggccagaggcccgcctctcactgtctgccgaggggtggggtcgggcggtgggcgctgaagacccctggaggcagaagtctggtctggccaatttgactggccgttcggtagttaagaaatttattcctaaatgcgggatttgctgaagctgcccgggactgaccgtccgttctcggccttaaaacccgacgttcacttcttttcatccagatctctcccaaatcaagaagcctaatcctttagttcccaaagtcgaggcctcgtggtttaattgccccatttgctctgtcagcccaaactctgccaggcctgctactagagacccttttttatttgtttaattcttgtggatacatagtaggtgtatatttacgggctacatgggatgtttagatacaggcatgccatggataagtaatcacatcaagtagagacagagtttcaccgtgttagccagaatggtctcaatctcctgacctcgtgatccgcctgccttggcctcccaaagtgctaggattacaggcagggttaggcttgctgaggggcaggcacaggagtcctggctgagctcatggcctgaggctgcctagcggacaccggggaatggtgcaatggcggaggcagagggcaggggtggcaagtggaggtccgtggactgccccctgccgtgcccgacgaggctgctcactctctaacttgaaaaccggcgacgctctggagggagacctgggtggagctggcaggagactgggctgtgggggcgtcctcaacttaacagaagctggagacgcggagagggc

SEQ ID NO: 713304 - DNA, 107 bp, Homo sapiens
cggcgctgtgacggtcattcccgggctcgatgccggaaaaacacttggccgccggaagggcaggcacatgggcataggtaagcggaagggtgcagccaatgcccgaa

SEQ ID NO: 713305 - DNA, 391 bp, Homo sapiens
atcgttcatccccttgtctccaacaccatcacgcagccacaggtctggagaggggggctgcaggctagccagaggtctgcaggtgcctcatctcactggtgcggccgtggtgacactgaggagggagcgtggcagagggaacgatggccgtggtgacactgaggagggagcgtagcagagggaacgatggccgtggtgacactgaggagggagcgtggcagagggaacgatggccgtggtgacactgaggagggagcgtggcagaggggaacgatggccgtggtgacactgaggagggagcgtggcagagggaacgatggccatggttgccattgaggagggaactggcagagggaacgatggccatggctgacactgagaagggagcgtg

SEQ ID NO: 713306 - DNA, 174 bp, Homo sapiens
  misc_feature (3)..(3): n is a, c, g, or t
  misc_feature (16)..(16): n is a, c, g, or t
  misc_feature (67)..(67): n is a, c, g, or t
  misc_feature (97)..(97): n is a, c, g, or t
  misc_feature (167)..(167): n is a, c, g, or t
agncttttgtcctcanggttgtggacaggaggtcgcaccactggcctggcgagaggcctctggtggnccgtggctttcccccagttatctgctaagnaaaactgtgctcttcgaaaggcagagccaagaagtcagccctgacttttgtaaaattttattaaatacanaacctgg

SEQ ID NO: 713307 - DNA, 1509 bp, Homo sapiens
ggcagacatctcgcaaactctgtgcttctgctcgatctgcgcgctctgcgtttctctgctctggtcgacaactggaacgaagaggagtctgcctgggcttggttcaattggaccagatgtgcatcacggcgatgtttgcactagcctgggtgtgtatgcctagtgggtacagaccgacatcacgcactaagacgcagatggtttgcccttaccgcatcgctcaggtgcgcactccgccaattaagaagcggcagggccagttgactgggtgtaagtcaactggagtgcaattaggacggactcggtacgtagcgcgaacggcagagcccaagagcatagccggtggtgatctcttgaattcgcatgaacgtaatccctcgattcgcatgctatggacgatcgttctacccaaagttgggggtaccgcacgatgtcacggaaagtatgctgggcaatgaacacctttcgtagcaactgacatcgtgctgccgtggaccccgttgaggaggctatcctcatgtggcgtgacatggaccccgcattgggggcgcacaccctggaaagcttcacctagaggggcgccaaacatgaaggagttgcactcacgtgtagcatcaggaaattaaattgctcattgtaggcaccactgtcataactacccgcgcggggcactattgttagccgttgttcaccattcgcatgggccgcaaggtgggcctttgatcacaccgttccctcacctgcccctttgcataggaggggccaggcaaagcgacgagcctttggggaccaacgtatagcttcgacttctgtggcattccttcggttgcgaattaggaaccaagggggcgcttcacaaaacgcccgaacaaagcggcgtttcggaacgcaccaaattgccttaaaccccaacgaggcgccttaagcaagtcgcgttctgtcacaccgcacaccgccgaggaagggcactaactttccgtttggacccgcctttctgtgggaaacaccgtggcgcccttgggttccctgagggtttagcccacgtggtacacacctgcaccccttagcaccgttcgcagtttgcagcaagaaaacttccccctttccaactttgtactgtcccgaacagaagacctttactatcgacactttcttccccgctaaaccaaacacgaagcgcctcgacattcggggttgagaacaatttctgggtagcccgtcgggagagcacatcgcacatagagggagggcacaaagctttggttcggcctgtaaaccggctcggagcgctcgcgtatagagcaccgttatacagggacagcgcaaacggggaaagggagatttgcggactccagagccacagggaagcgcggaaagatcccccttacacccttccttttcccattccttttgggatccacacagatccactctcgtaacagaaactcgcttaaggacacccggggattttggggcccataaggggggtccaagatatgagcgccccct

SEQ ID NO: 713308 - DNA, 434 bp, Homo sapiens
ccgcattgagcctggatgtctccgtgtgtctattaaatctacttttggaggtccaacaggcattacccttaacatcttagacaaggcagcagtgcatcctctcggtaggaccacgtcttacacataggcctcagcaaccaaggtttactcccaacacatcgctaggcagagctggcttctctcaaggccttctacggataagggctctggctcccctaaacatgcctcccctccgagcatcgctgatgtctagcattactcatttccggatccaccactgactccccatactgcttacgacatcagctggaaacggccgctccatcgtaaggcaggaactctgcattgatcttaggatgaggatctgtggcaggaagtaacgggtctactgcagactgctgaggagaaatagttcgagcctatgctgacggctt

SEQ ID NO: 713309 - DNA, 88 bp, Homo sapiens
gcggccgcctactactactactgctcgaattcaagcttctaacgatgtacggggacatgttaacttaagaaacatttgatcagttcct

SEQ ID NO: 713310 - DNA, 188 bp, Homo sapiens
cgacggggattatactatcatagactgttgtttctaaacacgaaactcacggctgggcacagtggaatacgcctgctatcccagcactttgtggaggccgatggcaggcggatcacccgcaggtcagcagctcgtagaccacgcccggccaatcatggccaatatccccgggtcgaaccgggtacctg

SEQ ID NO: 713311 - DNA, 250 bp, Homo sapiens
ctctagagtatcccctctcaaatggcacagaagtacagtacctgcttagactgcatcggcttggctagagctgagggatcataggagtgcttataatggtgtccaactttctttcaaaatttctttagaactctggagcccacgtgccaggttggagcctttgttctcccactttctatctctgctgtccttcaacccgttactttatttctgggcctcgatttcctcttctcgtgtaccgagctccaat

SEQ ID NO: 713312 - DNA, 371 bp, Homo sapiens
cggcatgcggtctgaaggcatcatatcccatcggtcaggacaatgcttatgctgataagttagctaaagaagcaactagcgatccgacttctgtccctcagggtcagtttgtcttcttcgcattgtgcactcccacctactcccgcactgaaactgccacctatcaatctgtccccacacaaggcagatggctcttagaccagggaaaatctgtccttccagcctgacaggcccattctattctgtgatcatttcataacctcttccatgtaggttacaagccgctagcctgcctcttagaacattttcctttattcgtggaaatctgtcctcaaggaaattacttctcagtgttccatctgctattctac

SEQ ID NO: 713313 - DNA, 227 bp, Homo sapiens
agaggcacgtcttgctctgcacccaggcttgtgcaactggtgcgacctagaatcactgcaaactccacttcacaggttcaagggattctcatgcctcagcttccagagcagctgggattacaggcatgtgccagcaagcccggctaattttttttgtattgttagtaaagacggggttttagtatgttcctcaggctggtctcgaactccttacctcaagtgacccg

SEQ ID NO: 713314 - DNA, 378 bp, Homo sapiens
  misc_feature (35)..(35): n is a, c, g, or t
  misc_feature (52)..(52): n is a, c, g, or t
  misc_feature (55)..(55): n is a, c, g, or t
  misc_feature (112)..(113): n is a, c, g, or t
  misc_feature (229)..(229): n is a, c, g, or t
  misc_feature (244)..(244): n is a, c, g, or t
  misc_feature (256)..(256): n is a, c, g, or t
  misc_feature (319)..(319): n is a, c, g, or t
  misc_feature (341)..(341): n is a, c, g, or t
  misc_feature (358)..(358): n is a, c, g, or t
atactcgctgtatccttgaactcctgagctcaggngatcctcctgcctcagnctnccaagtagctaggaccataggcatgtgcacaatgcctggctaattttgaattttttnntttcataaacagggtcttgctatgttggccatgctggtttcaaactcctgggcctcaagctatatttcctcctcagcctaccaaagtgttgggattacaggtgtgagccaccatgncctgccacttagggngttgtgttattnttatctttgattgattgggttttctttggggaaaagtatttaactggataatttatgttgggngattcatatttctaatagttcnggaaatattcatatttncgagtaggaaagttgttttt

SEQ ID NO: 713315 - DNA, 634 bp, Homo sapiens
tgtgtaagggcccaaactgctgcaaacagagtggtgatggcccctaagcttagtgttagagttgggattagggggctatttcctgctagggggtggaaccggatgagtaaaaagatccctgctacaactatagtgcttgagtggagtagggctgaaactgggtgtggggccttctatggctgatggggatttcaggggtggagacctaatggggctgatttgcctgctgctgctaggaggaggcctagtagtggggtgaggcttggattaccgtttagaagggctattggtgagggggcttcctcatgagtttggagtgtacggataaatcatgccaaggcgaggatgaacccgatatcgccgatacggttgtataggattgcttgaatggctgctgtgtgggcatctgcctcgggcgtatcatcaactgtatgaccacagaaggatataatacctacgccctctcagccgatgaacagttggaataggttgtcaccggtacctaaaattcgtatggtaatcaggaagatgagctacgatatttgaagaactgataagtgtgggccccgagtaatatatccagcgagactctatgatggccctgtacgaacaatgctccggttgacattacgga

SEQ ID NO: 713316 - DNA, 410 bp, Homo sapiens
tactttcacagggattcaaaaatggttcaacataagtaaatcaataaacatgatacatcaaatcaacagaataaagaacaaaaatcatattattatctcgacaaatgtagaagaaaatttgataaaattcaacatcccttcatgataaaaactctcacaaaactaggcatagaaagagcatatctgaaaataataaaggccacatacaacaaacccataactaccatcacactgaatagggaaatatctgaaagcctatcctctaagaactggaacaagacaaagttatccaccttcaccattcctattcaatattgtactgaaagtcctagccagagaaatcaggcaagagaaaaaaactaaccggcatccaagttggatgagttagcccgagttagctagtagacttc

SEQ ID NO: 713317 - DNA, 99 bp, Homo sapiens
atcaggccagtttccaaaaacttgaccctcatcaaaaagatgacataaataaaaaggcatttgataagttcaaaaaagcacatggagtggtaccttgag

SEQ ID NO: 713318 - DNA, 274 bp, Homo sapiens
taaattgggggccgcgtcgacgactacaggcgccaccacctcgccaggctaattttttgtatttttagtagagatggggtttcaccgtgttagccaggatggcctcgatctcctgacctcgtgatccgcccgccttggcctcccaaagtgctgggattacaggcgtgaccaccgcgcccggcctattttcttcactttttgcatagtagccaacagagaacctgccacttgatttggagtcatatacgtgatgggttaaatacattgttttagg

SEQ ID NO: 713319 - DNA, 401 bp, Homo sapiens
  misc_feature (19)..(19): n is a, c, g, or t
  misc_feature (62)..(62): n is a, c, g, or t
  misc_feature (111)..(111): n is a, c, g, or t
  misc_feature (125)..(125): n is a, c, g, or t
  misc_feature (130)..(130): n is a, c, g, or t
  misc_feature (139)..(139): n is a, c, g, or t
  misc_feature (149)..(149): n is a, c, g, or t
  misc_feature (324)..(324): n is a, c, g, or t
  misc_feature (385)..(385): n is a, c, g, or t
ctaaggaaccactaatccnactatgaactacaaagcctctatcccaggaggtggccatggcncgcttctgctggcctggatctccccactccaggggtcaggctccattangatttgccccttcncatcncttcctacncaaccactcnaattaatctttctttacctgagaccagttgggagcactggagtgcagggaggagaggggaagggccagtctgggctgccgggttctagtctcctttggcactggatggccacactattaccatgagaagaggggcctgtggggagcctggcaaacttcactggcttcaagaaganattgggagacttcctggccctgtttggtgtaatagatggcaaggattattttattattatntttttttgggttgtat

SEQ ID NO: 713320 - DNA, 109 bp, Homo sapiens
ggtttgtcgcagaaggaagatggcggatcttggaggagcagttgtcttgatgaagagaaggttcggtatagcaggcaaaaattcatcattcatgcccctcctcggagaa

SEQ ID NO: 713321 - DNA, 191 bp, Homo sapiens
atcttagaggatccccaccaagagagaaccctatgtaacgatggactatagcgtatgatgtgtcaatagtcaggctcatcaacatgtaacataatcataccactctggtgtgggatgctgatcattaggtgaggctgtgtcctagtatgtgggaaatacattccacatttctagtgcccatttcaagggta

SEQ ID NO: 713322 - DNA, 435 bp, Homo sapiens
gtgataatgagatcttgtatgtgctagctaagggtgacacagcctgtacacggtgctgtgaggctgctggacaactgagtggaatatggtgttataccaacccaagcaagatggatgagtagagggggttgtccctgggcccaaggctcatgcagacgcaacctattgtggcagggagagtaaggacggaagcagttttgggtggtgatgtcgtggtatgcccaatactcttgcgcatcctcgcttgtgtgccctaggatgtcctctgtactgagtaagagggcaggttcagtcacgcagacctgcttgtgcattcattgactgaagcctcactcagagtggccctttttctgtagctactgtagtcagctgggagtggggatgttgcatctcaaaatagcctgtggatcctgggaacaccgggtggatcctcta

SEQ ID NO: 713323 - DNA, 109 bp, Homo sapiens
gcacgacgggagactgcttgacgtccggacgctcagacccggctgggcaccatggcaaaaccctgtgctgtccacctcctctgtgctgtcccctcctctgtgctgtcca

SEQ ID NO: 713324 - DNA, 951 bp, Homo sapiens
gacttccggcgtagccatggcggctaacgctactaccaacccgtcgcagctgctgccgtcagagcttgtggacaacatgtctaggatcaagaattcacatcgtgatgaatgagtgataaggaaattgttggtactctatctaggatttgatgactgttgtcgaagtatggatactggaaggatgtcattgagttagaaagtcacatccaagtaaggaatgaaggattactaaattagatcagattttgctaaatggtaataagtataacaatgctgtttcctggaggacgagaggacctgaagtgtgaatgagttatccttgagttactactagattatgtgtgggcgttataatgaacccagcaccagatggacattgttgtttgtccgcatctttctatactgtttaatatcaccataaagctatagtttgcccgattaagagggaaagtgctttgaagatgtgttacccattttttgtacacgttaattcatgattatcctggacaaaaacgaagaaaagagcttcttctttgcagatgaacaataacaggtgtccggttaactgtcatttgttattctactgcagtagccagtggcacacaaaaggttgggagttattttcggcactttacttttgctgtcattatatggcttattgggtgtcatttacgtgaccatttgattctcaaccaaagtgttccaagcaaatgatgaactttgcttgaccggtggctctcaccacggggaatgtccttgaacacccactgaaatgccggctttgtaacaacaaaaaaagaacaaaaattgcggcggcgccccaaaaaaaccactgggccgggccacaaaaacgccttatccgcaaacgctgaagcggtcacaaaaacgggcggcgcaacaaatgtttttcaacgaaacagccgcggaaaatccacttatacaatagaacaa

SEQ ID NO: 713325 - DNA, 240 bp, Homo sapiens
ctaattggttcttcgatgacgccagccacgtctgttggtctataccacagctcatggcaatgccagatccttgacccactgaacaaggccagggattgaatctgtaacctcatagttcctagttggattcacttcctccgtgccatgacaggaactccaagcttgattttttcagtactgaaaattgtttttttttttttttttgggaaaggggggacccgccatcaaaaaaccatttgg

SEQ ID NO: 713326 - DNA, 753 bp, Homo sapiens
tgtggtgcacgcattgtgtgctccaactccctcaggcctgtgttgccgcactctgctgctatgagcttcctcaaaagtttcccgcctgctgtgccagcggaggggctccgtgctgggcagccgcaagacattgaggctgtcgttgaaacggagaaggtgctcgcgcacgtggctaccctttatacatcgctgagagccgcctgtctttgttaaagaatgcctctggatagggatctcacttgaataccccaaccattagtataacattgcatttaatcccaggggacccgaagttgacctgtctaagggaagaggcattgtggtattgctgtatgggtgaactgccaaaatttggaggaaggacttcaaaaaagaaacctgttggccgaatgaaagaaagaaggaaggacaggtgcttgcatggatgtggaacccttattgagtgaatttagcattgtggtggcctagtgataaactcagggtttgggaggcaatgttcaactgtgcaatgtgcgaatggcatggccttgcattccaagatcctggagcgatgcggatccagattgactaacgatggacacagattatgatgtgcacagccatgaacaaggaccggggaacactccttacatttaacacttatgaagaaggttatcccattacaagagaggcaagccacactgagagactacagaatgctctcagtctgtaccagcagataaatggtgggtcggacagaagatcacaagaata

SEQ ID NO: 713327 - DNA, 299 bp, Homo sapiens
ttggtcatggctgattcttgagggtacaaggacttgtttcctgcacttcgtgggggcaagacaggtgttttacttaaggtcaggagtttgggaatagcctggccaacatggcaaaaccttgtctctactaaaaatacaaaaattagccgggcatggtggttcgtgcctgtaattgcagctactcaggagggtgaggcaggagaattgcttgaatctgggaggtgaaggttgcagtgagctgagattcaaccactgcactccagcctgggcaacaagagtgagactctgtcaaaaaaaaa

SEQ ID NO: 713328 - DNA, 275 bp, Homo sapiens
gattacacagaggctttgtgaagggaagactaaaggaagagatgtagaaagaggggaaagggccgggcgcggtggctcacgcctgtaatcccagcaccttgggaggccaaggcaagtggatcacgaggtcaggagagtgagaccatcctggctaacacagtgaaaccccgtctctactaaaaatacaaaaaaacttagctgggcgtggtggcaggtgcctgtagtcccagctactggggaggctgaggcaggagaatggcgtgaacccggcaggt

SEQ ID NO: 713329 - DNA, 1062 bp, Homo sapiens
  misc_feature (833)..(833): n is a, c, g, or t
gctgcacctgatggaaaagatatatgacggcttcatgacattcctaaactatcttagtgcttatggccacagtctagcgttctacggtggcacgtccctcttcgtcgaatacatcagtgatggaaggatggatagacaaaaacaactaagcaagctagggcacaactcacaaaaaccccacttccattgatcttccctacagggcgttgacattgtggcgacactgcttagtaagtcacccgacagcccacagtgtaggggaagctctacagagtagcccaacggcccgcgaagtctcgtgttttatgtaaaagaactagccagttacgcattactacagtggcaacactgtcatctgcgcattaacttttcctaactcccactctaggctatagccctgcatgtctacctacttttaggccaattatgcgatgaaagatgaaaagaaattgacacataggaaagattgcgcacgcaatgagggttgcccaaacttgacaaaataagtaatgtgaagcatggcgagtctagtatgtgcactaagtttgccagagtggacaaagtattctcatcaaataactctcatttgatgttccatgatcaagaaagaatccctatctctatttgacaagtaattcaaagaggccaaataactgtgtaaacaaggacaaaggtaacttgtcaacagtcataactagtaaattatgagagccttgttctcataaacccagggtctttcttactacaaaatcgctgtgaatgtttggaaaataaccaaaatgtctctccaatgtctgcataaactgtgagagccaagtcaacagctttatcangaattactctctgacagcattaacaagcctggagaacagagagccgatcagatttacccaggggttaaaagactcggactttcccccttggaaacactgctctaattttaaacggggtttctgaggggacccagggtgaccccgaatctcgggaaggttcaaggctggtcacggcattcaaattagctacaaagcagggaacggaagaggacaggcaggaaaaacctaa

SEQ ID NO: 713330 - DNA, 954 bp, Homo sapiens
taatgaggaaatcttgggcattgactggatcctgactttgcaaatggcaaatacgattgcctgtctcgaggaaacttgattgatctttatggaaaccaaggtctgcaccccaccaggacctacaccatcagtcaactcctgtccagaccaaccttcccaacataaaaagggagctcacagagatctgaagcacgagacactggacaaaagagaggcagaaaacggacaatcacaaacatgaccgacacagaagaaccaagaaatcaccaaaaatgaccgcataaaagaacaaggaactaagaacacccaagaaccaatgaaaccagacatgcacaaggaacaaggaaaaccaacttacaaaagcatccgaggaatatataccgaacagtagcacacgagaacagcaacgacgacaacaagaaactagaaaaacagacagacacgaaacatggaccacgacaaaccggacaaaagaagccacagaaaaacaggaaatagacactgcaggaccgaagaacaaagaaaaacaccttaaaccaataccacgggatacacaagcaactccagacaaagagagaaacagaacaaacaaggaagaaacccgaaacaaagcaaaacagcagacaaaaaacaaccatacaaacacatgcagacacatacacctgacagacaaccatccgacaacacagcaggaacaaacaccacaacaacaaagcatccagaaaatgagaactgagaacaacacagaaaaatagagaacacaaaaaaaagggaccaacactgaaaacaacaagaaagaaaaaaccataaaccgagagagacagaccacccatacgcaaagcaccgaaaacaaaaaaaaccgaaagggaagacagaagagaggagcagagagaaagagaacggcacccgagaaagagcagtaaagaagggaagaatcaaagaagaagagaggag

SEQ ID NO: 713331 - DNA, 149 bp, Homo sapiens
acttctagaggatcccaggattcgtagatcactgacagcttgcacttgtgtgcctggaaaagctgcagacactcaatgcagccagaaggggggctgtaccctgactctgactgaaccacggagctcaccctggacagtatcactccgtg

SEQ ID NO: 713332 - DNA, 551 bp, Homo sapiens
  misc_feature (10)..(10): n is a, c, g, or t
  misc_feature (60)..(60): n is a, c, g, or t
  misc_feature (149)..(149): n is a, c, g, or t
  misc_feature (176)..(176): n is a, c, g, or t
ggtccgacgncctacctgcctcgctgtcagccaccacgcagcatgaggactaatactaantacttacctcctcgaccgccacgtgctctttcttctcctcctgctggatgatgtggtgatcgagagtacgacgacgtgtagttggtcgnccacactgctgcagcagctgtcgtcgnctcgcgcgcgtcgcgacgtacgtcgtcgacgacgcgtctactccccccacccgcggccgccgcccccgtgtcgagatacactactgctcctgtggtgtcgtcgtctcctctgctctctctcgcccccctctcgtcttctggtctactcgcgcgcgagagtatactctgtagtagagagagaggtgtgtgtcgtctgtgtcttgtctgtgtgtcagagcacactccctcgtccgcgcgcgcgtcgcccactccctcgtgaggatgctccccacgcgctcttttttgtggggctctttctttgttgtttgttgtctgttggttttctcttatatatatatatataaagagagaagaaaatactttccaccaaaaaca

SEQ ID NO: 713333 - DNA, 786 bp, Homo sapiens
  misc_feature (23)..(23): n is a, c, g, or t
  misc_feature (61)..(61): n is a, c, g, or t
  misc_feature (67)..(67): n is a, c, g, or t
  misc_feature (74)..(74): n is a, c, g, or t
  misc_feature (84)..(84): n is a, c, g, or t
  misc_feature (94)..(95): n is a, c, g, or t
  misc_feature (97)..(97): n is a, c, g, or t
  misc_feature (99)..(99): n is a, c, g, or t
  misc_feature (105)..(105): n is a, c, g, or t
  misc_feature (108)..(108): n is a, c, g, or t
  misc_feature (110)..(110): n is a, c, g, or t
  misc_feature (112)..(113): n is a, c, g, or t
  misc_feature (122)..(123): n is a, c, g, or t
  misc_feature (125)..(126): n is a, c, g, or t
  misc_feature (129)..(129): n is a, c, g, or t
  misc_feature (137)..(138): n is a, c, g, or t
  misc_feature (140)..(140): n is a, c, g, or t
  misc_feature (150)..(150): n is a, c, g, or t
  misc_feature (154)..(154): n is a, c, g, or t
  misc_feature (163)..(164): n is a, c, g, or t
  misc_feature (173)..(174): n is a, c, g, or t
  misc_feature (179)..(179): n is a, c, g, or t
  misc_feature (188)..(188): n is a, c, g, or t
  misc_feature (197)..(197): n is a, c, g, or t
  misc_feature (201)..(202): n is a, c, g, or t
  misc_feature (205)..(205): n is a, c, g, or t
  misc_feature (209)..(210): n is a, c, g, or t
  misc_feature (213)..(213): n is a, c, g, or t
  misc_feature (215)..(216): n is a, c, g, or t
  misc_feature (221)..(221): n is a, c, g, or t
  misc_feature (223)..(223): n is a, c, g, or t
  misc_feature (231)..(231): n is a, c, g, or t
  misc_feature (234)..(234): n is a, c, g, or t
  misc_feature (237)..(237): n is a, c, g, or t
  misc_feature (239)..(240): n is a, c, g, or t
  misc_feature (251)..(251): n is a, c, g, or t
  misc_feature (254)..(254): n is a, c, g, or t
  misc_feature (263)..(263): n is a, c, g, or t
  misc_feature (285)..(285): n is a, c, g, or t
  misc_feature (300)..(300): n is a, c, g, or t
  misc_feature (312)..(312): n is a, c, g, or t
  misc_feature (317)..(317): n is a, c, g, or t
  misc_feature (325)..(325): n is a, c, g, or t
  misc_feature (342)..(342): n is a, c, g, or t
  misc_feature (347)..(347): n is a, c, g, or t
  misc_feature (375)..(376): n is a, c, g, or t
  misc_feature (383)..(383): n is a, c, g, or t
  misc_feature (388)..(388): n is a, c, g, or t
  misc_feature (391)..(391): n is a, c, g, or t
  misc_feature (393)..(393): n is a, c, g, or t
  misc_feature (395)..(395): n is a, c, g, or t
  misc_feature (433)..(433): n is a, c, g, or t
  misc_feature (441)..(441): n is a, c, g, or t
  misc_feature (443)..(443): n is a, c, g, or t
  misc_feature (456)..(456): n is a, c, g, or t
  misc_feature (499)..(499): n is a, c, g, or t
  misc_feature (517)..(517): n is a, c, g, or t
  misc_feature (541)..(541): n is a, c, g, or t
  misc_feature (580)..(580): n is a, c, g, or t
  misc_feature (584)..(584): n is a, c, g, or t
  misc_feature (586)..(586): n is a, c, g, or t
  misc_feature (589)..(589): n is a, c, g, or t
  misc_feature (596)..(599): n is a, c, g, or t
  misc_feature (609)..(610): n is a, c, g, or t
  misc_feature (612)..(612): n is a, c, g, or t
  misc_feature (681)..(681): n is a, c, g, or t
  misc_feature (692)..(692): n is a, c, g, or t
  misc_feature (694)..(694): n is a, c, g, or t
  misc_feature (723)..(723): n is a, c, g, or t
  misc_feature (769)..(769): n is a, c, g, or t
ttctcatattactcatggtaggntgagaatgcattaaaaagttaaaataaaaaaaaaatanagaatnaaattgnaaaagcagtnataaacacanntntncaaaanatnantnntataaatanntnnatnactaaatnntntagccacatnttanccatgcatnnaataaaaanntattnctatttgtnttttataanatannttnatannttngnntaatnantatagatnaanaantnnaattttttatntangaaaaagtntatcgcgatcgtcagaaaagangtgcgataaatcgangcatggaaggtngaaangtttcgancattaaacgtcgtttgngaacngtatgtttgcatgcgagcttgcgcaganntgaaaancatgntcncntnttcaccaaggattctgtgcagcatttggtgactctgtnacttactngngttttctgcatgnaacacacataactggttcaggaccacggatagatagtcttctncacagggcattctttttncttcaggatgtttacaacatttgntgcccacttttcctaggtttcttgagacctctacaagantttnanttnacacttnnnntactttcttnntntaacgaactaatagcgcattctggaatttgtactctccaatcttctcaaaaatctcacaattttttttnattaaattctnantctcttccacaatatttttaaattcatcnaacactttttcatatcattcattattatcttcatcttcacatcacntctctatatttttttca

SEQ ID NO: 713334 - DNA, 806 bp, Homo sapiens
  misc_feature (40)..(40): n is a, c, g, or t
  misc_feature (68)..(68): n is a, c, g, or t
  misc_feature (79)..(79): n is a, c, g, or t
  misc_feature (83)..(83): n is a, c, g, or t
  misc_feature (265)..(265): n is a, c, g, or t
  misc_feature (269)..(269): n is a, c, g, or t
  misc_feature (296)..(296): n is a, c, g, or t
  misc_feature (330)..(330): n is a, c, g, or t
  misc_feature (429)..(429): n is a, c, g, or t
  misc_feature (435)..(435): n is a, c, g, or t
  misc_feature (441)..(441): n is a, c, g, or t
  misc_feature (517)..(517): n is a, c, g, or t
  misc_feature (595)..(595): n is a, c, g, or t
  misc_feature (606)..(606): n is a, c, g, or t
  misc_feature (612)..(612): n is a, c, g, or t
  misc_feature (658)..(658): n is a, c, g, or t
  misc_feature (666)..(666): n is a, c, g, or t
  misc_feature (676)..(676): n is a, c, g, or t
  misc_feature (679)..(679): n is a, c, g, or t
  misc_feature (721)..(721): n is a, c, g, or t
  misc_feature (780)..(780): n is a, c, g, or t
tatttctaaacagaatgggccgactcagtcacagtaactntcgacctccatagtagagcgacccacanagacagacctnattnttttcccataaccaggggtgaaaaatatacaacttgtttctgaaccaaaaccacaatttctgcagtctaaaatgtttcactgccaaaatggccctggtagaaattatgttgttttttttcttctttaaaaaaaaaaaattaaaaaaatttcctaagacacttaatcctcaatctggaatgtngaanctgagcccaaagcagcccagttaaccnaaaaaataaagaaaaaattcccatcacctgtttnagtggggcctgagaggagagaggtggtgtggggaaccctgccttggtatggagagtgagggcccccggacccagaccgagaccgtgagtggccatagcnggggcntctctnaggataaactcggatgtgggaagtttcaccctcatgagaccggaattgggtgtcacccagtttacgcggggcatancccatgtctccttttctgagacactcgaccatccccactccatccttctgcacaccagcttaacagaaatccccagcntctagcatgtnaccctncaggtcctgccagccgcctgacggaggaagtcctgaaacaagaccncggaaatnagacctcctngtnggaggcccatccctcccaccacggggccacccaccccgaccnccataagtcctggggaactccacaagaagccgaaattggccataaatcataaccatttnttccataaatagcatcctctgcatct

SEQ ID NO: 713335 - DNA, 655 bp, Homo sapiens
  misc_feature (361)..(362): n is a, c, g, or t
  misc_feature (534)..(534): n is a, c, g, or t
  misc_feature (560)..(560): n is a, c, g, or t
  misc_feature (615)..(615): n is a, c, g, or t
  misc_feature (618)..(619): n is a, c, g, or t
  misc_feature (637)..(637): n is a, c, g, or t
ggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggagggtcaaaatcaaacggaaaaaagggcttacggaacacgggtgtacacgtgtgtgtctcatattatatccgcgacggcggactactctcctcgaggcctgctggacatcgagttgatgaacactgcctgagcaagggtggtcaacatcgtccctgtcatnnccaaggggaacactcaccctggaggagagggtccacttcaaacagggatcaccgcagacctgctgtccaacggcatcgacgtgtacccccagaaggaatttgatgaggactcggaggaccggctggtgaacgagaagttccgggagatgatcccatttgctgtggtgggcangtgaccacgagtaccaggtcaacggncaagaggatcttgggaggaagaccaagtgggttgaaacaccaacactgtgagttnccnnactgcgccttctcatcangcgcccatcgtgcgcttc

SEQ ID NO: 713336 - DNA, 317 bp, Homo sapiens
  misc_feature (26)..(26): n is a, c, g, or t
  misc_feature (56)..(56): n is a, c, g, or t
  misc_feature (74)..(74): n is a, c, g, or t
  misc_feature (82)..(85): n is a, c, g, or t
  misc_feature (94)..(96): n is a, c, g, or t
  misc_feature (130)..(131): n is a, c, g, or t
  misc_feature (133)..(133): n is a, c, g, or t
  misc_feature (156)..(156): n is a, c, g, or t
  misc_feature (158)..(159): n is a, c, g, or t
atcaagcgacatgtagagttcataanttctggccaaatggtcatacctcaaacctnatcagcagtaaggctctntacttgcnnnnaaaatatgnnngctggggaatttggaaatgatatataatatatannantatatatataatagattaatatntnntatatataatacatatataatatatatgtaatagatatacaatatataatatataatagatatataatattatatataatagatatataactttccatgtgattttcctcttaatttttttctagctgatccatatgaattcctcttattaagaaaaa

SEQ ID NO: 713337 - DNA, 302 bp, Homo sapiens
  misc_feature (59)..(59): n is a, c, g, or t
  misc_feature (134)..(134): n is a, c, g, or t
tggaaacgggatgatttaggcctctggctgcagtgcacgcaagttaacaatcgtttttntttagactgcagatggaatatttaatcctttccagccaggcatttgcatctttgtaccccatctgtagagctatngtctgccttaaatcttttacctctacaaccattaccttagttgggtggttctagagatgggaggagagcgctgagcctgatatgtttgggcacagtgttgggtcccacatgttcttccagactctgggtctggatttctttattgtccttagctgatgctctagctaa

SEQ ID NO: 713338 - DNA, 733 bp, Homo sapiens
  misc_feature (565)..(565): n is a, c, g, or t
  misc_feature (606)..(606): n is a, c, g, or t
ggaaaggttcctggagaaaaatatatccacgctaaggcctgtaggacaaccagatgtcagctattgttaggcacagaggtaaggggagaaagaaaaagcactgtagatgcgttgtagacatagaaactccgcaagaggtgagggaggacctggcatattctaggggttctggtgcaagagtatccatgtgtgaaaaggaagtagaagacataaggctgaaaaagtaagcagaccccagaaggtgaggcactcatgaaccatgttaaagagttaaccactgaacagtggaacgggaagcctgtgaaggttttgctttgtgagatttacacttcaggatgataaccctgcttcctacgtgaaccaaaggggcagtggccaggaaggctgaaagcctttagacaaatgcaggaaaaaggtggcggtgaactgagctagcgtaacagtggtggcagtgaaaagaagcagacagattcaaagattttcaagaagggaacatggacagttcttagagttggatgactcgtgtggcccaagaaaagagaagactctaaatgatacatgtggntgggtcattgtaagttacttaactacttagttatctttggntcaagttttctctaatcacttgacaagaaagaaagaaaagtccctttaaattaacagtgcattaagggattttatttagcaagggtcataatttgcaaaattggagaaattacagtttattctaacc

SEQ ID NO: 713339 - DNA, 240 bp, Homo sapiens
  misc_feature (9)..(9): n is a, c, g, or t
  misc_feature (92)..(92): n is a, c, g, or t
  misc_feature (170)..(170): n is a, c, g, or t
  misc_feature (221)..(221): n is a, c, g, or t
tgtgaattnttaatggcaacaaaattttatttattttatttttaagagggaatctcactccagcctgggaaacagagagagactttgtctcnggaaaaaaaaaaaaaaaaagccaggcatgcacttgtagtccaagctactcaggagctgaggccagaggatcacttgancctaggagtttgaggttgcagtgaactatgatcacggcacttgcactctancctgggcaacagagcaaga

SEQ ID NO: 713340 - DNA, 293 bp, Homo sapiens
cagctcctccttggaagatgctgcagtgctgtttccagaatgtggctggctgctaaaataccctagtgtccctgtaattggtgccacgagtctgtggacacagggtgggcggggctggaataggacgtggaagagagggatgattctgaagaaccgtgagagggggggtttccaggtctcagtgcagtagtgcgataactgtatcctggagactgtgtaggatgtcctctgaagggggaggaactctgctgaaggaggcttcgtgattctgtccgaggactacttgtgttgtc

SEQ ID NO: 713341 - DNA, 171 bp, Homo sapiens
cctgcgcccgtgaaagacaggttcgtcatttcaagagatgattcaaagaaaacagtgagcctgcaaatggacagtctgaaaatcgaagacacggccgtgtatttttgtgccacagagttattgccgggtcttgaccactggggccagggagccctggtcaccgtcgcctca

SEQ ID NO: 713342 - DNA, 104 bp, Homo sapiens
ctcaggtctctcccaatgtccttcaggccttgctccaaagctctgtccgggtgaagctcccctcccatcctccttaaagcttcagcctctaccttgggacactt

SEQ ID NO: 713343 - DNA, 81 bp, Homo sapiens
  misc_feature (1)..(1): n is a, c, g, or t
  misc_feature (25)..(25): n is a, c, g, or t
  misc_feature (68)..(68): n is a, c, g, or t
nattgttggttgggcgatcccgaangcatcttgcttcacgggtcaaaaggttaacccatctttgtggngggggaatggttt

SEQ ID NO: 713344 - DNA, 840 bp, Homo sapiens
  misc_feature (335)..(335): n is a, c, g, or t
gggcattcctcccccttgggggcccaaccaacggggttccctggaccacccggtgccttgtggccccgcctattttccgcaagcccctgtcaatttctcctatgggagacccccgcccccctctggctgtgcccggcgccccaaggccacgtgttcagatcgttcttggccgttggctcgaccccgtctgcttcggtgctttgatgtctacccccccgcttgtctcctcgcgcccagatagtggaatgttcctccggcctttgtctccccgtggattcacgcgcgtgcaactatgcacgctcgtacgaaatagtccgcctccctgccgtcttgtnggtggataagactccacacactctgtctttctttagaacactactagatgggcgcactgacctcccccatttggttgttttctttgatggacaccgctcataattctgtctccaccctctcctcagaatatgtgcgggcggataacactgtttcaccctccctcaagcctgcgcgtcaatctgagagaagttaagacagagtcacacacgtcgtcagtcgcgatactagtctgcgagctgtcttgacaaaaggacacgccgcctctctcactgaaacaatatcgtttccacactctgtacatcattcggtacataaatgatgcagttttctctttagattcgggaaataatactctatattttcgacgagcgtacgaaactccttgtcttaaccagtgttacagacaccgctgtcatgacaaccacactctttccccacaccacccaccccccggcctcacgatgaataaccaaacctaacaatccacacggactcatcataaca

SEQ ID NO: 713345 - DNA, 966 bp, Homo sapiens
  misc_feature (23)..(23): n is a, c, g, or t
ggatccttctggcgaactctatngatgggcccaagcgtaaccaggctcttctgattggccggtgtacttcagtttccgtccaaggtccgcctcctacctccttctgcttcggtgcgtttgcttctgaggatctccagtgtcacaacaaacacatgccagccctgttttacagggagccctggaggagttgggatagaggccacattgactgagggtagttgccagggtcctgcagttatacacaaagtccttaggataagaccatggccttgagagcatgtggcttgatcatcttccgaagatgcctcattcccaaagtggacaacaatgcaattgagtttttactgctgcaggcatcagatggcattcatcactggactcctcccaaaggccatgtggaaccaggagaggatgacttggaaacagccctgagggagacccaagaggaagcaggcatagaagcaggccagctgaccattattgaggggttcaaaagggaactcaattatgtggccaggaacaagcctaaaacagtcatttactggctggcggaggtgaaggactatgacgtggagatccgcctctcccatgagcaccaagcctaccgctggctggggctggaggaggcctgccagttggctcagttcaaggagatgaaggcagcgctccaagaaggacaccagtttctttgctccatagaggcctgagctgactggagcagagtcatttgcttcagcaggatccttgtgggccttctaagatgaagccaccctcaggtccagggaaggttgtgctggtatttggctcatgacagccaagagcagatttgtgaaatcggctcaactcccaggtgagagcaagcaaaaatcttggctgggtggaaaggaaggcaaaagagtaaaaattaaaaaggccaggcccagtaagtgtaccttgtactttataaataaacctcaagcagctcaa

SEQ ID NO: 713346 - DNA, 246 bp, Homo sapiens
  misc_feature (3)..(3): n is a, c, g, or t
  misc_feature (7)..(7): n is a, c, g, or t
  misc_feature (35)..(35): n is a, c, g, or t
  misc_feature (49)..(49): n is a, c, g, or t
  misc_feature (53)..(53): n is a, c, g, or t
  misc_feature (65)..(65): n is a, c, g, or t
  misc_feature (75)..(75): n is a, c, g, or t
  misc_feature (99)..(99): n is a, c, g, or t
  misc_feature (111)..(111): n is a, c, g, or t
  misc_feature (148)..(148): n is a, c, g, or t
  misc_feature (151)..(151): n is a, c, g, or t
  misc_feature (173)..(173): n is a, c, g, or t
  misc_feature (178)..(178): n is a, c, g, or t
  misc_feature (183)..(183): n is a, c, g, or t
  misc_feature (187)..(187): n is a, c, g, or t
  misc_feature (196)..(196): n is a, c, g, or t
  misc_feature (217)..(217): n is a, c, g, or t
  misc_feature (230)..(230): n is a, c, g, or t
aancgtnagaagttttaaacagctttcacacaaantagatgcaactgtncccntgtctgagtacntatttaaaanaaaggtaaagattggcctgttagnaaaagcataatntgagcttggattactggatttttttttttttttaaanacncctggagaggacatttgaaaanactgntcttncccncgaaccctnatttggttccattatgtaaanatttcaaatattnaaaatgtatatatttg

SEQ ID NO: 713347 - DNA, 374 bp, Homo sapiens
cgatcttaacacggcgacgtccgggtaggaccctgaggattatgttgctcgtataaggaggagctggatggtcacggcacgtggtcctggcctggtggtgtgaccgggctgctgcttggggagttgcagatgacggctcgccctccacgcgggcggggtgtggcggcgattccccaaaaaggcacagcaactcgtcctcctcgctcagtgcacggcgggggctgatggtcagttgcacctccccctgtgcccgctggttcatgtcctgttggctgggcgctggttgacgggcacgcaaggctttgcttcggatccacagcccagtggtggcttccctcgggcccgggggacacttcggccttccggggtgcatc

SEQ ID NO: 713348 - DNA, 497 bp, Homo sapiens
ggggcctggaaggatcaagaatggtgagaatggaggatgaggccaggcgcagtggctcacacctgtaattccagcactttgggaggccgaggcgggcgaatcacgaggtcaggagtttgagaacagcctggccaacatggtgaaaccctgtctctactaaaaacacaaaaaattagttgggcgggcgcctgcaatcccagctactcgggaggctgacgcaagagaatcgctggaacctgggaggcagaggttgcagtgagccgagatcaagccaccgcactccagcctggggggaaagagtgagactccatctcaaaaaaaaaaaagatgggaggatggccaggcttgggggctcacatcagtcatcccagaacttggggaggccgagacagggggatggcttgaggccaggagttcaagatcagcctgaacaacatggcaagacctcatctctaccaaaaactttaaaacttacccaggcatggtggcatgcaccc

SEQ ID NO: 713349 - DNA, 200 bp, Homo sapiens
attctgtggccgacggacgacgacgacgacagacgacgacgacgacgacgacgacgacgacgacgacacgacgacgacacgacacacgacgacgaacacgactggcgaccacaaccacgacaaacaccaaataacacgacgcgacacagacataaccagagagtcgaccagcaacacagcgacacacgataataggacac

SEQ ID NO: 713350 - DNA, 1059 bp, Homo sapiens
  misc_feature (23)..(23): n is a, c, g, or t
ggatccttctggcgaactctatngatgggcccaagcgtaaccaggctcttctgattggccggtgtacttcagtttccgtccaaggtccgcctcctacctccttctgcttcggtgcgtttgcttctgaggatctccagtgtcacaacaaacacatgccagccctgttttacagggagccctggaggagttgggatagaggccacattgactgagggtagttgccagggtcctgcagttatacacaaagtccttaggataagaccatggccttgagagcatgtggcttgatcatcttccgaagatgcctcattcccaaagtggacaacaatgcaattgagtttttactgctgcaggcatcagatggcattcatcactggactcctcccaaaggccatgtggaaccaggagaggatgacttggaaacagccctgagggagacccaagaggaagcaggcatagaagcaggccagctgaccattattgaggggttcaaaagggaactcaattatgtggccaggaacaagcctaaaacagtcatttactggctggcggaggtgaaggactatgacgtggagatccgcctctcccatgagcaccaagcctaccgctggctggggctggaggaggcctgccagttggctcagttcaaggagatgaaggcagcgctccaagaaggacaccagtttctttgctccatagaggcctgagctgactggagcagagtcatttgcttcagcaggatccttgtgggccttctaagatgaagccaccctcaggtccagggaaggttgtgctggtatttggctcatgacagccaagagcagatttgtgaaatcggctcaactcccaggtgagagcaagcaaaaatcttggctgggtggaaaggaaggcaaaagagtaaaaattaaaaaggccaggcccagtaagtgtaccttgtactttataaataaacctcaagcagctcaaaaaaaatatacacacgaaaaaaaaaaccgggttcttggggggaaaaaaaaaggcaggtattctccacaccttttaagaggagggccacgggaa

SEQ ID NO: 713351 - DNA, 1139 bp, Homo sapiens
ggagcctttctgtggctgcacttggggacccttgtggaccatggggtgtggctagggaacccctaagtttcagactaaaggaaagatcctgggtgatgctggctttttgcttctttcttctgccctcccacctcagcttgtaagcggggatgtgtgtatgtctggggagaggaggtgtagggtgcgtatgtccatggggggaggggcttgtgtgtgcagtcattgttccaaggtgtttccagtagcgacttctgtccccctatccccaccctggtccccactttgcgcccccgggctccctgcctttggtgcacacaggatcctgcccgccccccttgccagagccagagaagggggttggggccattccaaggaggcaggactgaaaccctcaccagggttactccccaacatccttttgcctgagtcaccctctaagcgctttaaccacgggcagctgcctgttccccagacagtttttggtggggggggtccagggtcccccttgctggtacctccctcacccctctttttgtttttccatctgtgcctgttccttccacagcccaggcacacagaagcccaccttcttccccttaggaggagggatagtcaacacccctgctgtctctctgtcactcacacactgatttatggggtctgagctgggctgttcctgcaggatggacaggacccagcgccctcttctccccacaggctgtaaatagacttccaatcaccaggccagcccccacacaccctcactcattccagggaagcccaggtaggtggtgaacccgctgccacgtctatcagtcctcttgttttatgcaaagatttactgtaaagtagatttctttccctccctcccccattcttttattgtaaatattgtctctaaatgtgtaacatattataaagaatttataaggatttttaaagatgttttgctcatttacaaaagtgttgtaacagtgttggacaaagccttccaccccatgtccgcatggctcctttcactgtgtccttgacacacctctctggcaacaactaaaatttcctgcttctgaaaagtcctgtcttaaaagtacagtctatatcttggaaataaatagctttcctcaaggcatgaaaaaaaa

SEQ ID NO: 713352 - DNA, 993 bp, Homo sapiens
  misc_feature (23)..(23): n is a, c, g, or t
  misc_feature (988)..(988): n is a, c, g, or t
  misc_feature (990)..(990): n is a, c, g, or t
ggatccttctggcgaactctatngatgggcccaagcgtaaccaggctcttctgattggccggtgtacttcagtttccgtccaaggtccgcctcctacctccttctgcttcggtgcgtttgcttctgaggatctccagtgtcacaacaaacacatgccagccctgttttacagggagccctggaggagttgggatagaggccacattgactgagggtagttgccagggtcctgcagttatacacaaagtccttaggataagaccatggccttgagagcatgtggcttgatcatcttccgaagatgcctcattcccaaagtggacaacaatgcaattgagtttttactgctgcaggcatcagatggcattcatcactggactcctcccaaaggccatgtggaaccaggagaggatgacttggaaacagccctgagggagacccaagaggaagcaggcatagaagcaggccagctgaccattattgaggggttcaaaagggaactcaattatgtggccaggaacaagcctaaaacagtcatttactggctggcggaggtgaaggactatgacgtggagatccgcctctcccatgagcaccaagcctaccgctggctggggctggaggaggcctgccagttggctcagttcaaggagatgaaggcagcgctccaagaaggacaccagtttctttgctccatagaggcctgagctgactggagcagagtcatttgcttcagcaggatccttgtgggccttctaagatgaagccaccctcaggtccagggaaggttgtgctggtatttggctcatgacagccaagagcagatttgtgaaatcggctcaactcccaggtgagagcaagcaaaaatcttggctgggtggaaaggaaggcaaaagagtaaaaattaaaaaggccaggcccagtaagtgtaccttgtactttataaataaacctcaagcagctcaaggttgtccttctaaaaaaaatncnaaa

SEQ ID NO: 713353 - DNA, 129 bp, Homo sapiens
  misc_feature (119)..(119): n is a, c, g, or t
agcatgtgagactccttgtaattttggtggctgagtatacaacggagctggcttcacactgatcctgctggaagaggtccacacttcctgatagatgtatatgatttcctggtgatacncagtgcagcc

SEQ ID NO: 713354 - DNA, 898 bp, Homo sapiens
  misc_feature (731)..(731): n is a, c, g, or t
ccttaggggggaggaccccgggaatcggggccctggtgggagggggcgggggcggcggggccccccaggacccgcgcccggggcgcgccccgtccagagcccgcactcgctcacgtagattttcttttgatatatctcctatagcccatcctccctgcgcccaccctactccgcagagcgtgccgctggccagcaatcgccgggcgggggggctctgcgtccgcctccctccgtacacgcacactcacacccggcaagctcgatctatggggcccgcattcgttcccgcgcgtcgcagtcaaagctcgcgctcatcccctccgacacctctcaggaccgcccgttgctgaccggggcggcgcggcgccctacaacgggagaaacgaagaatgctggagattatagattcaacacgactgctagccccacgcacgtaccaccatcattcacgacctctgcggctacccccccctccccccacacccccctccaccgatactattcctcgctccatcgcctctccgcactccctcgccgccaccggacgtgctcgggcgtcgccagcggacggctgtgagagacatccatactctccctctcgctaacctatacacctctcgtgtgctcaccgtgctagtcacaagctgaagtgcgcgcgttgtaaccgtcgcgcgtaggatgtcttccgtgctagagagtagacgcgcgcatcgcgcccagcatgacggccnaggcctgcattcgatgtagtggcactcggcagcgttctgaaagggtcggccctgctataccctattcttagttaataatatctacctcagattactcttatctcatttctttgagacatcccccgcttacgttcgaatctcacactccacccccatctcactcgtct

SEQ ID NO: 713355 - DNA, 888 bp, Homo sapiens
  misc_feature (29)..(29): n is a, c, g, or t
  misc_feature (58)..(58): n is a, c, g, or t
ggaagcagggagagagaactggccagggnataaaaagggcccacaagagaccggctcnaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaa

SEQ ID NO: 713356 - DNA, 1008 bp, Homo sapiens
  misc_feature (23)..(23): n is a, c, g, or t
ggatccttctggcgaactctatngatgggcccaagcgtaaccaggctcttctgattggccggtgtacttcagtttccgtccaaggtccgcctcctacctccttctgcttcggttctacagtgatggggtgcttccttttggcttctggaatgggtgcgtttgcttctgaggatctccagtgtcacaacaaacacatgccagccctgttttacagggagccctggaggagttgggatagaggccacattgactgagggtagttgccagggtcctgcagttatacacaaagtccttaggataagaccatggccttgagagcatgtggcttgatcatcttccgaagatgcctcattcccaaagtggacaacaatgcaattgagtttttactgctgcaggcatcagatggcattcatcactggactcctcccaaaggccatgtggaaccaggagaggatgacttggaaacagccctgagggagacccaagaggaagcaggcatagaagcaggccagctgaccattattgaggggttcaaaagggaactcaattatgtggccaggaacaagcctaaaacagtcatttactggctggcggaggtgaaggactatgacgtggagatccgcctctcccatgagcaccaagcctaccgctggctggggctggaggaggcctgccagttggctcagttcaaggagatgaaggcagcgctccaagaaggacaccagtttctttgctccatagaggcctgagctgactggagcagagtcatttgcttcagcaggatccttgtgggccttctaagatgaagccaccctcaggtccagggaaggttgtgctggtatttggctcatgacagccaagagcagatttgtgaaatcggctcaactcccaggtgagagcaagcaaaaatcttggctgggtggaaaggaaggcaaaagagtaaaaattaaaaaggccaggcccagtaagtgtaccttgtactttataaataaacctcaagcagctcaa

SEQ ID NO: 713357 - DNA, 660 bp, Homo sapiens
  misc_feature (41)..(41): n is a, c, g, or t
  misc_feature (150)..(150): n is a, c, g, or t
  misc_feature (155)..(155): n is a, c, g, or t
  misc_feature (191)..(191): n is a, c, g, or t
  misc_feature (244)..(244): n is a, c, g, or t
  misc_feature (339)..(339): n is a, c, g, or t
  misc_feature (351)..(351): n is a, c, g, or t
  misc_feature (384)..(384): n is a, c, g, or t
  misc_feature (481)..(481): n is a, c, g, or t
  misc_feature (501)..(501): n is a, c, g, or t
  misc_feature (532)..(532): n is a, c, g, or t
  misc_feature (552)..(552): n is a, c, g, or t
  misc_feature (556)..(556): n is a, c, g, or t
  misc_feature (627)..(627): n is a, c, g, or t
tctgcgcttgtctgccatgctaacgttgaagcaaggatganaatagaacctccctaaaactgatgccgtccttgtccaggagctgaacccacttttgtaagatgaatgaaaggccacaagattaggatttggtgcgttggggcctgaatnctgtnaaaatacaggcatagtttctgtaaccccttactgcncaggagtcatgtggccagaggtcacaagacttgtgtctcccccagtgcctccngtagataacatcactattgtggaacctaaaattggccttttgggatgtttctcagacttaccccacctggactcaacctgtggccccacccagangtggactcagtncataaggactatttccacacccgtatgattgcntccccaaccacttggggtaacatcattcattcatttgcacgtggaaatccagttttcccaataccattgtaattccctggtgggttcttcctgcttnctgcacagacaaaaccagtncactgaggccatggtattgcagtcaggagtngaattaactcaatgccagcnacanggaaggactggagttatcactgaaatcagcctccccaaaggctcagaggttagggtgtttcaaggaaagtnttgtgggcaggcaggggactcaggaatgggtgc

SEQ ID NO: 713358 - DNA, 832 bp, Homo sapiens
  misc_feature (10)..(10): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaa

SEQ ID NO: 713359 - DNA, 987 bp, Homo sapiens
gctacctccttctgcttcggggagggcatgggatcagctacctgtttctgcctcaaccatggaccaataatatgagatctttgttcaccagttctacagtgatggggtgcttccttttggcttctggaatgggtgcgtttgcttctgaggatctccagtgtcacaacaaacacatgccagccctgttttacagggagccctggaggagttgggatagaggccacattgactgagggtagttgccagggtcctgcagttatacacaaagtccttaggataagaccatggccttgagagcatgtggcttgatcatcttccgaagatgcctcattcccaaagtggacaacaatgcaattgagtttttactgctgcaggcatcagatggcattcatcactggactcctcccaaaggccatgtggaaccaggagaggatgacttggaaacagccctgagggagacccaagaggaagcaggcatagaagcaggccagctgaccattattgaggggttcaaaagggaactcaattatgtggccaggaacaagcctaaaacagtcatttactggctggcggaggtgaaggactatgacgtggagatccgcctctcccatgagcaccaagcctaccgctggctggggctggaggaggcctgccagttggctcagttcaaggagatgaaggcagcgctccaagaaggacaccagtttctttgctccatagaggcctgagctgactggagcagagtcatttgcttcagcaggatccttgtgggccttctaagatgaagccaccctcaggtccagggaaggttgtgctggtatttggctcatgacagccaagagcagatttgtgaaatcggctcaactcccaggtgagagcaagcaaaaatcttggctgggtggaaaggaaggcaaaagagtaaaaattaaaaaggccaggcccagtaagtgtaccttgtactttataaataaacctcaagcagctcaa

SEQ ID NO: 713360 - DNA, 172 bp, Homo sapiens
gatacctggtcccatgcctgtatccacagctactcgggaggctgaggcgagaatcgcttgaacccaggaggcggaggttgcggtgagctgagatcgcaccattgcactccagcctgggcaacaagagcgaaacaacaagagaaaaaaaaggaagctgcacgacagcccaaaa

SEQ ID NO: 713361 - DNA, 886 bp, Homo sapiens
  misc_feature (29)..(29): n is a, c, g, or t
  misc_feature (58)..(58): n is a, c, g, or t
  misc_feature (797)..(797): n is a, c, g, or t
ggaagcagggagagagaactggccagggnataaaaagggcccacaagagaccggctcnaggatcccaaggcccaactccccgaaccactcagggtcctgtggacagctcacctagtggcaatggctccaggctcccggacgtccctgctcctggcttttgccctgctctgcctgccctggcttcaagagggcagtgccttcccaaccattcccttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctagctggcccgggtgggatccctggngacccctcccaaggcccttctggcctggaagtggcatccagtggccacagcttggctaataattagtggctcatttaaacataatatcc

SEQ ID NO: 713362 - DNA, 833 bp, Homo sapiens
  misc_feature (23)..(23): n is a, c, g, or t
ggatccttctggcgaactctatngatgggcccaagcgtaaccaggctcttctgattggccggtgtacttcagtttccgtccaaggtccgcctcctacctccttctgcttcggtgtccttaggataagaccatggccttgagagcatgtggcttgatcatcttccgaagatgcctcattcccaaagtggacaacaatgcaattgagtttttactgctgcaggcatcagatggcattcatcactggactcctcccaaaggccatgtggaaccaggagaggatgacttggaaacagccctgagggagacccaagaggaagcaggcatagaagcaggccagctgaccattattgaggggttcaaaagggaactcaattatgtggccaggaacaagcctaaaacagtcatttactggctggcggaggtgaaggactatgacgtggagatccgcctctcccatgagcaccaagcctaccgctggctggggctggaggaggcctgccagttggctcagttcaaggagatgaaggcagcgctccaagaaggacaccagtttctttgctccatagaggcctgagctgactggagcagagtcatttgcttcagcaggatccttgtgggccttctaagatgaagccaccctcaggtccagggaaggttgtgctggtatttggctcatgacagccaagagcagatttgtgaaatcggctcaactcccaggtgagagcaagcaaaaatcttggctgggtggaaaggaaggcaaaagagtaaaaattaaaaaggccaggcccagtaagtgtaccttgtactttataaataaacctcaagcagctcaa

SEQ ID NO: 713363 - DNA, 310 bp, Homo sapiens
gcccgagttagaggggctgcaagaagaaggtcgtccacatatgaagatgactgggagacaggtttaaggaagtgaggtttcgggctagagcttgtccaaagaaatgagggctatccctgaagccctgagggaggacagtccatgtgagttgttgtgactggagggtgtcagggtcagtccaggtgaaagcaaataggtgcccgagtagcatcctgtgacccctccccagtgcctctcctggccctgaaggtgccactccagtgcccaccagccttgtcctaataaaattaagttgtatcatttcaaaaaa

SEQ ID NO: 713364 - DNA, 241 bp, Homo sapiens
  misc_feature (17)..(17): n is a, c, g, or t
  misc_feature (38)..(38): n is a, c, g, or t
  misc_feature (64)..(64): n is a, c, g, or t
  misc_feature (70)..(70): n is a, c, g, or t
  misc_feature (115)..(115): n is a, c, g, or t
  misc_feature (150)..(150): n is a, c, g, or t
  misc_feature (169)..(169): n is a, c, g, or t
  misc_feature (182)..(183): n is a, c, g, or t
  misc_feature (192)..(194): n is a, c, g, or t
  misc_feature (208)..(208): n is a, c, g, or t
  misc_feature (235)..(235): n is a, c, g, or t
ctttggccaaatgggcntaacaaggggcttccccgggnaccggtccccttgcttccctggggcnttttangggcccttgcttcttgccctggccccttgggcttttcaaagtagngggccaagttgccctttcccaaacccaatttcccnttatccaggctttttgacnacgctatgctccnngcccatcgnnngcaccagctggccnttgacacctaccaggagtttgaagaancctata

SEQ ID NO: 713365 - DNA, 987 bp, Homo sapiens
ccacctctgcctcccaacgtgccgggaccacaagcgtgagccacaccgccagaccaagatgatttaaagtatacaggaggatgtatgtaggttatgtacaaacactacgccattttatgtcagggactggatccccaggggggttttggaatcattgaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaa

SEQ ID NO: 713366 - DNA, 231 bp, Homo sapiens
tacgaggcctactctctcctcccgtacggcgccggaatcctatctccacttaccaggccgcggttaccccgccgtcccctccgattcccgccaccccgctctcggcaggttcttcaggattcaagtccgtaggccctttaaggggtctatttgccgtttgctacgccctgggactttggtcccacacagccgggatccggatggctttcgtgccggcttcgacaggcctag

SEQ ID NO: 713367 - DNA, 154 bp, Homo sapiens
cacctcagccttcccagtagctgcgacgtacatgcatgcgccatcatggctggccagtattcgcagctactgggaaggctgaggtgggaggatcgcttgagcccaggagatcaaagctgcactgagccatgattgcgccactgtactccagctg

SEQ ID NO: 713368 - DNA, 497 bp, Homo sapiens
  misc_feature (13)..(13): n is a, c, g, or t
  misc_feature (44)..(44): n is a, c, g, or t
  misc_feature (121)..(122): n is a, c, g, or t
  misc_feature (142)..(142): n is a, c, g, or t
  misc_feature (319)..(319): n is a, c, g, or t
caggcgtggaganaacggaggccgcgattccccggggccccttntgttttcccccctggacgccccagggggcaaagggtgggtttccttaacccaccgggtagggcgctattacttgggnntgggcccttgggcctccaanggggtcctttcgaaagaacccccccaaaatttggccttgccccttccacccaaattggtatccgccagggtaaaatccccaaacctttttttggtggtttcttccaaaaaaaaaaggtgggggagccccgccccccgggagggtgggtttttccccccaaaaaaaagaaatttttgntttcggggccgggccaggttggtccgaaaagtgggggccccccaatttttcccaaaatccaaggttttcccccggtcccggggcccccggggtttggggttggttttgcggaagggatttttcccccccaattgggggttttaatgtttttaggaccctatttaaaagctggccccca

SEQ ID NO: 713369 - DNA, 943 bp, Homo sapiens
tccgggtcctcatggattccggggtcctcatggattccggggtcctcatggattccggggtcctcatggattccggggtcctcatggattccgcgctcctcatggattccggggtcctcatggattccgggctcctcatggatccagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaa

SEQ ID NO: 713370 - DNA, 287 bp, Homo sapiens
aatgacagagagagagactgaaatgcacagaatatacaagagaggtagaggcctggaggatgaacttggaaggaatattagctaatgtgcctttagatggacagagtgagctagaaaaagaaaagacacacggagaacttagcgaagagcaccctgagcaaaagaaagtagtcttcaggcaggagatgttagttctgaccctcacagagatgctagagacaagaaagcaagtcgtatcgatgtcgagcgatcgcgcgcccgtcgacgcggccgcgaatttagtagta

SEQ ID NO: 713371 - DNA, 457 bp, Homo sapiens
  misc_feature (31)..(31): n is a, c, g, or t
  misc_feature (59)..(59): n is a, c, g, or t
  misc_feature (114)..(114): n is a, c, g, or t
  misc_feature (139)..(139): n is a, c, g, or t
  misc_feature (146)..(146): n is a, c, g, or t
  misc_feature (264)..(264): n is a, c, g, or t
ggtgccccgagtgacctctctggtaaagttncacattcccggtatgtggtacatccaancacactactactcttaagtcccagttactcattcatacgaaaaaaagcttgtggnccatggaacgtaagaactcataaanctcttanatatatagttatttttgtgggagataattttaataggacgttctttgctgttgttggtcgcagctaatagactggacatttaacttttctaccatttctgcaagttaggtatgtttgncaggagaaaagtatcaagacgtttaactgcagttgacttcctccctgttcctttgagtgtcttctaactttattctttgttctttatgtagaattgctgtctatgattgtactttgaatcgcttgcttgttgaaaatatttctctagtgtattatcactgtctgttctgcacaataaacataacagcctctgc

SEQ ID NO: 713372 - DNA, 393 bp, Homo sapiens
tcgaccaggagactcgctgttaccccagaggctgaggttgcagcgagccagtacatgccactgtactccagcctgggcgacagagcaagactctgtacacaactcacccaccccctcctgcctcagcctcccgtgtagctgggactacaggcgcgtgccaccatgcccggctaatttttgtatttttagcagagacggggtttcaccgtgttagccaggatggtctcgatctcctgacctcgtgatccacccgtctcggcctcccaaagtgctgggattacaggcaatgagttgatttttaactactgggtttaggccaggcaggcccaggcctggttttgggcctggcgctgggctgcctgtctttggttttacttccttgttgtattttct

SEQ ID NO: 713373 - DNA, 886 bp, Homo sapiens
  misc_feature (29)..(29): n is a, c, g, or t
  misc_feature (58)..(58): n is a, c, g, or t
  misc_feature (797)..(797): n is a, c, g, or t
ggaagcagggagagagaactggccagggnataaaaagggcccacaagagaccggctcnaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctagctggcccgggtgggatccctggngacccctcccaaggcccttctggcctggaagtggcatccagtggccacagcttggctaataattagtggctcatttaaacataatatcc

SEQ ID NO: 713374 - DNA, 918 bp, Homo sapiens
  misc_feature (29)..(29): n is a, c, g, or t
  misc_feature (58)..(58): n is a, c, g, or t
ggaagcagggagagagaactggccagggnataaaaagggcccacaagagaccggctcnaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtgtgaggcagctgtgggttctaacatgcccgcgtgggatccctgtgaaccctccccaaaggctctccttggcctggaagtttgccccctatggccaccaaccatgtcctaccaaatactgttgttccacaaaacaacaacacaaaacaacacaaaacacaaacatcc

SEQ ID NO: 713375 - DNA, 869 bp, Homo sapiens
agcgggtgccggcgtgcccgggcccctgacacagcggcgacatcctgggcctggtggtcaacgccgacggcgagctgcacctcagtccacaatggtcgcggccgccgggatgcagctgtgcgtgtgacgcctcgcaggccgctttggagtgctcttcggcctgcacgggaccgtcgacgctagatccgcgtcctcggctccactatcctggctcgagctggggtatcccatcatctcccctgcatcccctgtgctcgcatcgcgcaatcgctctgcctcacgtgcccttggtgcgagcctgcactgtcgtgagcgcccgttgcgtcaagcacgtgcagcatctgtgctcctctgtgggtagcgtctagctggttgggacaggccctcgcgaattcgctccgttgagcactgctcgccgaagtccgccatgttgaggcccgagggtctcctggtgccacgtgtggacgcgactgaggatgcgatcgcatcttgtgcggtactgtaaacactgctggtgggacacgaggtctattctacatcactgtgggccacatgtgatgccttctgacatacgtgcctgtggaccctgacgccgtgcgtggaagtgctctgtcagggccgtgtgtgcccctagtctgccggcgctgccatcataggatcgtcactcgaggagcctaccgcatgctccttatgtccgttgcggttggtcccatcccgcgatacgccgatcttcgtcggtgcttcagccccgagtcaccaagctgaggagctgggccagtgggtggcccctttctctttcctcattttgggaaaccttttgccgtcactctagttaagacattggggaaacgttgcaacctatggggatc

SEQ ID NO: 713376 - DNA, 893 bp, Homo sapiens
  misc_feature (29)..(29): n is a, c, g, or t
  misc_feature (58)..(58): n is a, c, g, or t
ggaagcagggagagagaactggccagggnataaaaagggcccacaagagaccggctcnaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtggtgcccgagtagcatcctgtgacccctccccagtgcctctcctggccctgaaggtgccactccagtgcccaccagccttgtcctaataaaattaagttgtatcatttcaaaaaa

SEQ ID NO: 713377 - DNA, 825 bp, Homo sapiens
gcccaaaggaatgttgcgtcctggcatattgaatgcaacgaccacgccattatgcattgctccctcaagcccttctgttgcccctccatgaggaggtagaagccttgtcggttcatgtcatgaatgggaaaccattacctgtgagtaggtaatgtttgctttgcgggagctgacaggttcggtctggggactcattgagatggtagtgtacgtgcgtgtttcgtgtgaatgatgcattgtcttgccgttcgacgaatgcgtgcgatttcattaaggaacctaactagaagacggctccaggctcatgacgttaagaggaagtacgttgccaacgtacttcatgaaactattggttattgaagatggcgtatacaagtcgagatgtgagtcaaatttgtgttggagacatgaatgatggattactagctttgatgcacgcacagtgaatcatgtggacagtagtacgactgctactcgatgtgtgtcacaatttcgttgatcactcgttgctcgaaaatgtgtcctgcaggcgtaaggagtagttcagaggagaattgcccagcactggagctgggctgtgcagtggctacagaagaagatgtcagaacattactggacaccacagagtaatgtctctaatgaaagcatcaactggaacaaacctttcagcgaaccatttcatgctcagtgacacgttagcgtattgccagcagtttgtcgaatgaacaatgagcaatcaggaagcagtgatgggtcggagagtagtcctggcaatgagaacggagagaggcatctacagagggttcagaatctcccatgatgatg

SEQ ID NO: 713378 - DNA, 316 bp, Homo sapiens
atacgggaatcgagagaacatatcatgtcgagtcctccacaggacagggaagaatggacagaacgctatccaggctggagccgacagactgcagaggccagaagaggagagaatgaattgtagtccaacttcacaaattgataatataggcgcggcagagcatggcatgcctctcacaaccccatcatcaacagcaaagcacaatgaatgcattttagactattatgaaactcactaggtcgaaggcaacttttgggcaaagttcatttatggttcggagcacacaggcaagtggcacaaatcactatgctcatgc

SEQ ID NO: 713379 - DNA, 397 bp, Homo sapiens
atgcttgttggtcgtctctcacggatccccccggtcccatctactggttgaatacagggatcctgactgtggcgacataaattcctgtctgctggtctctatctccattttgctgtatctcgccgcaagacctttagtccctcaactttctgattttggtttttacagccctgcttgagagattcctgttgttgctttcagaactggtcatcggagataatcttgtcatgcccgatgagttctcgcgctgatggggacggctcttgcatacgtgttcttgcaggattcctttctttgccatcttaagaggactacctaaagtcttctcctatcccatagtacgcctgactggcctgtgaaggtcgtggttgcagatatttttgattaactagtcgat

SEQ ID NO: 713380 - DNA, 489 bp, Homo sapiens
aatggggattgtaccactatatggccttttgtgtctggcttcttctactcagcataatgttttccaaggttcaatccatgttgtagcatgtgtcgggtattttgtttctttttatgagactgaataatattccattgtatggatataccccacattttgtttatccattcatcagtggtggacataggggttgtttccactgttggggttgtgaatagtgctgctgtgaacattcttgtgcaagcttttgtctgaacaagtgtatttaatttgttttagtctatactaagagtggaatttcagggtcctgtcgtgcttctgtgtttagcttaaggtggaactgccaaacttccacggcagctgtacccttttacattcccactagcaatgtgtgagggatctcatttctccacatcttcaccaacacttatatttcattaaagattttttattataaaccccctagtgggtgtgaaatgataaaaaaaa

SEQ ID NO: 713381 - DNA, 256 bp, Homo sapiens
gcagtatgtatcggcatcctcccaggcatgggtgcatactctgggaacagcgactccgagtccagctcagacagcgaaggcaccatcaatgccgccggaaagattgtgtcctccatgttccgaaacaacaccttcgtagaggccccccaccctctccgcccctaaaaagggagctgctccccaagggtagatcggaccgttcatgttgcccataggcattatgtccctcaaaaaaaaactcctttgcctgcaaaaa

SEQ ID NO: 713382 - DNA, 824 bp, Homo sapiens
  misc_feature (813)..(813): n is a, c, g, or t
gcttgtaggtaagctcttcctggggtacaatgtgggcttcaatgtcaagttatgtgtctgtcaaggtatgtttcgtcgtggcatacggttgctggtgaccagcatatatgtaccctacctatggtagtctgctggcttctactgctcaggtgtatttatcctgataccatcctaggcctatatatagcgccggctatgcccctgtattggtattgcctacacggctcacatttgcatgcaagtttgctgagctgaaggaaattgattgatcgccgttctggttaaatagctggaagatggccctatattcttgatagtctggtgtatgctgccattgttgatatggttcctggcatagcccatgtgtgttgtagagcttctcagactatcctacctctgggtcgctttgctgttcgtgtattatgtagtactagtactagttgtcggtgggtgtcatcaaagctagtggtacttagtaaggctgctggtagcttggcataggtcaccaagtctgccctagaatagctcagataggcataatatgatatacttatcccttattaccgtgcctacccctactcttttatcagtggtggtagacggtctcagaactgtttgtttcaattggccattaagttgtagtagtatagactggttatgatacatatgcatcgtataccttcagaaggaaaggagatgtttgtgaccactggtttcttatgcagtgaacagttttaaatgagtcagcaaattcagcgacacattttcaagtgaagctactgccactaaaagtattaccaagggagacaactnaaagatagcgg

SEQ ID NO: 713383 - DNA, 551 bp, Homo sapiens
  misc_feature (45)..(45): n is a, c, g, or t
  misc_feature (52)..(52): n is a, c, g, or t
  misc_feature (56)..(56): n is a, c, g, or t
  misc_feature (58)..(58): n is a, c, g, or t
  misc_feature (61)..(62): n is a, c, g, or t
  misc_feature (66)..(66): n is a, c, g, or t
  misc_feature (75)..(75): n is a, c, g, or t
  misc_feature (95)..(95): n is a, c, g, or t
  misc_feature (100)..(100): n is a, c, g, or t
  misc_feature (104)..(104): n is a, c, g, or t
  misc_feature (106)..(106): n is a, c, g, or t
  misc_feature (114)..(114): n is a, c, g, or t
  misc_feature (118)..(118): n is a, c, g, or t
  misc_feature (123)..(123): n is a, c, g, or t
  misc_feature (135)..(136): n is a, c, g, or t
  misc_feature (140)..(141): n is a, c, g, or t
  misc_feature (144)..(145): n is a, c, g, or t
  misc_feature (147)..(147): n is a, c, g, or t
  misc_feature (154)..(154): n is a, c, g, or t
  misc_feature (157)..(157): n is a, c, g, or t
  misc_feature (316)..(316): n is a, c, g, or t
  misc_feature (443)..(443): n is a, c, g, or t
  misc_feature (501)..(501): n is a, c, g, or t
tattggttggacgaggtggctcatgcctataatcccaggactttnggaggcngagncnggnngatnatgaggtcnggagttcgagaccagcctgnccaanatgntnaaaccccntctntactnaaaatacaaaannagcnnggnntngtggcangcncctgtaatcccagctactcgggaggctgaggcaggagaattgcctgaacccacgaggtggaggttgcagaaaccatgatcacgccactgcattccagcctgggcaaaagagcaagattctgtctcaatcaaacaatcaataaaaatgtaaggaggaagnatttactgtgtatttatatgtctggtattatgtgaagcactttactatcttatcaaatcttcgggacagatcttcagttctcatgaccacaaaagaggatactaaagctcagacaggagaagagacntggccagcctgtgtccccagggcctatggtcttaccactaggttacagtgtttccagntatcacatgttgtgagatttttgctttaaatgaccaaaaaaaaaccaaag

SEQ ID NO: 713384 - DNA, 407 bp, Homo sapiens
caggtggctgaggtgggaggattgctcgaggctgggaggttgaagctgtagcgagccatgatcgcaccactgcactccagcctgggcaagagagggagaccctgtctcaaaaaaaaaaaaaggggggaaaggaaaggaaaagggaaaggaaattctcagggcctgggttccctaagggaaaaaacagaaagggggggaaaaaccttcttaaagagggggggctcccctttcttggcaaatgctaagaaaaggccaaaatttcaaattcaaaaattgggaaaagggctttccccttggcccaaaacaatgactaaggcttggagaagggaatccggtcatcctaggactaaaaaggggcggggcctaaaaaaaaaaatccaacattaaatggcccggcaaaaaaaagg

SEQ ID NO: 713385 - DNA, 421 bp, Homo sapiens
  misc_feature (45)..(45): n is a, c, g, or t
  misc_feature (52)..(52): n is a, c, g, or t
  misc_feature (56)..(56): n is a, c, g, or t
  misc_feature (58)..(58): n is a, c, g, or t
  misc_feature (61)..(62): n is a, c, g, or t
  misc_feature (66)..(66): n is a, c, g, or t
  misc_feature (75)..(75): n is a, c, g, or t
  misc_feature (95)..(95): n is a, c, g, or t
  misc_feature (100)..(100): n is a, c, g, or t
  misc_feature (104)..(104): n is a, c, g, or t
  misc_feature (106)..(106): n is a, c, g, or t
  misc_feature (114)..(114): n is a, c, g, or t
  misc_feature (118)..(118): n is a, c, g, or t
  misc_feature (123)..(123): n is a, c, g, or t
  misc_feature (135)..(136): n is a, c, g, or t
  misc_feature (140)..(141): n is a, c, g, or t
  misc_feature (144)..(145): n is a, c, g, or t
  misc_feature (147)..(147): n is a, c, g, or t
  misc_feature (154)..(154): n is a, c, g, or t
  misc_feature (157)..(157): n is a, c, g, or t
  misc_feature (186)..(186): n is a, c, g, or t
  misc_feature (313)..(313): n is a, c, g, or t
  misc_feature (371)..(371): n is a, c, g, or t
tattggttggacgaggtggctcatgcctataatcccaggactttnggaggcngagncnggnngatnatgaggtcnggagttcgagaccagcctgnccaanatgntnaaaccccntctntactnaaaatacaaaannagcnnggnntngtggcangcncctgtaatcccagctactaaggaggaagnatttactgtgtatttatatgtctggtattatgtgaagcactttactatcttatcaaatcttcgggacagatcttcagttctcatgaccacaaaagaggatactaaagctcagacaggagaagagacntggccagcctgtgtccccagggcctatggtcttaccactaggttacagtgtttccagntatcacatgttgtgagatttttgctttaaatgaccaaaaaaaaaccaaag

SEQ ID NO: 713386 - DNA, 472 bp, Homo sapiens
  misc_feature (246)..(246): n is a, c, g, or t
  misc_feature (251)..(251): n is a, c, g, or t
  misc_feature (273)..(273): n is a, c, g, or t
  misc_feature (291)..(291): n is a, c, g, or t
  misc_feature (321)..(321): n is a, c, g, or t
  misc_feature (334)..(334): n is a, c, g, or t
  misc_feature (349)..(349): n is a, c, g, or t
  misc_feature (357)..(357): n is a, c, g, or t
  misc_feature (362)..(362): n is a, c, g, or t
gtgttatgtgcaatgacctatttaaggtaaacccattccaactacagcagttcaggggtgatccaagcactgcctccctcctgctctgtccaggtggtttgggccataaactcaactttaaaaggaaggcttggggttgaggacttgtgatcaaaaaaactgaaaatggaagttttggccggggctcattaaacatgagtcctccctttgtgtcctgaggccgggtcattttttcaacctccctgnccccncacacttattccagacacaacnccatgtggtttggaggtnccagccccccccctaaaaaggttatccctnagaactcccccanacttgggagcccaantgcagtgnctggnggtggtcccatttgccgccccccttttttcctgcaattggtttggactccctggggtgtgctttcccctgtttaccccatgtatggaaataaaggcccttttcctcctga

SEQ ID NO: 713387 - DNA, 265 bp, Homo sapiens
cctccgcctcccgggttctagcgattctcctgcctcagcctcccgagtagctgggattccaggcacctgccgcgacccccagcaaatttttgtatttttagtagagatggggtttccccatgttggttaggctggtcttgacctcctgccctcaggtgatccacccgccttggtctcccaaagtgctgggattacaggcgtgaccccccgtgcctggcctgtaatgtggtttttatattcagtgaaataaaaatttcttggacca

SEQ ID NO: 713388 - DNA, 235 bp, Homo sapiens
ggggaaaaaggagttttttaaaaaaactttttgctcctctgtttcaaaaagccagacttttgggttttaccctgtgtccccgtgggcagtggcaggtggcctggccctgcatggagccagcacgtttacctcccatttgccgccccccttttttcctgcaattggtttggactccctggggtgtgctttcccctgtttaccccatgtatggaaataaaggcccttttcctcctga

SEQ ID NO: 713389 - DNA, 3273 bp, Homo sapiens
atatatagggtcttatatgtttcttaataaattgatcccattactttatagtcacagctcctattagaagttttaatgaagactctccatgagcttaggcttcaaattacttgttttggaaaaggtcatcttgtcctttataaactgtaaattcatatattatttagctttaatatgcaaatacaatatccttgagttcatcctattaatttagaaactcccaggaggtaagatgggtggttggagcgcattctttggttattttcattagcattaagtccttattctttataggtggatttaattcttgaaaatattcaaaagtaattcagagtcaaggtgttggggatggagagaaaggaggaacagagaggaaaaaaattagcatttgttgagtgttgacgatttgtagagcattttgacaagcacttaatatacatcatcattcattttgatcctcttaattaccttgcaaagatttgattcttttttttttttgagacagagtcttgctctgtcacccaggctggagtgcagtggcttaatctcagctcactgcaacctccgcttcctgggttcaagtgattctcctgtttcagtctcctgaggaactgggattaaggtgtgtgccaccacacccagctattttttttctatttttagtagagagagggtttcaccatgttggccaggctggtcttgaactcctgacctcaagtgatccacctgccttggcctctcaaagtgctgggattacaggcatgagccaccatgcccggctgattttattatttttttaaaaaacatatgaaaccaagactcagagaagtaaaataactcatttaggatcatacagaatggtaaagtcaggattcagacatagatttctcccactccattattcattttttacactacgcaatgtatacaatagcttttggttaacaaaggcaaggtgactataaaatcgtgagattaaagcatttcaattttttgatatattaccgtttatgaagagtagagaggtttttttgtgtaaataaaaaaaactgtaggaaacatctgtaggaaatatcaagatttaatgtttaactagattttcaaggtaaatttacatttatttagctaagtgttatattaaagttatttgtcataacatacctcaaatatttatttatagttcatatttaatacagaacaaatctagtcttcgtgttaacatcgggtctcggcagagtttctgaaatgaaacattatgaagaaaggtagttcagatttgttgaatctgagctttagggatttcaagtgtatttttttttattttcctctttcagaatattaacatctctattagttttttgatgaatatgagttttaagattcctaataagggttttaagtgaacacacataaaatacatatcaaaccactgatcccgattgttccctttagtcgctgtgacattgttacctttagtggcatgcacttggaaatgtcagccttcagagaagggggagttacatggagtaaggcctcatggatgtcatggtggtcctccatgttcaccaaccaccaagaaaattcttcttcagtccacaattccagcttgcgctctttggtgcacttggagccagaaagtgtctttttggccctgttttgtagaaaccgtgcatgtaccaaagagaaactttagagtttggatggagctgaagcattgatgggaattccctagtgcacccaggagcaggaggcaagcccaagcctcgggtggtagccaattatattttgtgatcgtgtatgtacttaaaacatcagagatgacacagcacatgaatataactattgatatgtaggtgcatactgagtattctaagtagcagatagataccaaaatactgtataatcccagaattgcctaaactgcaggtttgctagttctctgttatacagaccagtaggtagcctttccacacatttgtgttttctcttccataataagagagtgctgcggctggcaggcaaaggtagttgcctcatgcactttatctttttgtctttttctcttcttcatcttttgggatgctgctggctgtatctgtcccaaacttcttgttgcattagaatcagatctgtgtatgtttgaggaggttttattttaaagacttcagttttactcagctctaggaagggtcaaatacaacaacaacaacaaaaaacagaaaacaaaaaaccctccctaggtgtttgcttttgcaacattaaaagaaatgccttggtgctaaaaagtatttaatgacgcatgttcaccactaaaaagcgccactgaattcacagtatttcactgctaagtggctgcatgtactttgtgtttggaaatctgaagaattttccagaaaacaagcatccattactctcatttcaacagttactccatctatgctgcaaaaatgaagcgtgaaaggggggatacttttctatggaatactcagtgcttttgatatttattttagcaagaataatcagatgccaaaaataatttcagagaaaggtagaaaaaatatttcagataaccttttcttatttcttctccaaaaagattacacccatgtaaggtatttttaacactggggttttgaaggtgttatcttttctggtatcctatcactacatgttaaaattgaaggagaaaatattattgaaactaaagtaattgcagggacacattaaaccaaaggggtgaacaaaagaggtttaaagtttgtatctagaaatgaaaaataagaatcattggtaagactagtaccgattattggcaattggtaattgataattggtaagagtagtaccaaatagtgggcatttttcttaaaatacatacctctaccccaaaccccaaatgttaatttagaatcctgaaacaggcaggtcaggctctgactcttttgtttaaggaaatgtaatactgtgtcaactaaactggcattaggttcttagtggagtgtgtgtttgtgtgtgtgtgtgtgtgttttgtgtagaggtatgtttgtgatgaaaggttttgcactgttgcataaagaagtttgattttgtgatttttaaaatgatattcatttggagactttttaaggtaatttaaaagatgtataatttccgtgtgtttaatgaaatctgttgtcgatgtactaatcttggtttacagcatcttgaatacttgattattgaaaattaagaaaaaagttaaaaatgaataaagtgtgttggactgaaaaaaaa

SEQ ID NO: 713390 - DNA, 863 bp, Homo sapiens
tcccgccaggacagtacaaacctcgggtaaaagcaggcgtgaaacaagccgcccaaaagcctattttccggcggcctccaaaaacccgggggccacactcccccctgtggtgggtacctcggcggtcgccacaccacacaagcggtgggtggcatacacacaaagcacgtgtcgcacacacagtacggcggtgcaccccccacaagggggggaatatagttaccaccccacacaaggagagacacgaaggacacgacttccccgcgaaccccgcggtgggtccacgccctcctgttggatacccccacacgcaccatccgggggggcgcaccaaccgggagcgacaaacagaccacacacacgtggtccaatgccgtgcgtttttctaacaaacacgccctcgcggggtgaacaaactacagccggagcaacaccctctctcctcttggttcaaccagtacaatacacacccctaaaggtgtagaccccaccaggcgcggtggtgtggtggcgcagctaccaagcgaagatcacccaccccttgccgcgcggggcgcgtgtttgccacgcaagcgcgagagtcatactcgcgcacacctagtagtgagtcccggggtgtgagtccgcaactgtggtcggtgaaaagattgccaccatggcccttgttcctcctcctggccccccgttgattagatactctttgtttgcctccaacaaagatatttagctaaaaagggtgcacatactaaaaaggttcaacaagtactcccgaaggcaaataccccactaagatattctttgcaaaaaggagccaggaggacgactttcccggcttctagaacgtttaaaaaaggcccccacat

SEQ ID NO: 713391 - DNA, 907 bp, Homo sapiens
cagcacggcgccaacgtgaacgctcagatgtattctggcagctcggctctgcattctgcgtctggccgcgggcttctgcctctggtgcgcacgctggtgcgcagcggggctgacagcggcctcaagaactgtcacaatgacacacctctcatggtggcgcgcagccgcagggtcattgatatcttaagggggaaggcctctcaggctgcttcagggtcacagcctgagccatccccagaccaaagtgccaccaactcccccgagagcagcagtcgtctcagctccaatggcctccagtcctcgccaagctcctcaccctcgctgtctcccccgaaagatgctcctggcttccccgcgactccccaaaactttttccttcccacaacatctacacctgccttcctgcccttcccaggagtcctccgaggccctggccggcccgtacccgcttccccagctccaggaagcagctgagacggatgggggggcagacccggactcatgaggaggggcctccctgccctgtggggaccactcttctggaaactgtgaggaccttgttctgcttccccccgccaatcctcgggaccaggttttgcaccaaggcacatgcacatactactgagcacagatcctcccaatcgcgcccttgcccaggatctcagcccccaccttaatctcaggcaccaggttccctgtgctggaatccaccagatactcaattctctgagtggaggacccaaaggacagcagctctctctggcaactccaacttgaggaccagaaacagagggtctggagggctggacacggtaaatataggtggtcaatccttgtataacattgttctaacaaacaaaaaaagggggggaaatcccggggcaatagcacattttaagggctagga

SEQ ID NO: 713392 - DNA, 200 bp, Homo sapiens
tgtgataccatttaaaatgttcttacacagctgtagaaatgtaaattatacaacctctattgaaaatgaactagaaaaactcaaaatagaactacttatcaaagaactcaaaatagaactaccattcgatccagcaatcccatgactgcatatacgcccaaaggaaaacaaatcattgtatcaaaaagatacctgcactg

SEQ ID NO: 713393 - DNA, 112 bp, Homo sapiens
  misc_feature (28)..(28): n is a, c, g, or t
ctcggtccgactcctcctgctgtctttntctgcatccaacctggcaaggccctcctgtggggtgccatctgtgcctttattccggctgtgccctcgactttccgtatggatg

SEQ ID NO: 713394 - DNA, 226 bp, Homo sapiens
gtgaccagaggatccctccataatgtgtgcccagactggtcttaaactcctaggctcaagtaatcctcccatctcagcctcccaaagtgtggggattacaggtgtgagccactgcgccgtcgcctacacactaataaattcctcaaaacttagcagcttagaagaacaatagcgtaaggtactagctctcacagtttctttgcatcaaggcgccgtcgcctacgca

SEQ ID NO: 713395 - DNA, 203 bp, Homo sapiens
gctcaagcaatcgtcatgtaatgctagttcaccagtgaaatttgggatcttggctccttcaaatgggttctgttcctagagacagaattacttttgatgctttcccaggagagcctcacaaggacgctgatactcagaagaggatttcggagcagatacagactgatctgcacactaatgatgagtaatttgctacatacaaa

SEQ ID NO: 713396 - DNA, 352 bp, Homo sapiens
acggacaaagactgtatgtcattacaacagaaaggtcactcgattaggggtgagaggtctgtgataaggcgtaaagccccactggctaaagattcatcctttatgcaaaggattatctgaagctattatgtgatgtgatttgtattttgaaaagatcagaggaataatctgcacaatgttcccattcttgaagggatctttctgatctcttacaaagtcttagtggcagctgctactactgactctttggagcaatgttattctcgacggagcttaacgcttcaatccaaactatttgaatttagccttaaaactctttttccagctgaggggggatcactagagcacccag

SEQ ID NO: 713397 - DNA, 535 bp, Homo sapiens
gtcccttctctaaagatgtataaacaaagggtccccaagggatcaaggctgaaatgtaccacaattaacatttttagaaattatctagaaaaaacaatagtgaaatcttcccagtttgcagatgactctacagcaacacatagaagtacaatggtgcaaggctctgtgtgttcagcaatgtgaaaaacagcttccatgtagacaaaaataaggtaattcagtgacagaaaaatagttcaaactataattatcaaacgatgagctctaaaactacctgttttaacataggaaaggggtttcaaagtccctagactgtaccctgaatacagctacaaaaaggcaacaaaatactggctgtcattatgaaagctttggaaacacagaacatattatcctatccttgtacaaaccaaagtgtacctgtacctagaatagaatgtgtagttgtagtcatcatagcacaaaaaaggtaaaatagagaaggcctagaaagatatcacagaagaccaaagggaccagaggggcttctatatga

SEQ ID NO: 713398 - DNA, 182 bp, Homo sapiens
cctccccttttttttccccttattcaatgttttgcctttggggaggggggttgttcaagaatttggggtttggtttgggcattttgttccccccccccccttccccccttaatttccccccggcttcccctcccccgggggttttattcttgaataaaaaataattttgttgttggggttta

SEQ ID NO: 713399 - DNA, 430 bp, Homo sapiens
ggcaaacctgatctaatggcacttgatattaccaagaaatgaagaaacctgtgacctgtccttgacttccacctccctgtcacccctatctttacgccatcaccaagtcctattaaattaagctcctaaatgtctctcatattagttctcttcttgatatccaccagcaccagccccacctcagaccaagccaccagtatctctcacttcaaatatcctcccagttggcccctatccagtatgttcgccacacagaggtcacagatatctttgtgaaaattcagttctgattatgtcccatccctcagttgaagcttctcaatggcttcccattgcttttaggataaagaccagaatatttaacataggcttcaaggttctaagtgatatggcccctgctcccctgcttcatctccccatctctactttg

SEQ ID NO: 713400 - DNA, 803 bp, Homo sapiens
gatactggtacaaaagcatggtgctggtacaaaagcagacacatagatcaatggaacagaatagagggcccagaaataaagctacacacctacaaccatctaatctttgacaaagttgacaaaaatacgcaatggggaaagaattccccattcagtaagtggtactgggataactaggctagccatatgcagaggattgaaactgaaccacttccttacaccatatgcaaaaatcaactcaagatggattaaagacttaaatgtaaaaccccaaactataaaaactctggaagataacctaggcaataccattctggacataggaacggaaaaagatttcatgacaaagatcccaaaaataattgtaacgaaagcaaaaattgacaaatgggacatgattaaatagaattaccatttgactcagcaatcccattattggttatatacccaaaggaatctaaatcattctgtcataaagacatatatacacaaatgttcacggcagcactatacacaatcgcaaagtcagggaatcaaactaaatgtccatcagggtagaacaggatcacagaaaatgtggtggcagggagtggtggcttcatgttctgtaaatcccagcactttgggaaggctgaggcggggtggttcacctgaggtcaggagtttgagaaccaggcctggcaacatggcgaaactccgtctccgcgtaaaaatacgaaaattaggcaggcgtggtggggaagaactgtgaatccaggtactggggaggctaagcgtgagaatcggttgacctggaagggggg

SEQ ID NO: 713401 - DNA, 689 bp, Homo sapiens
gagaggaaggcgcagcgtcaagcagcgaagacacaaatgtaggacgattactactactatgggcatcatctaatgccacctcatgccaggggccgtggcaggcgtgccagccgtggtggttactcctacccgccagactattccggctatgaagattactacgattactatggttacgattaccataactacaggggtggctatgacgacccgtacttcggctatgatgatttccaggcgcccgctcgaggccgagggggccgcggcagtgccagaggtgggacatcccatgcgcgtggcagaggggccagcgctccacggggtagggcaggctttccgcagcgcggaggtgccggggccgggccgggagccagcaggggcctgcgcggaggagccagaggcggtgttctgccgagagggcgcggggtacgtggtgctcggggtggacgcggtgcaaatgtaggaggcaagcgcaaagccgatggctacacccagccagattccaaacggcgccagaccattaatcagaactggggctcgcaacccattgcccagcaacccttgcaaggtggcgatcattctggtaactatggttacaaatctgacaaccaggagttttatcaggattcttttgggcaacagtggaagtagagaatatgtagggctctttgtgttttcagtaaaaaaaa

SEQ ID NO: 713402 - DNA, 290 bp, Homo sapiens
atctccaaaacagtaaaaaacccactttttgttgggcaatatgaaatttttaaaggagtagaatcccaaatgatagaaccagccggcctgaattgagaattttgattttttaaagggtgtttctttttaaatggctgtcccttaatttgattaatttaattcatgtattatgattaaatttgaggcaaatgagcttccaagtattgaaataattactaattaatcccaaatgtgaagttaggcatgatgtaaaaaatccaaccattttaattaaaggctttgccccccca

SEQ ID NO: 713403 - DNA, 636 bp, Homo sapiens
gtgagcccaagtacagtacagagatcaggatcagctttgaaggctggattctatctacataagtcctttcaattccaccgagggcctagagcagctccaccactgtgcacttagccatgatggcaacagaaaccaagagacacaattacgcagtgtatttagaagcagagggacaaccagaaggcccttaactatcaccagtgcatcacatctgcgcactctcttgctccattccctagcaggaacttctatggctcatttaagcagataaagaaactgaggcccacggtttcagctagacaattgatttaggcctatggctctgagttaagcacaatgggccactgtctctggcctatcttccctgtgaccaacgagggtgattacctctcattttccagcttctcagtttctgcctgtgcaatggtccagggcccaggaagtgcggagagtccgtgatggaggggagaggggtcatacgcgattcgccctgcttggttctagtgctgctgtacagcaaggccctgtatactgtctgttctggatatatgtctctttgagagttgagaatttcgttatatgtcaagactctaaaggactaatgacttgtaatggtcaaaaaaagatcgaattgaa

SEQ ID NO: 713404 - DNA, 86 bp, Homo sapiens
ctacaggttatagtgccacacatagtaggtgctaattcattgctgtctaatgagtcagtcaataaacaaatgaatgttctataact

SEQ ID NO: 713405 - DNA, 438 bp, Homo sapiens
tttcgcggtggctcaagccttcaatcccagcactttgggaggccggggcgggcggatcacaaggtcaggagatcgagaccatcctggctaacacggtgaaaccccgtctctactaaaaatataaaaaattagctgggcgtggtggcgggcgcctgtagtcccagctgcttcggaggctgacgcaggagaatggcatgaacctgggaggcggagcttacagtgagctgagatcgcgccactgcactccagcctgggcgacagagcaagactccgtttcaaaagggaggctgaggcagaagaatcacttgaaccaggaggcagagtgtacagtgagccgagatcatgccaccacactccagcctgggtgacagagcgagactctatccccaaaaacatcctactcatctcactaactacatgttggccggtttggccatg

SEQ ID NO: 713406 - DNA, 830 bp, Homo sapiens
agcggagtgaggcgctgtttaaagatggcggcggaggaacctcagcagcagaagcaggagccgctgggagcgactccgaaggtgttactgtctggcctatgatgaagccatcatggtccagcaggaccgaattcagcaagagatttgctgtggagaaaccctctgtgtgtcagagcgggtggaagcttcctcggtccttataccaaggagtattgctgaagatgacgaacttcttatccaaccaggaaaggatccagggaccctccacaaaaggtaactcgtaaccattccgaaagacccagggcctgaggggcaaacttgtttctatcgggctttcggaattctccccactttggaggccaactgctgggattgacaggacaacgggacgttgccaggcgggtaccaaagggctgtgttctgccaggaagcaagggaaagaccctgttgttccccaagggcttcaaccttgaattcaccaaattggacggatttcccaacaaaaccacgtttcatgtgaccctgattgcagcaggtgtggagaagcagaccctctgtctgccggacctgtgctgggcctcctttcaaattgacccagaggaactttccaggataaacctttggtggttcttacacctggcggggttggttccacccttccggggctaaccttggcagccgcgagagacccaaagttccttccgggcaacttccatccgaggcgtgggaccgggcttgtcaacggagtttcctggccagcagggcggtgggacccccttgtggcatgggagacgccgacccattccaaattcatttgtgctttggccccg

SEQ ID NO: 713407 - DNA, 870 bp, Homo sapiens
  misc_feature (512)..(512): n is a, c, g, or t
atttttttcctcatggaaactcccaaaaatccgatgctttgcgtgtttttttatttgcctgataactgatcctttccttgacatttattttagtggactttcagtaactgaaagatggaaacccttttgtaccgtggaagaatttgcagaagactttcagtcgttttgctggaatgattgagcttacattttttattctttccgcattcaaacttagagacactcacctctggtatttgtaatacctggcttttccattttggaattttctggatgattgtcatattatttttcttttaactcttggggattccataccaaattaaatgactgccataaagtatattttactccaggacagattacaatagccttgatagaatcatggcatccaaagggatgcgccatttttgcttgatttcagagcagttggtgttctttagtcttcttgcaacagcgattttgggagcagtttcctggcagccaacaaatggaatattcttgagcatgtntctaatcgttttgccatgggaatccatggctcatgggctcttccatgaatggcgtcactgtttaggaggaacatctgtgggatatgctattgggatttccaccaacttctgcagtcctgatggtcagcaacactgctcccccagaactgtcaggagtaaattgaggctactggctgtcatgcttccaggatttgttcttggttgggacttggttgggctttccagtggcggcttggactgttcataagtctgatggaggtgccattgtttttgtcggcccgtgcggggtggggaaccggcctggggaggagtcgccttaaagcggggaatctgggtcggtgctttcttgtgtttcttg

SEQ ID NO: 713408 - DNA, 591 bp, Homo sapiens
atttttttcctcatggaaactcccaaaaatccgatgctttgcgtgtttttttatttgcctgataactgatcctttccttgacatttattttagtggactttcagtaactgaaagatggaaacccttttgtaccgtggaagaatttgcagaagactttcagtcgttttgctggaatgattgagcttacattttttattctttccgcattcaaacttagagacactcacctctggtatttgtaatacctggcttttccattttggaattttctggatgattgtcatattatttttcttttaactcttggggattccataccaaattaaatgactgccataaagtatattttactccaggacagattacaatagccttgatagaatcatggcatccaaagggatgcgccatttttgcttgatttcagagcagttggtgttctttagtcttcttgcaacagcgattttgggagcagtttcctggcaggtaagcttattgtttgtccagcaaccccaatgacgtgtaataaaatgctagcttcaataattgaaattaaagttataaggtcaagttcctgatttcaaaaggaaaaaa

SEQ ID NO: 713409 - DNA, 138 bp, Homo sapiens
  misc_feature (34)..(34): n is a, c, g, or t
gttatgttaagatctatgccatgcctgggggtantgactcaaggctgctggtcagcgcctcccaggatgggaagctcatcatctggtgacagctacaccaccaacagtgtcctggcctcccacagtgtcctggcctcc

SEQ ID NO: 713410 - DNA, 109 bp, Homo sapiens
gacaaaacgtccagtggtccacaaggcatacgtggcgataagggagagcccggtgacaaggggcccagaggtctggcatggacttaaatgggacacacatggattgcaa

SEQ ID NO: 713411 - DNA, 406 bp, Homo sapiens
agggtcttgctctgtagtcatggctggagtgcattggcacaattacagctcattgcagcctcgaactcctgggctcaagtgacccccctgccttagcctcctgaatagctaggactataggcatgtgccacttatagctggctaatttttatttaaaaattttttttgtggccgggcgcggtggctcacgccagtaatcccagcactttgggaggccgaggcgggcacatcacgaggtcaggagatcaagaccatcctagctaacatggtgaaaccctgtctctactaaaaatacaaaaaaattagccggtcgtggtggcgggcgcctgtagatccagctacttgggaagctgaacttgcagtctcccgggaggcggagcttgcagtgagccaagatagcgccact

SEQ ID NO: 713412 - DNA, 449 bp, Homo sapiens
caatatgacttgagtccacaaggacacaaacccctgagtagttgggcagcccttggcagggtttaagccaggaagtaaaaatgatttggcctaaatatttaagggaactttaggaagaggcctaggtttttaaaatcctgtttttttgtcttaccataaaaggctgacccttttttcatttttttgaagggccacttgtgttttttgttttgggaacttcattcatttttcaacggggttgttgatctttccagtaatttttaggagctgtttatgtttggaggtaattggtcctttgtccaaaaatatgaaatgtaagttttattttccagtttatttttttgcttattttttttgactttttattgtaaaataaaacatcaaactgcccagaacagttgaatagcttaatgaataactccagtaaaagttatggtaaccccccccca

SEQ ID NO: 713413 - DNA, 108 bp, Homo sapiens
gaggatcttatgtgtcatctgaagcagcatgtttaccaaatacacccaatctagcaagcattagcctgcagtgaggtggctagacatactggtagaggtgaggggttg

SEQ ID NO: 713414 - DNA, 207 bp, Homo sapiens
gggacacgagagcagagtgtgcacccacgggtgtgtctagtctctgtgtgagtgcatgcgtggggaggggcgcatgtatgtaatagtgtgcatgtgtgtatgggcatgtgtacctgatctacatgtgatgcacgtgcactacgcctgtgacacatgatgcatgcaatgtgatcatgggccatgtgatacactgtgacagatgccatg

SEQ ID NO: 713415 - DNA, 142 bp, Homo sapiens
atcaggcaaaagcgaactgtacacaggagtaaagatcgccgtcccctgtaaagcagcatatagcattttagccaaatgttgacaaacccaaatcaaccagccttgactatgaatagccagtgcaaatccccacgtttgcagg

SEQ ID NO: 713416 - DNA, 1102 bp, Homo sapiens
  misc_feature (250)..(250): n is a, c, g, or t
  misc_feature (439)..(439): n is a, c, g, or t
  misc_feature (723)..(723): n is a, c, g, or t
  misc_feature (725)..(725): n is a, c, g, or t
  misc_feature (760)..(760): n is a, c, g, or t
cgccgacagtgacacgaagaacgctcaaggctggggttctcaagggaatgaaccgaaggtgggaagacaagcagcaacaagcgggtggcgagaagaacccacgaacatcacagctctcttagggaaagtggaagcacccgatgaatgtgccgaatcaaatgaacacttttccctgtgcaggaattacacttggccggtgaaaggaagaaagtaatgtgcaaaggtaacctggacctcaacaagtggccangaacggggaatgtgcgggcacaaacggccttcccggcaaaaggctcacagtggtctccacttggtgtgaaggcggccctcacactataactctcaatggaatgtaatgtcaacgggggcaggcaaacacaacgcggcaaaagacaaggcatcacatgtaaccatggtgtgcggcaacatctggtctcanaggcacatgtggccctattcgcaaagaaatcacatatcacacgcgctgtgcgtctaacacggtggcgcaaagaaaaaccccatctctggacagtggtctcctgggggtgtaaaaccggcgcacatcacatctcaaacacaggtgggggttccccccgcggggacaaggagacttctcaaacacacgggcaaatattgggggggcgggcgggcacggcggggaaacatgggtgtacagacacggatacacgagggcgtgtgtgtggacatcggttggtctccgcncncgcatgtgagggcacggtgggtgtaaaaaccacanggggcacttactgtgggcttgggctggtggcaccacggggcggccccggtagaaaaggctgggcctttccccggggaaccatttaaagacaccatatgtgttgaaattggccttggccaagaatagaagctccatactcaattgggttggcccaaaggggctctcatctggaaaaatatccttatatcccacatttcaggaaagaaaagggccgaagcctgtggagcgttgtttggcgccaagtccccaaacggctggaattattccccacaattggtgggccccaataaaaccttttgtttggcctttttgggggccgacgccccaaccagcacacaatcc

SEQ ID NO: 713417 - DNA, 766 bp, Homo sapiens
gctcagcgatttggggacgctctcaggctctcggagcacggccaggttcttttgtaatgtctactggttcaggaaacatagctgtgccacgcacagcatttgcaagggttgactcggctctataatcgcccaacgggcaagtctggcgtcgtgtcccatgtccaaatggtacattgagtgactgcttggagctgcggacgctttgtaaccatttgtaaagcatgcacattcacggacccagctggtgttgtgattactgtcaggaagtgtgtacacacgaatttgtggctcgtggccggagaggtcacattgcgtctggcagcacaagggataattggcatatcgacgtacccaagtaggtggggccttagaaggagtgctcgttgcgttcaggacatctggaatgctaagcacgtaagttcttggcacgaccttgtgcgggcgaaggtagagacctggggcctaattggaagtactcccttgcggccaaggctattgatcagcttctgatgcttgaaaaggtctgacctatgaaactgggctcaggtgacgaccgtgacggagggaactggctcgtcccttggtggaatccactggggttatgccactgaagaaactggtccaacgttacgaccgagtccagagaggtagttaacgcaagcacgatcgtgaagcgcgtggagttttggtgaccaggaggttgtctcttggagagagggatcagtgctttgcgtgaaagactgtgcatgaagttccggcggggcag

SEQ ID NO: 713418 - DNA, 138 bp, Homo sapiens
ctgtctcgatctgactgagcaccttggcctcccaaaatgctgggattataggcgtgagccactgtgcccggccaacaataaatttttttaaggctagtcaaactaacaaaaaatttaaaagtcaatcagtagttctaa

SEQ ID NO: 713419 - DNA, 371 bp, Homo sapiens
ccgttaccattcacagagactctcaactggcctgggagggttttttccacagcattgacatctttggctgagggcattgtcatttataagaatgctggctagaaccaactgggggaagcaagtatagcatccgcttttaatatctcctgaacaagagctttgtgagtgaaaactgctttacagtgctttattggtttcatctattcaggcaaaacaacatgctcaataagataccaaattatcagatttttaggcctacactactacctttgtttgggagagaatcacacactattaggcttttagtgttgttcagacttcttttgtatagaatcatcagatgatgaactgaaatggccgggaccgagctc

SEQ ID NO: 713420 - DNA, 129 bp, Homo sapiens
gtgagaagagtaagccgcttacagaagccgcaccacagacagtttaatcataccgtgacaggttttacaacaggattagcaacctgaccctatcttacttaagcatgtcttgtgaccttgacagtgcta

SEQ ID NO: 713421 - DNA, 875 bp, Homo sapiens
  misc_feature (111)..(111): n is a, c, g, or t
gtctcacaatgttggctcgcttgggaatctgtgaattcttagactgtctccgagctcgaaggcgtaagagtcatggttacaaagtaagtcgaagccgagttatcatgtccntccaagtccctacgcgacaattggtgacacattgctgctgatgtgcttcatggcgcacatgagctattttctctcgaaggagcaggatagaggaaactttagatccaattgatgaggtcgctgctactcatcgcagccaccattcatgatgtggatcaccctgggagaaccaaatccttccggtgtaaggctggaagtgagctggccatcttgtatgatgagcactgctggtgctggagagccgacacatgcggtctggaccttccagctgagccactggagatgatcaaatgcaagtatatgtcagaaagcatggagaggaagtgattatcggacgctgcgccgggggattatcgacttggtcttagccagagaaagtgacgaagcactttgagcgatgtcaacaacatttgtcaacagcatcaacaaaatccttggaaacaactagcaggaaaatgggggaaactggataaacaacgcaggcaagtcatcaaacgactatgcttgaggagtccgggagaacctggacctaaatcgaaagaatgttgattactcgtgctgatgtgtccaatacctggcgaccctgcgagtagtgcatcgacgtgggctgtgcgcaatttcggaagaaatatttttctcggcgaatgatgcagacgagcaggcagggtttactggtggtgatgccagtgtttgaccgaaatacgtgagattcccgaatccaaattttttacataggttattatccagagagatggaggctggat

SEQ ID NO: 713422 - DNA, 490 bp, Homo sapiens
agcttaaataatacctcgttcaaaagatgactaattgaggctccaaataccacctcccagccctctttaattcgctcagttgagaaagaggaagaggggaagaaactatggaaaatcattgagaggatggtttcctgtgtaattttgaatagattgtgttgaacatggaagacaccggtgttacctattgtgcgtttcctttaaggctgttgctgtgtgtatgtcttagcaaattcagattattttgcactctcaaaactgagagcttgcttttttcccccatatactttcttacatgaccagtctcttagatggttgtgacattgtagtctgtataatgaattcctgccttggtgggctttctggttcctttgaaccttagggaaaggcttggttagtttccatttgctgtgcattggctgagaagcagagataactgagtgaaaggaaaaacacttcttgttaactgtatagtggaagcttggaaaag

SEQ ID NO: 713423 - DNA, 1410 bp, Homo sapiens
tttcttgctccctgcttttctcttctgtgggatgatctcagatgcagggagctaggtttatgggagttaatcctagcttgtgccaaggtgctaggacactagctagggtgggctaggcaaagcccactacccattcctagtcctatctagtggcctccatcccctcatgggtgctgccatccttcctggagagagggaggtgaaagctggtgtgagcccagtgggttcccgcccactcacccaggagctggctgggccaggaccggtgagagggagcactagctgccctacactggcccatgctccttaccgcacgttagcgcggtggaccgacgccatcgcttatcacccactagttatcggagcggaagggcgcaagcgaggggcgtctaaccagggcataggcagcacaggcatgagagcggatgctgggcgtggcagcacgatgacgatcacagagagggtgcctcaatggagcgtcgggcaaggccctagcgggttgcaaatagcagaacagggccccagcacaccgtgcacgggacatgccgagcagcggcgcacacgctggtcccaatgagctgcacaccgcacgcggggcacccacaccataccctgaggcggcactgccctgagcgagctagaaccgctcacgcgtgcagctcgacgacatggcgccctggcacccggacagcgggctacacctggcgggaagccccttcgaacgcggtacatctcaatctggtgacccctcgctggtaactaccacactataacttacccaccgcggacacaccacggcccttaaagcgttcatacttacactagattccgcggcaccctggagtcacccaacaagggatacttccacatacctggagctccccgtagcctacccatccaatttggctgactcacagctagaattggaaacgcgacacaaccacaaaggccgaacttgacaaatcgcacgccactgagcgaatccacccaaatcacctcacacagccgccgccgccacgaccacgcctctccactcaacagcggcttgcaccattgacatcacccacagcatacaggagacaaccctaaacaggccactactcagatcccacagtagccccatcccaggaacaaccgacaccgacgactcagggcgctcgcacactgcgtcggcaccatctccgcccacacagccaccgtggagtcgtaagtactacgaccagcatgaggacgacgcgatgatagcacaaccaggcgccgacgtcgaccgtgcaagccaactcaaactgagccaggcgataccatagctcacacatgacaccatcgcgccaccagaacgccgccatccagcctctgctcgagacgccacaacacctcaagagccactgcagaccgccacgtgcatcgcac

SEQ ID NO: 713424 - DNA, 140 bp, Homo sapiens
catgtgtaatacttaaatggagaaaagtcaacgcaagtatacctgctttccctccttttgtaagagaatctgtattttgttcttggcagttccactgccccctacatggtgcgtggcttcatgactctgtggccatccct

SEQ ID NO: 713425 - DNA, 100 bp, Homo sapiens
gtgtcggaagcctgtgatttcctaggaaaggatctgggttaagcccattagaaaaatagcagtttacagcagtgtcacactgagctgcctgagagggtac

SEQ ID NO: 713426 - DNA, 374 bp, Homo sapiens
  misc_feature (63)..(63): n is a, c, g, or t
gcgcgcggttcggcatgcaacccggcatgcagccgttcattgcaaccgagtagccgccgtcgncacgagcgcatgccccgacacatagctggaatcgtccgatgcgaggaacgcaacgaccgttgccatttcgtcggcggatgccaggcgtccggccggtgtcgattcggcaaaagccagtcgcgcttcgtccgatgcccagatgccgcggtgatggaacggcgtatcgatcagcccggggcacagcgcgttgacgaacggccgcgcctggaaccatttcgattcgacgccgtctttcgtcatcccgattcaccgcgtgctttgctgggcgatattaggaccgacgcgtttttcgaagccgatggacggccgcc

SEQ ID NO: 713427 - DNA, 960 bp, Homo sapiens
  misc_feature (391)..(391): n is a, c, g, or t
ggaaccaggttgaagagtctaccctccctttagcaggcaactggtcccaccgctgtgagcctccgtggatcttagaccagtacttctccttacacctagcaggtatctcctctatctataggggccatcaatttcgatcgacaagcgaattagtcaagtataacaatcgccctgtccatatacccagagtaccaagaacgcgcccgtcgtgtcgttctgaatctcgtccttagattctagctagctatgtcctagcttctgccgtgatcatctcccgagttcgctacgcggtctggcggtcaacatctagctactagagaatgaccgacaagcttcaaggagcgcaccgtgtcttcggatccccgcgcaggacggaagggatgacgcgccnacttctgagtagcacaaccaccataattctggagttcttgacggcgtcaccccttgcaagtttatattcgtatatcgcgtgaccgagtgctatcgagaatcacatcgtcgcgcatgatgtggtatacttgacatactcctgtgaggaagacacgaacaccatttgggatcactgtcaggtcatcggtctagagcgtatggatatctaatgtgggctgtccttagcggtttatcgctgtgagcaacacccatcatatttaacaagctcaggcacatcagcaccgtagacacactgcagcatattatcgaccgtcctgcttaggcaataaatcgattcggcatgatcgccccaaccgtggcgtccaagacgatatttttaaggcgttgacttgcgtcccacgagcttccagcgtggaacggcaactacatagaaatagtcgaatcgtgggtggccggatgcgtcccggaagcccttagggaattccactctggtgtctcattgtcgccggaacgaggtgagcccttgacactgggcattggatttgacgaaacgtcacatcactaataaca

SEQ ID NO: 713428 - DNA, 325 bp, Homo sapiens
tctagacgcgtcccaggcgctcctggcttcgatgcagaggctgtcgtcgcgaattcagattctacggttgcaactcgcacggggcggattggtgccccgtgagtggctgtatggcgctgccacgtcggtgttgtccacgcttggcattgcctagttcgttacgccgttcgcctgatgacgattggtcgccgccacggtggcagaaatcgcgaaaatactggagggggaatatgacacaagtacaacgcttcctggtgaagctaaagcctggtgcatcgcacgcaacgacatccctcgcactggatagcgggaagattcgcttcgc

SEQ ID NO: 713429 - DNA, 265 bp, Homo sapiens
ctgtgcatgctatgcatgtctatcaggattcctaaatagccgctagatgatcttcacaggagtaatagcgatcatcccctgtaggaacttagcaagaattgtcataaacctcttcagcatccagaaatccatagtgtatccttggatgctcgcaaagtgttccttctcccacatcagtggacactcctcagattacacacacactctatacgatcggcgtgcttgatagtctcatgtgtatatatctacatatactacagtaacg

SEQ ID NO: 713430 - DNA, 708 bp, Homo sapiens
  misc_feature (364)..(365): n is a, c, g, or t
tggagatgcttctagcctcccagtaggaggccccagccatgccttcaaccgtggcaggaggtgtagccactcctcatcctccctgagtgctgatattctctctctctctttctcttcctcttctttctctctcgttctcctctgtttctctcctcgtctctcttcctctccgtctcttcctctgccttctctcttgctctggcctctctctcttcctcttctctctcttcccctccgtgtctcctcccctcctctctctcttcctctcctctctcttcctctcctctctctacccctcctgtctctcctcccctcctctctcttcctctcctctctctcttcctctcctctctcttcccttccnntctctcttcccctcctctctctcttccgtcctctatctcttcccctcctctatctcttcctctcctctctctcttcctctcctctctctctcttcctttcttctctctctcctgtctcggctgttgtgggttgcaggttgggtgctgctgtgtggtccttcccagaaactgccagtagagggcagcctgggcatcctaatgcttactctggttgttacacaaagaaaatatggggtcactggcgagcccacccacactcacagaatctccagtgtagtcccctaacaaacagccttcattcctcttccacttcagcaattgtattctgatgcattggctcaga

SEQ ID NO: 713431 - DNA, 143 bp, Homo sapiens
agttgctgaagcttatgagtactgttgatcccaagttgaatcatgtagctcctggcctcgtttcaccaagtctgaaatcggatacctctagtaaagagatagaggaagctatgagaagagtacgagacgcacaggcctcattc

SEQ ID NO: 713432 - DNA, 259 bp, Homo sapiens
gatttatttcatagtggttttaactgacatttccatgaacattagtgatgtgcactttagccatttgtatgtcttcttttgaaaaacatctcttcaggtcctttgccttttttttttttttaggaaagggggctccacttttgccccccaggttggggggcaggggcccaatttcatttcaaaaaaattacaacttttagggcccttgcattttttttcccagggcccccaaaagggttgggattaggggggggacccc

SEQ ID NO: 713433 - DNA, 114 bp, Homo sapiens
cacgggacgaagagcgccttaaacgcactatgctctcaaaagtgggccagtaatatccaggacagtagtgcttgcacagcagtggctccgaccggaccagtctgagcattagat

SEQ ID NO: 713434 - DNA, 2290 bp, Homo sapiens
ccatgtgaccctctgactcaggttttgtgttcttcctagtggaaggagcctgggagaggccaggcctccccggactgctagcctgcttttcctggggtccctggagccggaggaagaaccaggatgttgctgcctgcagaagctcagctcaggaagacttccaggaacctgaggaggagctgccactaacagccatatttcccaatggagactgtgatgaccttggaagggggtcaaaagcctgtgatggagtcgtacacactcctgctgagcccaccggagactcaagatgaaggctggacccttgcgctgtccctggctctaacctacagactggggcctggctccgtcttactggcccccaggtctccatggagactgcagaaacccccgcctgctggaggcctgccacactcacagttaccagctagacagtggggcttactaagacaagcaggacctaaaacagtgtctcccctgggaacctactccccacccacagttaccagctagacagtggggcttactaagacaagcaggacctaaaacagtgtctcccctgggaacctactccccacccagcatttgctaagtctgatcacagggaggttattttgtctctctgtctcggtttctctgagccactgagacagatggctgtccgctttgaggctctgcagagctgtggcaccccatggtgtgtctgcagtgttctgggcacatgcatgggcacccatcgttgagagtgcagctgggaagaactctgaaccagaagtcatcagagctgaggcatggccttgaacatgtcactcagtctctggggcttctgtttcacaaatgcatgagggggccaccagcccagtggctttaaaccaggggcaggttgtccctccaggcagcattggaaatgtgtgtgtgttgagggggtcacagtgactgtgggggcacccctggcatctagtgggcatcccacaatgtgcagaacagtctctgacagcaaagaattggtccattcaatgccaattgtagtacctttgagacattctggctgagccaatgccttctccctgtcagagtcccccagagcagagagggtcaggcttccctggaccttggctcccagagcaagccaaaataaagactacactgttgccttgggggcttgtcgggccagggccaagacggtctgcgtgctgcagggccaggacagaaatagccacacatgccggtgagaacaaagagcctctttctttctcatgttgacatcgactttctgtgccaagtcctttgggtataaggatgctagggaattcctataggcaccaaacagaaggaaagctaggggcttggactactgggtataggacttgctctagctctcaggtcctagcccaagctcaatgcaaacacagcccctccgggctctctgtttctgtgaggttctggaatcccttcctctgtgtccgtgagtctgacagaatcgatgatgttcccttagagctgggaaatccatgtgtttattcacggagggaactcaccattacctcccttgtcttctttgcctgccttggagaaatccagagtcttcggaatggcaaaggcagctcctggatttccctggaggggaggcactagctgagggaagtagctcccttcattcatgatgcacagtttacgcagcagacacacaactgcgcctactatttgctcggtgccctgcaagtgctgcctaactttgatttgttatttcagctctctccaggatagtgccaaatggtgcaatgggaaacctgttttgctggggggctctagatcactggctccagaactcccggctgccagggtagcccctacccccagccccttgctcctggacagcagtgggtctcacctttagcctctgcccccagttctggtctgacccaacagaggggctctatgatattaagaaggggcccttcctgctctgtgcctcaacctattctccataatagggagtctaatcctattccttccctgcctgatgaggatggtgtgaggatgaggaggacggcatctcatttggggctttttggcagtgggcctcattttaatcctgcagggctgcctgccagtggatctatccagctgcttccttgtagccaagaatgagttcaatgaattgtgattcactgattttattgattttgttttaaaacagggagactggtatttttgaagctgctatcattttctatttctttattaatttctttgtaatcatcttattaaagttttcttatttagtggg

SEQ ID NO: 713435 - DNA, 193 bp, Homo sapiens
aagcgcacacgagaccctggacatgaatgaatcaattagattacccacccatccatccggggcaggacacatgggctgaactgggtgctggaggtcgcgggcagggccatggcaggcaccagtgagctgcctacccgtctctggcatgtggctgctcctgatcctgggcccccagaatggaagtcaccttctc

SEQ ID NO: 713436 - DNA, 720 bp, Homo sapiens
tcgactggcccggagtcttgggtcctacctggacatctgttgctccggtgcatgctgctgagcgagccacaggcttcggtgtggccctcctgctggcgctctctcggccgtgcctctgaggaccgctctgctgaacctggtgtccccacctgggactgtgaggatggatcgtcgaggaggcgaggacgtggggacgggactccaagagacgcaggcttgtgcgagcctcctgcctcggccctgacaacacggggatcttgttacctcactgtgcacctgattaattttaagcaattgaaagatccgcccttcatatgggttttcggtgttgtactttcctggtcgtcagcgctgcgtggtggaaacagctgaagctttctaggagacagacttagggtttaggtgcagggccacggggaggggaccgggaagcgctggggcttgtttctgtttgttacttacaggactgacacatcttctgctcaaactgtctacccctggggccttccgctaccccggggcgaggcctcactgcctgcatggtgcccttgtcccagccccaggtcccgtgcagggcacctgcgtggctgacaagccaggctcttacctccagccggggctgccagcgcatccagccagcccacgccctgtgaaagatggagctgacgttgctgtaggggacctgatttatagggtaacgagcaagtcgcactctgcctc

SEQ ID NO: 713437 - DNA, 432 bp, Homo sapiens
tcatagctcttgtggtgcatccataaaggccctcatgctatcttcaaatgtatcttgtatgtcgtctacgaagtcgttggttgcaaatgcttccaattctctgcagtccataagcgcttatcacactctcaccgctttggctcaagagatagtctacatctggtcacatactcattctgaactaggtgagactgaatggcgtccacagcttctgagccgtcatagctgtcagtatgctcgtttcatgctgagccatcgtctttcctcatccacgtgtgtgtgcagagtgtttatgatgctgccccacacatacgtgtctgcctatggcttctgatgtacgctcaagcccgcagccctgtgccctgtgctgtccacatccgagaggtccagagcaccagccctttcgtgctcggtgaccaagacccttgctac

SEQ ID NO: 713438 - DNA, 742 bp, Homo sapiens
caaaaactacattacatataataagagtttagttccttctacttgaggtgtgacatgaacgaaagtaatggaaattaagttctgccctcccattctcgaaggtgaccagaggggaagttcacagtatagaagcaggaagtgattctggaagttgacactggaatctcgtcactggcatcccaaagaaatgactgatctttgtcactcttacctgtttcattccctgggggcgagatacaaaaaggactgcactccaaagatcggacatgaaccaagaactgggtttcatataaaatattttattctgtcctcttgagatgtgacatgagaaaagtattgagaatacttctatcgacctcatgcttcaagaatccgtaggaattctcccatggtggacttaacggttaacctgaacaggtcttggaaaaaggactttaaacattctcctgttctgtggaataagtatacgtttgtgctggacgatacaccttgtcagtgagttccatgtgatactagagttgcatagatttttaacctttacgccagatgaagatctgaggcaatacattgcccttttgttagaagtattgcatttggtcactgataactgtgataattgatcttgttgaaaagcctgggatattgaagatctgatatgtgattataccgggtttcctcaatgaaaaaagagtacaatgaaaggaggctgagaatttggtgcttttcaggggttggtgatgac

SEQ ID NO: 713439 - DNA, 399 bp, Homo sapiens
caagtagtcaatcagcatgctatcgtatcttggggcagatttataaggggaacgggaaggcagaacagaggtgagtaaatacacgttgaataacatagactcacgttctttcttcccttcagtgtttgctgtgtaggctttccttgccatgtgaccctagtattcagagctgtctcctaacccgggctgatgaccgcattttttacgagataagagatgaaaggattttgctaggacagcccagtgttgtattttaaacaagtctgcctcacaagtgtgagggccacaacaatacactgactcttattacagggctgggtaggatttgtagcaagctgcctaggcagtacatttgggtctagcaaataagtttgtactcactaccccacagagagagcg

SEQ ID NO: 713440 - DNA, 87 bp, Homo sapiens
  misc_feature (87)..(87): n is a, c, g, or t
gaaggccagcaacccatcgtcagaaaagttgtggagcatggcctgtttgtcaagcactgcaaagtcgaggtgtatttgctggaactn

SEQ ID NO: 713441 - DNA, 185 bp, Homo sapiens
tggcccgagcacccttgaaatggttccctttccttttttgtaaccagactttgaaaaattgtttgttttatcagggtttgttcctcaaaggccttttggtaggggcctcccgaaaaatttgtttttttgtataaaagacaaagtgttgaaaatgtatttcctgaaataaatgtttccaatgcaga

SEQ ID NO: 713442 - DNA, 112 bp, Homo sapiens
ccttgttcccatttactgtcaggtccattttcgttagaatgacaaggattcacctttaacatctttttcaaaataataagccacatcagctatgtcccgtggggtaggaggt

SEQ ID NO: 713443 - DNA, 1928 bp, Homo sapiens
ggagcagttcaggcaggtccctgacgtggatctgatctcattgacttcaactagtagttaaggacggaacatgatcctggtggactctcttccagcactccgacactgcccatccgacttatcctactcctgcattgcaaccgtccggagtaccagtcattcatcggaccatcatccatgccttcgtgcggaaaccgtgcacaagcaacacgatatattatgatggattcagcatccatatcatttgaccaagccacagcacaatgaagacatcaccagaatatcagatcaggaaaattactttcacgaacctggaacagataggaaagagacgatgcccaggtacaaacaacgcaccatgggttccaaaatataatggtcaccccttgcaaggggccacatcactatacacccattaacccatcttacattccttgtgcgcatatacattaatttatcagaccactgcaagaaactgaacctgtactgagctattcattgctgacaatgggagctggtatgcagtgcacccaacatctctacaatttcctcatagctggaacaccgttggtgaccccgtcacgacggcacgcacatccgccggcaagaacagttgacgcgctaactaggtaagtccaggttcacttcaccgttgaagcgagcaagtggccacacaccaaagccaccaatatggctgacttggtaccatgatggcacctcgcaagatcacatccgatcactctccccaagtagacaacgaacatcgaaacggcaagaacgcccccaacgccgctgtacaacgtcactggcacggcactggagcggcgactaacaacacagcaagccccaccaagcagaacgacggccccaccatggcaagcagacgcgcgcttgcaacaagatggcggccacgccacgagtgtaggcacggcaccaacacacacaccggccgttgcgcacaccgaaccgacggagacacaccgatcaatcagctcgcgcagtgtatcccgtcgtcacaacttgggacaccgcgctgtgtagcgactacagcccatgaaccccacggccacgaccgggaccaacaaccgccgacacaagacagatcccatgaggagagtaccagctgaattcgcccatgaggacacaggaccacacaacacctcgcccccacaacagatgaccagcagcacacgcgagcaaacgacgacaatgacactccaacaacgacagcagcaaatgggggcgactgacacccaaccacatgtgaaacacccaaaagacgacgacaacaccgcggcaccttgtggacactgcggcccctgagcgactgctcctccgctaggcacaggagaccgcagaacacactgacaacgcagacataacgacacacaagcgggcgacgatcaacgcgacgccgagcaagcgacccgacagagaccatacagacgcaccgcacatgatctgtgcgaacgaccgctcacacgcacacaacactccagtcgaacaacgcgccctcacaccacatgcacagcagcagcccagcacacgacgagcgacaacaccgacgcaccgagagcccaccacgcacagactcccaccaacaacgcaccaggagctgacacaatgcactcgacatcattctcgacacacaacccgtccgtcacgacacactgcacgcaacgaacgcacccagactcgcacaacgagcaaaactagataacagacacagacacacaaggcagtactcgcacgacacgaccacgaacacgacaccacgacagcaacagctcccgacgcgccagcccacacagccgcacactaaagctaacaacgaacgagaacaacaccacgaacgtagatgacacccacacagcaagaagacacgatccaccacacacgcagcaccctcgatctaccacaccagactc

SEQ ID NO: 713444 - DNA, 131 bp, Homo sapiens
aaggggggggaggccaaacccccttttttggggggggggttttcccctttttttaaaagccccctttttcccaaaaacccttttttttttgaaaaattttttgggggtttttttattccccccccccccga

SEQ ID NO: 713445 - DNA, 164 bp, Homo sapiens
ggctgggactaacagaagcatgccaccatacctggctgatttttgtatttttagtagagattggggtttcaaccattgtttggccaggattggtctttgaacttccaaccttcaaggtattttgcccacttcaagcttcccaaaggtgttgggattcaaggcgt

SEQ ID NO: 713446 - DNA, 107 bp, Homo sapiens
tgaaacagaagtctcattctgtggtccaggactgtactgtgtgaaccccactgactaaattagtgaaaaccataggcgtggaaatttctcaccttttacaatgataa

SEQ ID NO: 713447 - DNA, 206 bp, Homo sapiens
atcccgtgtaaatcattcttaatataatctgcttgatagccctggctattattgccctcttacaggacctgtagatactcagggcttactctatacaccaatgagtcttctattgatcctaagaccaccactgaagttttttatgttcttttggacaaacatgcatgacttcttcagatactttttttttacctttgatggcagca

SEQ ID NO: 713448 - DNA, 986 bp, Homo sapiens
  misc_feature (132)..(132): n is a, c, g, or t
  misc_feature (159)..(159): n is a, c, g, or t
  misc_feature (197)..(197): n is a, c, g, or t
  misc_feature (208)..(209): n is a, c, g, or t
  misc_feature (231)..(231): n is a, c, g, or t
  misc_feature (257)..(257): n is a, c, g, or t
  misc_feature (261)..(261): n is a, c, g, or t
  misc_feature (270)..(270): n is a, c, g, or t
  misc_feature (279)..(279): n is a, c, g, or t
  misc_feature (285)..(285): n is a, c, g, or t
  misc_feature (457)..(457): n is a, c, g, or t
  misc_feature (483)..(483): n is a, c, g, or t
  misc_feature (501)..(501): n is a, c, g, or t
gacgcgcaataaggaggggcgaaaggacatttttttttttcttgctcccgcctctgttcttcccccacctgccacgtacagagcccaagttctccgctaggcttgttgggtcagcgcgattggccggggccngcgcgagcctgcgagcgatggtgcggnggttgcgaaggtgcaaccgagcgggccgtgaccaccgnctccccgcganngccccagtccagtggcctcgcngtccgcccattcagcggagacctgcnggangaggcggcngtgccgggnctccgnaagccgtctttctctagagttgtatatatagaacatcctggagtccaccatgaacggacagttggatctaagtgggaagctaatcatcaaagctcaacttggggaggatattcggcgaattcctattcataatgaagatattacttatatgaattagtgctaatgatgcaangagttttcagaggaaaacttctgagntaatgatgaagtaacaantaaagtataagagatgacagatggcagatcttcataaccacatttgttgatagttctgacctgttcctttgcgaagtgtcaggtgcagtaggatactgaaaactgacgattgatttgtctaatgggccaggccagagaccccctttgaatcgaagctcaggtgaaatatcgtccgtcgagaactgatagaacttcgagaataacagtgaatcgtttgattggatagcttggaaccacctggagaaccaggaccttccaccaatattcctgaaaatgatactgtggatggtagggaagaaaacgtctgcttctgattcttctggaagaacaggctactcaggtgatggcagcaagtatgtctgctttgatcctttagaaaaccaagatgaaatcaataaaaatgttgtgtcagcgtttggcttagcagatgatcaggtttcagggccacccagtgctcctgcagaagatcgtcaggaacaccgacg

SEQ ID NO: 713449 - DNA, 120 bp, Homo sapiens
tggtacctaacacaaagctgatatgtcgtgcgaaccaggcgggaaccgaatcacttttgggtcatcaaaattgcgcaccacaatcggcaccactcctatagatcagtccgttcgcatgtt

SEQ ID NO: 713450 - DNA, 870 bp, Homo sapiens
gccggatcgcgagcagtagttgggtgggcgccatggttgggatcaccatcatttgtggtggtgaagcgcatatcatccaggttctgctacacaagactgtgcaagatgatgcacaggagtgagctgagcgcttccgagcgattaattagtagaggagacatggcgtggtcccgtgcgaaacaggctgtacggcgtgaggtggaactcctattacatccgtaggatccagctggatttgaagaagacgctgtaccggtgctctggatcgcctggcctctgtcctgtatactggtctggaccgaagtctgcatagaatacgtcgtgcctgatgaggagtgatgcacgacggtatgaatggttgtcgagtggtcggggctcccgagtcttatcatgaaaagtcgctactcaccatgagaactcccgaaggtcgtcagaagactgggctgcatcggtgagactgaacgtgggtaatacgcgcacagatgtgtagatgcatggtaggagtcgcggtgcgtaggctgttgcactggatgaggttacgatggcctacatcattggtgtctttcggtggactgccagccctacctgttggtccatagagtagggaatagatggctagatacgaaacgtgaactggacccatgagggcttccctaggtggtctcgacgctcgcggggccttgtgtcaaatagcgtacctctactaaaggagaggaaatgaattgcccttttcgattgacaggactctctcccattacttgtaccttgccgtagacaacactacggcagcgcaagagagaccaggtccatgtcgattggcaggagccccttgggaaggacaacacaggagaggagagtgtttgctggaac

SEQ ID NO: 713451 - DNA, 883 bp, Homo sapiens
gctgttactggtcctggaatttataggcatgtggaaggttcgtgtgctagattagatgggcgccaggtgtcgccggcaggtaaagcatggatggggtctattggagtggcctttgagggaacattgagtcctattcttgttcctgcctgtgtgtgcctcgatgtggcggcttggacgccccgagatgactggcctgctgccctagtgcatgggccggcggacgattgctgcgtgtcctgctcctcttagtgcccgggaccgcgggatgggttgtcggcgtgaccagtgacctgagctccctgtctctcctcagtgacatcgtctttaaaccctgctgtggcaatccctgactgcaccgccgtgatgcccagggaagacagggcgacctggaagtccaactacttccttaagatcatccaagctattggatgacttatccgacaatgttcccatctgtgggaggcagacaatgtgtggctccaagcatgatgcagcgagatccgcattgtccccttcgcgggaaggctagtggtgctgattgggcaagaacaccatgatgctgcaaggccatcctgagggcacctggaacaacaacccagctcttggagaaacttgttgcctcatatccgggggggaatgtgggcttggtgttcaccactggcaggacctcactggagatcaggggacatgttgctggccaataatgggtgccagccttgcttgcccgtagcttggttggccattgcccccattgtgaaggtcacttgtgccaggcccagaacgactggatctcgggccccgaaaagacctcctttattcccaggctaaagggtatcgccactaaaattttccagggagcaccatttgaatccctgcatacgtg

SEQ ID NO: 713452 - DNA, 674 bp, Homo sapiens
gtgtgtctggtggggatatggaccgtttaaacgtccaagatgatttgctaagactcagcagcatgaacacccaatttgctttcaataagacaactcctctcatggcaattatgcatacaaatcgggttccgaggctaataaagctaagatgagtcagtcattccttctttccgaaccagcttcgctaaagttagacatttgtcatttcaacatgagaaatagtttgcccacttagctcattcgattgataaatcgttcagattagttcctttttagacttaaaccacaggttcaaagcatgcttttcatgatttttttatgtcaaatgtaacatgtatggagtcacatgtagtgccatatgactactttgtgtataaagatgttgaaatcagtggaagttctccataaatcaaaggaacaaagcccatttatgatgagaaactaacaccaatttctgtttttaagaggaaaaagaatgactgatgtaccctaagtattgttatgagctgtctctatttgctgccaggctttagtagcttgtgactgatcttcttagactgtcatcatggctagggttctgtgacgtatgttacattacacccccctctcacaggtcgagctaaacagaaaaaaaagctggagactacctggtccggaatcctgcagcccggggg

SEQ ID NO: 713453 - DNA, 1410 bp, Homo sapiens
ggcgagagagagagagagagagagagagagagtgggtgttagactgcagggcaccaccagaccagtctcttcgctggtctcactctcgtctgtctgcgatctctatcgtcttaagcagacgtcaggcgcgaaggacatagcgtcttctaatgatgtccccatcttctaaacccaatcctaatatggcgatgtggaagtccaatgtgggaatggaaaaacagggtcgttacatcgatatctagctgaattcgcacagcctttgtgatggacacaggaaaatgttctagaagtccgcgaagattgtgatttggagtttgaagaacagtgtgaggaggttgtggagctaggattgaatggcaggccgagatagttaagatcgtgcatgagagttgtcagtgttagcgaaggaatgaaagagaggagggcgaatgatccgaagagatcagttggaagacgatgatttacctttgcaagtgtagggctatgaagagcaatattaggaacaaccatatagagtaataatgcgttgaacaaattagatgaaattaggcaaacgctaccaagggactggggcactattgtgggaaaatggggaggcatgtcgagaaaggagtaaaaaagtgtgagattatcaaaaaaaagtaacactaataaagaggacaatcaagagacaagagtttaatattgaaaaaaggatttcagaatggaatatacgatataataaatatctgttaacattggaagaagagaggaaggatataaaaagcggatgatccaaacgtgataaagttcacgattcgacgacggatagtgaggtatagcgaacgaagaagaacgtaaaataagaaaaatgggacaggaagtgactatacgcagatgaagaacgtgcaaaagatctacaagcagatctgtagtagcaaggacatcgaatgggggtggagtgacaacgaagtgaaaacaaaaatgtgaacagcgacccatgttacactccccgtaaagacatagtaggaccatctgaacaacatgtgaattatggaaacgcttcacaaaggtcgaatgaatgggaataattgattcccaaggaaactaagatgaaacgacggaaacaatgccccccaggagaccaagaccaatgaatgaactcaacatctgtgacaacaaccacatcaatccagcgcaagataggaccgaagcgacaaaaccagacgcacccactacataacccgccaccgatcacaaaacacagcggacaaaacaaaaaagagaacaagccactgagcagacacacaccgtgacaacaaactaagcggacaacaaaagaaggaccgagcagaagaagaaaaaacaggacagaacaaggaataacagacacacaaaaacagagatagacaggcagaaggccaccaccag

SEQ ID NO: 713454 - DNA, 191 bp, Homo sapiens
cgtacagaaccacgagtcatgctcctaatctcgagaagactcaggttacacactatgcttgatcaagaacttttcgttgccttttttacttggtatcattttggtatgaactaactccatcaatagatttctatacaagctcagtatctcaagtactatcaacacttgtcacacattatccgttccaaaaa

SEQ ID NO: 713455 - DNA, 375 bp, Homo sapiens
ggcgctggcaggcagggagcttcggacatagccgctgcttcgtgaggctggcttgggggtggcctaatgccaccatcaccacttccctcaagagtgagggagaggaagaggaggaggaggaggaagaagaggaggaggaagagggtgaaggagaggaagaggaggaggacggggaggaggaggaggaggaagggggggaaggagaggacttgggggaggaaaggaggtggaggaggagggtgatgttgatagtgatgaagagaggaggaaatgagggagctcctcgggggcttgagctgaggactggccaggagtatgcagccgtgacttcggcttatggtgcccagagaccatgcctactctgctttctgaagt

SEQ ID NO: 713456 - DNA, 909 bp, Homo sapiens
gctgcggctgcagaagtaccgcctgcggaagtaactagccaagatgctgtccgtgcgcgttgctgcggccgatggtccgggcccttcctcggcgggccgagactggtcgtccagaaatgctatgggttcaatcttttcattagcttgcaaaggtaacttgccatgcctcgtaacactcatctatcaacaagactagggactagctgagatgtacctctagttactatgcactgagcgtacttcttgcgagctggagtacctctagtctagatcttgcaagaaacctgggcgcagtcttaacgtataggtgcatggtgattgccgcgcggtcacactagggcctgaggcaaatgtctcagagcagcagagcacaatgggtcagagactttagcatgtcaggcctatacacagtggcatatggtccttggacacacctgtggaaacgcgtgaacggatgctctgggtgcttcggtcagcgtgttcgcgggaacaatgggagtcacaaccctagactctcaacggcacatgggacgaactactaaggtagcatcacaacgcggaccaacgtgacggcccgactagtgtcagcgaacgcgtacacccaggatccggcgtggcagcgacgtgctgtaagcgcgactcaggaagggtaaggcctatcagaacaccaagctccccacacgcgacctgacgcactgggagaagaaacatcggaagaatgaggaacaacaggagagaggtaacacccaacgatagcgcgggcacaccagcacaaccgcaaacgaggacagagctagcgagacccaaccagtaccggggacaggcaggcaacacacgacgcgcaacagccgagcagaaagtcacgagacacccctcatcggcaaagactgtcaccacagcgcgaccgca

SEQ ID NO: 713457 - DNA, 407 bp, Homo sapiens
cggcgccacagcttctctcatgcataatcgcttcctctgagataccttccttgaatggctacctatttctcctaaagcacttgtcctattgttggaattctatctttgtctgttcaggttattaatatttatctctccaaatatcagagaccattcctgttatgctcatcactgttttcccagaacagtgtctggtgtatcatatggctcaacatgcaattgtgttgtatgatataactatttgactgaactgcattgcccactgttacaatcatcaaaatgagaatttgatgcccttggaggaaactgacttagccatgtcctaagctgactctttttatagctgtttgcttcatatacatttagaaaaatacatgcttggcctggtgcagtgggtcacatctgta

SEQ ID NO: 713458 - DNA, 741 bp, Homo sapiens
ggcgaggctgggggaagcggggcccaattacggatcccgggagttacaggtgccgacgtgatgtcgcttctctggtgcccagctcccttcctggtctggagactagctctgggggtgggggggcccccacacgctgtccccgttccaccctgcctgtgctggcttgtctgtgcctgtgtccagagccctgtgtgggggaggatggtggccaccctgagaccggggaggagacgggcgtctgcctgggttggcgggagaagccgcttaatggggttgtggtcggtccagacacctttgttctccaggggggatgggcgtgaggggcaagcaaggagaattccccaccgtttgagcaaagaacctttttctgtgttttaaacacattcagggtccttcatttttcacatggggaattacaaggtgagtttgtggaaaccttaaaaaaaaaaaagaaaatagcagaaaaaacaatttgtggggcgcctgtggcccggagaaaaggttttttttcgaaacaccaatcgtggtggggggggcggcggaccccaatgttgagtttatgtgcaaagtggggtcataagcgtgttcacgagggagaatcggtggtgagaagacggtgtgtgtttttcccccaataaaaaagggcgcggggagacagggggtgtttggaaaaattcgagggggtctgaggacatagggggtcttgagagggtcagggacggattatgtgggcgcgtggga

SEQ ID NO: 713459 - DNA, 343 bp, Homo sapiens
tgtctgcagcttgtcctgctacatttcctggttccctgactgggaagtgaggtgattggtggatggtcgaggcagctccttaggtgacttaagcctgccctgtggaacattccggtgggggactctggccagcccgagcaacgtggatcctgagagcactcccaggtaggcatttgccccggtgggacgccttgccagagcagtgtgtggcaggcccccgtggaggatcaacacagtggctgaacactgggaaggaactggtacttggagtctggacatctgaaacttggctctgaaactgcggagcggccaccggacgccttctggagcaggtagcagcatg

SEQ ID NO: 713460 - DNA, 267 bp, Homo sapiens
aggaccggggaagggtggcctgagagcagcgatacctctggggtcactgtccccggagggacttcacctggaacaagagctggcaggcagccgcttgccccgtgaggcttgtcccctgcaggcgcttcgccggtgagtgtgcgggctcggtggcctctaagtctctcctgtgagcacggtgctgcgcgtgcgctcgtcggcttaccgcggcggccagtcccttctgggtcgtaacgggtacctgagctcaaatcttcgtaatcctag

SEQ ID NO: 713461 - DNA, 274 bp, Homo sapiens
aacatttgtcttattcatatgttttgcccctacatattggaagaatatttgatagactcatttataattccacaaaatttgaaacagtatatttttacataggcttcttttttgctttgggtacagggtctcattgtgtcacccaggctggagtgcagtgacatgatcatggctcacagtagcctcaacctactgagctcaagcaatcctcctgccttggcctccctagtagctaggaatacaggcatgtgccaccatgcccagccaatttttt

SEQ ID NO: 713462 - DNA, 157 bp, Homo sapiens
acaacttcgacgctcggaccaggagcgggggaagacaggatacgatggttgctgtggagacaggatgcggagttggaaaggaagaaggagctcatgtgccaggaacagattagcaggtggggggtctcaagtacgagttattttccagtgaaaacag

SEQ ID NO: 713463 - DNA, 561 bp, Homo sapiens
gtagcatggtggtaaatctctagaacataccaattatctgggctacctcccccgagcacatgtgacgcatgtggatttccaaacatgccagaagtgtatggttcccaactgtactaagtaggtgggaagctgaagtcctcaagtgtacatcttccaacttttcccagtctgtggtctgtcttgggatccagccaataattgcctgaacagctcactatggcttcgttgcttttggtctgtagctctctgagctcctctatgtgcagcaatcgcagaatttgcagcagcttcattaagacactgcatctcctgtgtcaaaaccacgaatatgttggtctacagcaacaggtaagccctctttggtatgctttggccttagcaactgcatcctgtgtcaggcgctcctgaaccaaaatccgaatggccttaagcattacccaggtaatcatcatgacgctgaatctgaagccaggtaagccaaagccatcacaccagccttaaaatcaggatcatttactccaaatggctcaatggtactgcattttagttgcatagtccgca

SEQ ID NO: 713464 - DNA, 228 bp, Homo sapiens
ccctcgtagctgcacgaagcgttcagtacgggatagccctctgccgagggctcacaatgatgctgttggcattttgccccggagtttcaggtcctggcttgggcgtctctcctgccaggggctctgaccctatggggtcacgtggccccagccccttccagagcgctgtgagactgccctattcccgcgctggctctgcaggggccgcctgggaccgagcgctgtcca

SEQ ID NO: 713465 - DNA, 791 bp, Homo sapiens
cggaagagtgggccgttttaagaacccgccggggggagggattcccctctccaaccgggaaatacaaaggtggccaattataataggtccgggttctccccaagaccccgaggcttgttggttttaaaattccccgccaagggtttgggggccttgggacgtatttctttttggtaaggggccgcttattttcggggttttggccaatgtttggggttaaccctcatggaaggggccataaactgcagttcctctgcagtgtcgagcactctagaatgattggttccacgcggctcaagaatacggccccaggagctgcttgttcagggtctttcagttagagacatcatactgacttagcgtccgccatcgtaagacggtgagggatcatctagacaggtcattccacagcaaggctgtgatgagcagtatagtctcgtgatgtatcaggtcagcaggctcacagtcactagcattcccctcacatgggccagtaggaaatacagccaaggtattttgtggatgtgacagaaagtacattccctatagggctaagtccgtgggatagtctcccatcactgtgggtgagcctgacaagatcagtcctaaggcctatagttcgtagctaagggtttccgtaaggcacaggctctgcctgagtgcaccagtgcagtgctcgcagtgagatcatcgcgtcctctctttttgatagcttaccagcgccacgtttaagcctgtaacagccgctggtgcgtacgctccagccttcccgttgcaatctatctcaatgt

SEQ ID NO: 713466 - DNA, 204 bp, Homo sapiens
gtggaactaattgcccgaggctcagcaaggccaagaggagacagccgtgacggtaaacctcccctctaccagcctccaagccccacgccagcgagcaggctgcctgcccaccccgatgtcccccagccagtctgctgtgtcaggggcagtagcatgtccaacatctgttatatagatgggggtttttgccaatgcaactgagtg

SEQ ID NO: 713467 - DNA, 155 bp, Homo sapiens
  misc_feature (1)..(3): n is a, c, g, or t
nnnaaatgcagaccttaacaacctcaacttgccccatcacaacaggtccacccagagcttttaacgtgcagacaggcatgtgaacctctgataaagagagggaaaatggagaggcacttcctctgacttaatacaacccttttactttggagaaa

SEQ ID NO: 713468 - DNA, 149 bp, Homo sapiens
tagctaagtttttgtattgttagtagagagggatttgccatgtgcccaggcggttcacgaacgtcctgagctcaagtgatcctcctggcctggcttcctcttggcacacgggcgttattctctctcttccaccgaggacttctctgaga

SEQ ID NO: 713469 - DNA, 685 bp, Homo sapiens
ctgaaaacaccgtccgaatcgttcattcagaaatatcgggtcgactgctctgttgccaaaactcgagaatagaacttagacgtatgtctgagtccctgagatcacatgctaaagtcgatgaaaagtaaccactgccactgtcttgatgtcagaacttttacaggtacagaaaataacagaatagccttctgataatgaggcgtcctgttagagtttagcatgagattctaatacttaccgtaggacccatacctacgtggttcatctacaatggttaccataaaaaatctggcaggatttaagaagctcaagtcagctctatccttatgagctacgtgacttgaaaagaccagagagaaggaaacgagagcatattaagtccatgccagtgtgcttggctagagatatgatcaagcgactatgtagtagaccacaaggttgcaaagaaacacgtatgtcacgcgctagcaaacatggacgtcgtatattcctaaaacattactaaggcagcagtttgctcgagtgtcctaatccagctgactgtaattggaagggacacgaggaataacactaacccaggttagtctcctgggcacgagcaccgaagagcctggccgatggcgaggcagtcgctacggagccctaagagggccgcgatcatgtactgacccaggaccgggtgatc

SEQ ID NO: 713470 - DNA, 495 bp, Homo sapiens
  misc_feature (14)..(14): n is a, c, g, or t
  misc_feature (142)..(142): n is a, c, g, or t
  misc_feature (209)..(209): n is a, c, g, or t
  misc_feature (223)..(223): n is a, c, g, or t
aacaattctgggcncggtgaagcccatgcaaacagaattgcttagatttccaaagagggaatgatgttgccttcccctttaaccccgcgttcaatgagaacaacaggaaagtcattgtttgcaatacaaagctggataatanctggggaagggaagaaaaacagtcggttttccccttttaaagtgggaaaccattcaaaaaacaagtnctggttgaacctgnccccttcaagggtgcagtgaatgatgctcccttgttgcaggacaatcatcgggttaaaaaactccaatgaaatcaccaaactgggaatttttggggacataaacctccccagggctttatataccatgatataatttgaaaggggccgattaaaaaaaaaaaaaagaatttaaaccttacatgggtaaaggtttcatgttccctgtgagtgaaaatttttacattcatcaaaatccctcttgtaagtcatttacttaataaatatttcagtg

SEQ ID NO: 713471 - DNA, 367 bp, Homo sapiens
  misc_feature (259)..(260): n is a, c, g, or t
aagacacgtgtgtatccatagcctcagaccactagtagaaatgtctaaaaatgagaatgtctgaactactaagcagataaaagagaaaagaaaaataattcgtcactaacttggataagttatcttgtagggcaacaggtaacattttcaagaaagatacagttatatagcgatttcgctctgaacagtatgcgtgtacacgtatacgcgtaatgtgttcatggtattcatctcataccagtatacttttatctgagcnngcctactatgtgctcaggtggcttaacgatgcatcagacgaataacgacaagagatcctttggccctcaagggacgccttatattctggatagcagcgcatacacac

SEQ ID NO: 713472 - DNA, 575 bp, Homo sapiens
ggacctatattaagactccaatgcacccctcctccatcctctcaggatccttatggctcagtgtcacaggcatcaaggcgatagtctgttgacccttatgcaaggcctgcatggacaccaagagctatagataatattactcataatcagtcaaatgatccatataagtcaggctccccttacctggacaaccagcagtgaatgcctcttttgcacaatccttcacgggctttatcccaggctggaaaccatatcaaggccaagatctcaggacccatactctcataacgccaggtatgcatgcctacctggggcgtctgcccacagcagtgctgcagaaccgttaaccctcatttggacacgatcacttttgctgcgggatcattccctaactgctcctcagacagagtacaggaataacatgatttgttattggcctgtactatcatcaactgccagagcctcctgcaggaacaagggaaccctgaactttcattaaggagagcaagtttgagctctttcacagacccagcttacctgtgggtgctccgcgagtattgggctacatctgtgta

SEQ ID NO: 713473 - DNA, 697 bp, Homo sapiens
  misc_feature (635)..(635): n is a, c, g, or t
tccatttaaaagagttttataacgggatataaatatttaggacacttcagaaccaccttatacttctaatcagattgggggtaccgggtttaaaagtgtccactgtgaatattttcctcatacggtcttccaggttaaagttacttctcagaagacgtgttaaagaagagtgtcaatttggagtctaaccagttatactcctttaattacccgtgagacatcaatctccagtggaactagctttcatagtggataggtttaacagagtgctctctggatagcttgggcaagttgtgctctctcgtgatttccggaacagtgcgtttccctaaacccaacagtgaaacctcccttcgtttcccaggctgtggggctttcgtgcacctgtgccctctaacttttaacagacacaatctcaacagacctgggaccagcgtggttatagctcgtgcatttaagataagccaagctagaaagaaccctcaaggttatctccacccagtatttttatccccaacaacagtctcaagcaattgtggcgacccaaaagaaggattgcgacactactgacgattttgccccggccagtgatccggccctctttgaggggggtgtcatagccatacacttatggntcctaggccacgagccggcggcctggcaacgggcaaactgccgcacgctgcatggcaagttg

SEQ ID NO: 713474 - DNA, 245 bp, Homo sapiens
ggacccctagtttagaagttcaatagcatttctgtagtgctggttgggtagggacaaattcccctggcattggtttaaaatgactttatttctccttcatttacaaaacttagtttgtgggataaaaaattcttggctgacagttgttctgtttaaagaggttgaagacaggaccctaatctctttgggctggtaaggtttctgctgagaagtctgctgtggctattgaaacttctaaaactagg

SEQ ID NO: 713475 - DNA, 156 bp, Homo sapiens
  misc_feature (126)..(126): n is a, c, g, or t
cattataaaacagcctaacttcccttatgccatatgattgccttaaaaagaccagatctcaaggaaaagatcatcaaagagcagagatcttgaagcggcacagttttccagcagttttcgtatttntttttatttacgaatgccatactctgtttt

SEQ ID NO: 713476 - DNA, 719 bp, Homo sapiens
  misc_feature (536)..(536): n is a, c, g, or t
taacgaacatatcataccataccctctacatcgacttcgaaagctgccatagcgcatcttcgctatcgatcgcgccagttcttctccacgctagcacaccttcgctacgtatgtaccatattctcgctacacaccttacctgcccatcaatccccgcattactggcagcaggtagctagcgagagccacaagtcaggccctcttctacaagctccttatcgctgcaccatctattcaggcattaacctgttatcgtaccttcgtggcttcgggtagtaatgtttactggaacactccatcctgagtatgctgccaggggtctttgaaatcagcaaagcaacgtcctcgcgttattcccgtctgactggggtccatttcctcttttattaacggaacagctctttcctcaggagaacctatctcatggatttaggtaggactgactcggtagtgtacataactgtttaatggccagctggggccaggcggagggacagggacgaaagccttatcttgtagaattgcccatttcccanggtgtaaaactcccccactaccagcttcaagctacagacataacatcactgagacgtcactgaccttggactcgggaacagatgagcacacccagctctcacaaacacatccccggtgctgattttaccccatccagggctgggcacatgacccaaagctgccctgaggaactcccatagggc

SEQ ID NO: 713477 - DNA, 129 bp, Homo sapiens
aaaaaaaaccccccaaggttttggattttctatattttaaagccttgggtaaggttattttggtaaataaagggaactgctttttgtctttaaaatgatattttaaataaaacccttactttttgttga

SEQ ID NO: 713478 - DNA, 451 bp, Homo sapiens
agactggcgatttatacgcgactgagaaagactgctgtccaggggcctaagaagaagaagaagcacctccttataggagtgtcctcagatcgaggactgctgtggtgctattcattcctcccttgctaaaacagatgaccagcgaggttgctacactaacagcagctgagaaagaagttatgcttgtaggaattggtgacaacatcagaggcatactatatataggactcattctgaccagttactggtggcatacaaagaagtgggaagacagccccccacttatggagatgcgtcagtcattgcccttgaataactaaatactggatatgaattggatgaaggctccatcatctttaataaattcaggcctgtcatctcctatacgacagaagaaaagcccatctttacccttaataccgttgccagtgctgacagcgtgagtatctat

SEQ ID NO: 713479 - DNA, 133 bp, Homo sapiens
gaggaaacgaagcggctctttccgctatctgccgcttgcccaccggaagcgagttgcgacacggcaggttcccgcccggttgctcgttcaaagggtttgaggaccggcaacatggtgtcggcggtgaataagg

SEQ ID NO: 713480 - DNA, 480 bp, Homo sapiens
ggctgcgtgcgcatgcatggtgtggtcgataactgagtgtcacacatgtgacacacaacggtcagacgagtcgacacgtggcagaaatcatcatctcctcgtggaggtgatggttgtcatgtgtgggtcaccgttgtgcagggcagccccatcctgggtctggagcttccctagacccaggcaccatgcacaggcattccctgctcagttcctgaacccggaccctcctgcctggtcacgtccgctatcgcaccctcctgcatcacggccgagggcccaccctgggctcctttaacttccagggtgttccaggatggtcaagttccagcactgagaacagatcatgtgtgagtgtgagctattgtggagagccgtgtctggtgaacctggttgaactatggtggtgggacggtgctgatgcaggggagctacagaggattacgagcgactcgggtctgacagcacaggcccaggcaggcg

SEQ ID NO: 713481 - DNA, 169 bp, Homo sapiens
ttgttaccttgtgaagaaggtacgacagtcttgattttacagaagaggaaactagagatgagattccctggcgcaagtatacactgcaagtaccagatagcccaagtgaccaaccctcgtctttatgacgttaaaccttatgcattccgttcaaattaaaggaaaatga

SEQ ID NO: 713482 - DNA, 777 bp, Homo sapiens
acaaaaaacaaaaaaaactttaatatagctaggagatctttccctatcagaatgctgagtattcattcccttgttatatatagctacatattattacactgcatagatgtacagtggcttatttaatgagttttctattgatgtgcatttaggttatttctaatcttgtttggatacataaaactgtagtgggccagacgtggtgactcatgcctgtaatcccagcactttgggaggccgaggtgggcagatagcatgaagccaggagttcgagaccagcctggccagcatggtgaaaccccgtctctattaaaaatacaaaaattagctgggcatggtggcaggcgcctgttatcccagctacttgggaggctgaggtgggagggtgtcttcagccttggaatttgaggctacaatgagctgtgatcacaccacctgcactccagcctgggtgacagaacaagaccctgtcgcaaaaaaaaacaaaagacagaaagaaagaaaaactttttgggggcggtttgggcccgggaaagatttttaaacacattggttggggccgggggcccagtgggacggtcacactggggacaagcgagggacccaaggagaaacccggggaaagagaaagggggcggtgagatttcccgcccaatataaaaaaacccccgggggacaaccaggacgggcttgaaccaactccccaagaggggtccaccagaggggcataagggggaccataaacagggagtccaaagaggcgcaaagtaaataccg

SEQ ID NO: 713483 - DNA, 962 bp, Homo sapiens
gtttatgtgccaccaaggtgggcagcgctgctgtacgcccggctcctcgccctggacatgtgtggggtctgccttgtcaacacccttgtgggccctgcccatcatccacatgacaccctggcctgcagagccctggctgcacccggaatgcccatgagtgggctacactgtgttgtcagggtgtggccggctggacgtgctctcacacgacaccctcacaccagtgctctggactccaggagacatttggatggcagcgctgctgcccgcactactggtatattggggcccggggagctggggtcatggcgttcacgggggctccacgagctacacaatgaccacatgcataaccatgccgccatcgagatccgacacatgagcagactcgcattcggcgaggacctcgcgtccacatagtaacaccccagatattgacccaccaaccgcctaggaccgaacctagagccacagaattatcgcactaccatggacgggacacaacatcccgcaaagacaaaaaaactcaactgacacccaatgcacatgacagccaactgagggacactccaattcccctgaacaacaaacgcacacagcaccagaggcggatcagacagacagacgaacgccgtgaaatactagcgcgaacatgccgcgccacacaaaacggcccatgataccaccacgagagcaacgttcaaaagctagaaccaaagagccacgaaccatgacacacaccaaggaaaagacactcccataacaaacgtaaaagcaacaagcaaacacaaggagagatcgaacccgacgccaaaacgacgagcacagtcgaacaaacagaggcacaatgagacatccaacagagcagaattgccaaatcaccaagacctacaactggacgaaagtagccagacccaaagacaagagagaagaccaccatcgacaaacaaccacaggtatca

SEQ ID NO: 713484 - DNA, 200 bp, Homo sapiens
  misc_feature (93)..(93): n is a, c, g, or t
  misc_feature (171)..(171): n is a, c, g, or t
gaacctctgggctctcatcctctcctattgacagtgaagcccatggcaaatagaagaagctcagtatcggctcctcccaccataaccgcgttnaaatcgcctcctggaccatagtttcctccaccataagtccccccatgctcctgctaccaccgaagttcccactcctgngcgaaccgtagttagaagatcgctgttat

SEQ ID NO: 713485 - DNA, 1180 bp, Homo sapiens
  misc_feature (697)..(697): n is a, c, g, or t
  misc_feature (723)..(723): n is a, c, g, or t
gcacagcgctggcgcagtctgacaggatagggacggagcctagatggcggcggacgacggatgacgactcggcgtgtaccccatcgtcggtgctcatatgacgaactccgcgagtgaggacgtacagcttcgcgctcaatagcatcaaggaagctgtcccaccagtctgccttgtgcccttgtgggttgaaaggagccgaagtgagcttctagcctttccgttacagataccatcgtatgatgagggatgaggtcgctcctggccctgcgcagaacatgctgggcaaaccattcagcatagctcctggctgggatggcccagcagctacgtgacacctgcacttgcctgacagcacgctcgggagtgcgcctaggtcccatcagcttgcgacggcagacacgatgggtgcgggtagcaagtgcacgttggcacgctcctcttaccgggggccactcgtcagcgatcggagcatctacgctcgctcgtgatccttgggagggccgcacgttcgtgtgctcgcgtagctggaaaggcgcgcgtaggacggggactggctgacttgtgtttcgagccctcccctgtggacgctcggacgctgcaggcctgctatctccggtctgggttaccccccggaggttgtcccaggtgccttgtgcaaggggccggaaccgtgtcgcagcagataacattcgcggnaacccctggtgcgtccagtattgacnacgccaccattggttgacgtgcgtgtgctcgacgagaccgatccatagctgtggggcagttatgcgcataggttcgctgggagactgggaccacacgttccaaagacgtggagagtcatcgcccgcatgtaactccaaagccttggccttctgtacgaagcaagggactcgagtagcggatggcatgggacgggtcggagggcgttgcgttgaacattacgcacagcttactggccccaaggaaggaatcctgggacgagccctgggtgatggccccactcatgcgccacaggaccgctggaagaacaaatccatgggcgacgtccggtaacaatggtggctgacaagttcaaaggaggtccagacaagccaggggcggcccgaaatcaccacaacgacctggaccagcatccagaaccggagaacgatgggaagcgaaggaaggccgaacactcca

SEQ ID NO: 713486 - DNA, 1815 bp, Homo sapiens
tgggtcttggtaccaaaattttattaaaagggttctttagaaaagcaacatccaaatccccaaaatacaggtgccaagggaaacccgtttatgtgcgtggggggacgtggggtggggacatgtggcagggggctctctgtggcttccccccccttcttgtgttccgtgaaatgtgcggggtgtgggtgggcagatatctctctcattcttgtggggttctccaccaaggtgcctcaggttgtgctcagggcgagggggacttctttatagggcgccacatctctttaccacgtgtgggagtctcccagggggacaaacatgtagattttctcacccttgtagatgcgccacaagacaacaccctgtgtgtcttagaagcacaaacacgcgtgtgggcgcacacaagacatgtgtgtctcaaggcgagtagagaggtgtaaacacagaggggggtctctcgcggctgtgtgtgagactctcactctcagggggcacactctcccacacaaaaacctctctcagtgtgagagatatttagcgccctctctgtcgtctcactgctgagaaaagaataatactctcacagaagaacacaccacccagtacataacacgctctctgtaaaagcccgttgtgtgttgtctccccccacaactctcttctctgcagaggggatgatgatgaaaacaccccgcgacctgatgtgctcacaacaaccacaaagaatatgatcatgatgatgtctgccccctcgtgctgataacacaagagacaaaaaaaatgcgcctctcctctccctcctgataaggagaagaaggtagttgtggtggtcatcacaaccgcgccaaaagtaaagaatacctcttgctgtgcaccgctgttgggggccccaaaatgtggggccgcacacacagagaaggagaaccacctcttcttaataagtggttgtggccgcccaccccttttatatattacagaagagaacaaaatataagaagcacccttcttataagaagaatgtggtgggcccccctatctcctgttgagtgaaaaaaataaggtcgtacgaagaataagccctcttcattcttttacttgctagacaaaccctcattataagcagacaggagcaaagtctataccgaaagtattactcccccgcggaataaaaaatcatcgtgcaggaggcgagaggtgaacacccatatttttatattagacaaccccgaagataacaacacactatatttctccggtggaattatacagcggggaggggaaggggactcataacagaacaaaactatacgaaggaggaatatcgctggagtgggcacacaccaggggggaattatgtgggggagattggaattataacacctctttgtcaagcaagcaacactcactattcaaatgaaaagactctaccagagaaaagagtaatgaagccgccagaagtatattatacagaggaagacagaagtactcctccgcgagcaatagatgaattagacagaaacaaaacagtttcataatattaaagaagagccgaccgacgagtctttatgataaaaacgaagaagtgtgaccccattactaagggactcgagaacgtaaataagtattcacccatcgtatgcatgagtcggagagaaaaaatacttgggggacgcacggtgcagacactatatctatgtggcagcagacacgtcacgaggatagacaaaataaaccgccgggagttctattatattaagtcagaccgtggtgggtatatatacccccagcacgaggagtgtatttcttactacaaag

SEQ ID NO: 713487 - DNA, 209 bp, Homo sapiens
  misc_feature (94)..(94): n is a, c, g, or t
  misc_feature (103)..(103): n is a, c, g, or t
  misc_feature (148)..(148): n is a, c, g, or t
  misc_feature (177)..(177): n is a, c, g, or t
cggtctacctggttagaaatgacttaaagacaatcatcgttggtattttctgccctatggatcattgggacatggtctcttataggaggaaggngggcagatngaaaaacaaatataaaaacacagtcactgaagatgtggccacggngaggaccttgcagagctggtgttgttacnagaacacactcctatcaacctaagcatggttc

SEQ ID NO: 713488 - DNA, 202 bp, Homo sapiens
gtgactctacaggatcttaccagctactcagtgaggcaactcagccagtatcacttggggttaggagttcgagaccatcctggcaacatggtgaaaccctgtatctgctaaaaatacaaaaattagctcagtgtggtggtgcgcacctgtaaatcccagctactcaggaggctgaggcaggagaatggtgtgaaccagggag

SEQ ID NO: 713489 - DNA, 547 bp, Homo sapiens
agaggcaaccctagagatacacgataactagtcaacaaataagcaatctatatacaggttaaccaagcgttacacgtgacacactatgcaataaaacataggccaagtcaacaaagtcctcaggatattatatatcttgaagactatgtgggaacttcacgtcagttatacacgtgaagtgccctagaggaagacccccaggcaaaattaacactactcccttagtgtcaagagcttctagcccaagtcacagaaactcaaaagagatctgactacagggaatatagctgctgagtcatagagagactcaggtctcaagtgctgtaggcgaagtaatggtgtgcacaggatctacaaagtctattacagatcaagtacagaaataaaccaattcttacaaagatcatgatcatgaagaacacgcgaaaatgaaaacgggtgatctgtaggatatcggtgtgcgtggtgcactatcactcagatgggtacaaatgagttcgcatatcataccaaatataccataccttgttagtacaatgatattagc

SEQ ID NO: 713490 - DNA, 178 bp, Homo sapiens
  misc_feature (104)..(104): n is a, c, g, or t
  misc_feature (162)..(162): n is a, c, g, or t
  misc_feature (164)..(164): n is a, c, g, or t
ccacatccctctctgtacttacagcccccaatggtcccccaaaaagaccagagcccaagaaaggatgatgccaaggcagcccccaaggcagctccagctcccgnacctccccctgagcctgagcgccctaaaggaggtcgagtttgatgcttccatgttcangnttgagttcacacct

SEQ ID NO: 713491 - DNA, 740 bp, Homo sapiens
gtgtcgccgctctgccgcttctgttgctcctgaggctgctggctgaggccggaggatcgatgcggcgtgctggcggcttgcggctgatgagggctggcgtgatggtgagcggagcgggacgagggaacgggaggaagcgagcgaggagcgcgcagagcgcgcttttccgtccgcctgaggagccgaatgcagccccaggccccgccgcctgccgccttgccctgccggacaaagcctgagatgcctcgcgcccacagcgcatgtccgtcgtcatgccggcatgcgtgcaaccagcctcagccatgagcccgctgccatcccacaccacgacacctgtggcccatcagctgacttcccgcgcgagcttaccttcaatagagctattgcaaccgacgcccctggggtggactgctctatctaccaacgcacacgctggtgacggcaagctctgaagtcgatttactgcacagcaaacgttttcttgttcggcatccgtacgcaaagttcctccccatgtgctcatgacccccagccgtgtccgaccttgccccatatattccccagcgatgtcacgtatgccgctggacacccgttaagttgacatgacttccaagagctacgaacgtaagacagatattgacacaagctttgacacaagtccacgtacagtgaaatcattgcagtttggcggattgcatgtctccagttacggagcattggaccagtcttgacttcttcct

SEQ ID NO: 713492 - DNA, 154 bp, Homo sapiens
gaaaaatctctgcgtcgatctagaggaccccccttccccacagtgagcagagagacatggacttctgcaagttgctagacaattaaatggccaagtgaaactaaagtgaggtaagggtactgatgtgaaaatgctgagggtgtgatgaggacaa

SEQ ID NO: 713493 - DNA, 102 bp, Homo sapiens
ggccgcgcggtgaggttgtctagtccacgctcggagccatgccgtcaagggccccctgcagtctgtcaaggttttcggacccaagaagaaagccacacgttg

SEQ ID NO: 713494 - DNA, 320 bp, Homo sapiens
gaaatgtgatgctggggtctgcttggcttccgggggggtgcctcgggaaacttaccatcatggcagaaggcaaagggggagccggcccttcacatggctggcggtggtggtgggggcgatatggggggacttcccgcccccttttaagtgaccagatttcatgagaccaaccccaagagggagctctgcccccatgatccagtcccctccccccaagcccccccgccagcattggggatgacaattcaacatgagacctggggggagacccagatccagggggagacccagatccaaattatgcatttttcccctaatta

SEQ ID NO: 713495 - DNA, 2020 bp, Homo sapiens
gccagtgaaccccccaaagctggtttcaagccaaccccactggcctccaatgaccgtttttcaaaaaacaaaaaaaaaaaaaaacaacaaacaaaacaaaaaaacaaaacaacaaacaacaacaacaacaacaaagagaggcgcggcgcgcgcgcgcgccaaaactctctctctcctcccgcgcggcggccgccccgtctccccgcgcgccacccacccagtctctctctctagcgagcaaccaacacggcggcgcgccctcacatacatagtagtgtgtgcgcgctcgtctatatctatatatacgcgccacaacggcaaccgagcgcggcgagcggcaatctaacaaacacacgcccgccatcatatcagcgcgcgccgcaccacacccgccgcgaacgaccaaccagtgagcgacgtctcctatctcgcagacaaacaagaccccccctatcactctctctctactcgacgggggagcgagagcgacaccacaccataatagccaggcgctagacacactacactacaaccacacatcttatatatcatacttatatctcatcacacactactctgcacctctctcgagcgcgagcttctataatattcttataccaaatcatctctcacaacagagcgtcgtgctaacatcacgacacgagccgtgcgacatacaccaccaccagattaccaccactctgacacaatcataagtaacgctagcgccccacaccgccgacgtacgccacacgaccgctctgactctgacgcgcagccacatacactaccgagtagtagtactcatatacataatctgacctctgactgacatacagctcaacaccactaataatattatactaacacgcccaacgagcagcagaccctaccaccatcagataaaaaaataacctcccgtcttcggcctcacatcatacgctgagcatcaactcagatccaacatcccaaccaccaccgcaccccattactatcgctactcactgactcccatgacaaccactcaatacctctccaacctctccctacacttctcccctactcaccaactccctcactatcccaccaccaaccctcatccttatatacattacaccaaacatctattcctctatgataatttcacaataataacctatcactctaccacaaacttcacaataactcatactaagacagccaaataaatcaattatacaccacaccaaccactcatacccgtctccaacctccacatctaacacccccacactgcacgcagctatccacactccgcctcacacaaaaactcacaattcacataactctacactcataaacctactaactccttactacacacacctccacaacatcactgaacaatacgactgcaacacttcactccacacactacctaccacgaatgcaaaactgaaagctaaatagactacacttctatccccacctaccagctgtcctaactctccaatcatcctccacatcctatactctctcttactccacctctagcatccacacatccgacataaggcgtcaggtgcgactgctctgacgtcgctggactcgcagtagatagaggtagcggacattgtagagtcacaacgaaacagagccgaaagacaccacgatagcgatgcgagttagcgatgactctccagagaagcaacaaggagcatgatcggtatatataacttgatagaacacatgcacgaattaattaacaacgatcctctataccacgaatgctgagtacaacatatcgattagatacaaccgtaatcaacatcgtaactacagatcacatgaaacgaataagacattcaatctcgctttgagagtaaagtaactagtcatacgcataatataagcagcttcatgacacgtatagcctactctcctgtgatatgtcgtatattattcatgcgttcatcactcactacacctcatcacaagtgacacttcagtgaggatatgttctgacattactcagtacaga

SEQ ID NO: 713496 - DNA, 115 bp, Homo sapiens
gagtgtgggtttagtcaatggggtttgtggggttttcttctcaagccttctcctcatttcatgaggggttccagtcattgcattgttcaagcggtgtggtcagggatgtgttcat

SEQ ID NO: 713497 - DNA, 496 bp, Homo sapiens
gtttagtggcataatgatgctcaacgtgaaatggggcttcaccttgtacttgggcattgggctctggtcctcagtgcagagatcctaggcaagaggatcaatggactgggcccagccaagttgcttaaaagccagtgcagcactagaggaccagttgcaagtccagagtcttgggaaacggaggcaaaatctcaacccctatgtatagagcaacatgacgctcggagggaaggacgaaggcaatgcagtggtcctgggcttctacgttaatcctgagagtggccccgcaactcttcatctttctcttccctggctttaggcatgtatcttgcaactagcacttgcttaatggatttgacacacctccctacacttacccctttccatacaaagtgccaggtcctctgaaagctccctatatcacctggccaattggcattttcacagccaaggccccaaccaggtgaggtccgcctctcaacctccaccttcgccc

SEQ ID NO: 713498 - DNA, 364 bp, Homo sapiens
  misc_feature (67)..(67): n is a, c, g, or t
  misc_feature (101)..(101): n is a, c, g, or t
  misc_feature (109)..(109): n is a, c, g, or t
  misc_feature (114)..(114): n is a, c, g, or t
  misc_feature (137)..(137): n is a, c, g, or t
  misc_feature (198)..(198): n is a, c, g, or t
  misc_feature (221)..(221): n is a, c, g, or t
  misc_feature (269)..(269): n is a, c, g, or t
  misc_feature (340)..(340): n is a, c, g, or t
tcctcctcagccagcatcactggtgtcctaacaggtgaggcaccaggcaccgggtggggggtgactnccaggcgcatgaggtattgtcctggcccttaaanactcatanctaantaagatggaaagacaggtaccanggaacacctatccagggggccacctgcaaaaattcacatcccacccgccacctgccaccantgtgaccttggacagccactgancacatctgagacccgtggtccggtgtgtaaatgtgacgtcaaatgccnggccaaaggttgctgtaaggtcatgggacaagatccaaaatctcaatatatatatatcaacccggaatccngacgtaccgcagctacacttccta

SEQ ID NO: 713499 - DNA, 198 bp, Homo sapiens
tgggcttttccccccccggtttggttggaaaccaaaaaaaaaaaaaccttttaaaacaaaaaaaaaaaggtcccccccccccaaaagcccccccgccaaaaagggcaaaaaaaaaaaccccctttttttaatgccctttcccccccccaaggggtttttcccaaggggaaaacaaaaagggggggggaggcccccccc

SEQ ID NO: 713500 - DNA, 996 bp, Homo sapiens
gcttcccgtgtcgggtctcgctctagtgtccgggttcttcgcggttgatcaagatgaacccgactcttcgggaaagcgaaagccaaggctccaggcagtccaggcttgggtgttctgcatgggtcacggtggacaggtagagcgagaatcgcattgtcaaggaagcattcctcgatggggtgctgtagctgagtgaatgtgtggaggttcagatcgagtgatgatgcagagagggtcctgcaatggattgtggctcgagcagaaagcgttgctcatgtctcaaaagagcatccagaggcggtttgatgcggcgagcgggaacgaatctgtgcccaagtgagctcatctctagcaggggaaacatgcgccacctgtataccatccaggtctttgagaggacatccaaagaccaccggtttgatgctattgaccactgggattacaagggagactgaacgtacggcctacatggcaagtgaggatcgccagattgggatttacaagaccagctagagggatctgatggaatcatggcaatgcttcatggaagcggtgcttgcgtttgtgtcccagaactggtgaagagtgtggaaagcaagtggcatgcctaatgggtgagctcctggtcgagaaacagtctcattgcgtacggccatttgcctggattccgagtgtcccctgtcaaacacgatgggcctggggcggcactggtgaagaacccgccacagtgtgctcccgatctttgcaatccacttttggcgagaactatctctccatcgtcaacaaagatccttcccgcagagaaagccatttcgcacactcggaggccacacactcgcactccacacaactacgcccctttaccacatccatcggcgcgtctttgttgtggtaatgttgtgtcatcacaccacccccagtcagcccatacacgaccaaccatccacaccaacaccaccacctcatcacatcgccgcacccccacagacacaacag

SEQ ID NO: 713501 - DNA, 743 bp, Homo sapiens
ggaatgaagaggagctgggcagtaactgccaacatgaagctggagggttgggattttgttgttttttgaggctcaaaaaatgctgggagaaatgaaaatgctgtgggatagggctcctgttgcctttcagaggaagtctgacactacagcgttggcacagtgccgtgaacagtggaactgtgcccaagggactctgattatccaagcatcttccgaagagtgttgtggtcaccttaaagagacttccccttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaaagatactattcaatttaaagctatttttcctcagagtttttgttttctatatattaagtctaaattaagttttctactcattaagactaacatctccccactccatccccactgaaatttgtggaagaaaatttagtacttggctctgaggttgccagttatacaataatctattttgcatatgaaagtttgtatttaacttttttgttcattaaaaaccttactgatatggttataacttcagacagtttagagttggtcagaacatattttgcaagatctagtgcctagtgttgcttttctgatgtaataaaaggtggtctggcagaacctaaaaaaaaaaaaa

SEQ ID NO: 713502 - DNA, 734 bp, Homo sapiens
ggaatgaagaggagctgggcagtaactgccaacatgaagctggagggttgggattttgttgttttttgaggctcaaaaaatgctgggagaaatgaaaatgctgtgggatagggctcctgttgcctttcagaggaagtctgacactacagcgttggcacagtgccgtgaacagtggaactgtgcccaagggactctgattatccaagcatcttccgaagagtgttgtggtcaccttaaagagacttccccttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaaagatactattcaatttaaagctatttttcctcagagtttttgttttctatatattaagtctaaattaagttttctactcattaagactaacatctccccactccatccccactgaaatttgtggaagaaaatttagtacttggctctgaggttgccagttatacaataatctattttgcatatgaaagtttgtatttaacttttttgttcattaaaaaccttactgatatggttataacttcagacagtttagagttggtcagaacatattttgcaagatctagtggcagaccaccttttattacatcagaaaagcaacactaggcactaggtcgac

SEQ ID NO: 713503 - DNA, 500 bp, Homo sapiens
cggactgactgaaaggagatgcttattatactgtagaaggataagcactcaccataaaatctatccagtgtatcacttgcatgagctcatgtagacaatgaagacgacaacgttgtctatagccttagaacaactgagtacaaattatttgggacaagttaaacaacgtctaaaaacaaagtctatgcaaaccacttaacaatcattccatagtagtttatcaggtcacgtattcgattcttatgcttcttgccagaaatacattatgataaagtggaaatacataacgatgaagtggaaagagcaaacacttaggaatcaaacagagttgcaatcaaacctgacatgtactgtcatgaatactcacaaattatttagtatacctgaatcttggtttctttttataactgagtcatactggttacatctcaggtagtttgaggattgactaaaaccatgcgcgcatgtcgtatgtgactgaataacaatttaaactctgc

SEQ ID NO: 713504 - DNA, 149 bp, Homo sapiens
tggtaccgagttttctctgtggggaggggagcaggcaggaggagcagaattgccaacattgcacagccaggcgtgggagcagcctagggagagcccccatcatgcccaccacccacatccgtactggcccgcccccacagagagagcgt

SEQ ID NO: 713505 - DNA, 142 bp, Homo sapiens
tagttttaagacagagtttcactcatcacccaggctgtctcgaactcctgaccccgtgattcacctgtctcggacttgcaaggtgctgggattacaggcgtgagccaccgcgcccagcccgatcttgtatcttctgatgctt

SEQ ID NO: 713506 - DNA, 110 bp, Homo sapiens
cttatggtgacccagggtgtccagccggcgctgttatcatggcgcgggtcggggggggcaggggagcctacgtccagtccccctgattgggcatgtactcgggcagcagc

SEQ ID NO: 713507 - DNA, 345 bp, Homo sapiens
  misc_feature (149)..(149): n is a, c, g, or t
ccttaccttagataaatccctgaaatcttgtgtcctgattgattctatgcaaggcttgattccaagagtgtgataaatgtggttgcatctcaaaactcagaagtcgctctctgctggacttcactgaatgaaatcttcatgagaacgantaaacttggaattcacatgagattctctcgctcctttgtatctcatctcttacacaacttttgtgtgggtttttgctcagcttaaacaatgacaggatctgtccaaatgtcaagccggagtatattgagagcaggaagagaagatgcctgtctactgcagccacatccatcacagcacgtgaaatgcattgaacgc

SEQ ID NO: 713508 - DNA, 983 bp, Homo sapiens
  misc_feature (449)..(449): n is a, c, g, or t
attgaaatgacttaatagaacccttgtgtcctgctgcaaaaatttttcctctctaaagaaaaggtttatggtggcaaatgatgtttattttattttgtaaaaaaaaaaaaaatgtcctatgtactttgggtgtaaacccctgaaaaatctcgtggtcatctccgagaaattacctgtccaacgggtttctctatagtgctgatcgtcttggggcaaggggcaatttacattgaccttgggtgttggctctcctttggcagctctttttttttctccccccaattttctttccttaattagggaaaacaaaaacaaaaaaaggggttccccctgtggtgtgtgggttctccaatatccccgcggtgtggcgagaggggaaaacacttgcagagtttccccagaagaactttggcgagtgtggggggactttcactcaaaaaccccctggngtgggcgccgagcggtggtgcgccccgtgtttactccgcatcttccttagaacttctcttttcaaaaattacagagggctaacacacatccgacggggggggggagacaatatatcagctgcgtctaacacgcgtcttataatcattcaaagctctacaattccttcttttctcaacagcaccaatttttcatctttatattttatcccccatctttgctatggacccttagagggagcaaatctgggcaagcgaaacctcctgtcaacaccatttccgaagggggggcccctctggaacaaaaaggggcggacccacaaaatcgggggagatggacgccccatatatatacaacaaacccaagaatttcactgtgtctgtgggatgtaataaccccccaaatgatttatgaaccccctcatatttcttcaacgaggggacttgggtgtaatctcggtgtataattcaaaaaagcttctttttctacacacttttttagaagcaccacgtgcaacgcacccacagcaacaggac

SEQ ID NO: 713509 - DNA, 113 bp, Homo sapiens
tcttatccgtttttgttttctgttattttatttcccgagtgaaggtttactgatgacgattcttcaattacagtctgggacgtcttggcttcgctgggcctcctcaacaagca

SEQ ID NO: 713510 - DNA, 197 bp, Homo sapiens
tatcccagttttatcatggatcatcctgaagagtcaagccacaatcactcggtgtagccagcccagtgttggagtgagtggaaagcgaagaagagaagatgaatccatgataaaactgggatacggcctcttgatctgaaggatgccactctctttaattcttcatcaggaatatttgctggcacaaccaagattgt

SEQ ID NO: 713511 - DNA, 121 bp, Homo sapiens
actgtgggcccgttcttttgccatgtgcgagtcatggtttgactccaccgctattccttctttagaatctggaggtcagtggatcaccagagaacataggatttcttcacgttgaatatca

SEQ ID NO: 713512 - DNA, 788 bp, Homo sapiens
gttcctccaaatgttgcatatgcaggagttccttctttttgaggctgaattttttattgtgtatatataccacttttcctttttttgagacagagtctcactctgtcacccaggctggagtacagtgacatcatggcttattttggccttgacttcttggactcaagcaatcctcctgcctcagcctcccgagcagctgggaccacaggctacaacaccaagcctggctaatttttgtattttttatacagatagggtctcactatgttgcacgggttggtcttaaactcccgacctcaagcaatcatccctcccaaagtgctgggattacagacgtgagccactgcgcccagctcactttttttttttttttggtaagagtctgtgctgggtcgcccaagctgggagtgcagtgggcttgatctcggctcactggcaacctctgcctcccaggttcagggcaattttcctggcctcagcctcccgagtagcagcggggactacgggtgggccgccaccacaccgggctaatttggtatttaagtagagaaccggggtttcaccttgttgggccaggctggtctcgaactcttgacctctatgatccgccgtgtatgggcctcccaaagggcggggattcacggcgtgagccagtgtgctggcacatattcttatatcatggtggacccccggactgattctatttctgccttatgatatggtccgggacatggggtatggcttcccttggaatctgatgtctcccttggtttttccctaggggatgc

SEQ ID NO: 713513 - DNA, 403 bp, Homo sapiens
aaccactaaaacaaattcgctggatgtggcggcacacggcgggagtcccagctactcaggaggctgaggcaggagaatcgcatgcgcccaggaggtcacggttgcagtgagccgagatagtgccacatgtactccagcctgggcaacagcagcaagcacctggtctccaaaacattcaaaacagcaatgctcacagggaaccagtcttgtattctatcgtggcaggctttggccagtcatactgtcagggccaaattcctagcaatatcacattgcttgatcaaatggcatatgccttttcccttttcacacggcaccatggccacttcatgccacatgcaaacagcaagcaggcacggtttcccagagtcatcaggctcatggtgaagtttataaaagagtt

SEQ ID NO: 713514 - DNA, 1654 bp, Homo sapiens
  misc_feature (1466)..(1466): n is a, c, g, or t
ggtaatcctgcgtggctctttttgtcttggtgaaagtaagcaccccccttctatctctggtactcatcactgtgggtgccctcgcggtcctatatacacaactcgtgggggttgttgttacaccagccacagttgacatcaactgtagtgggctcccctccctaccaggtggctgtatctattctcactgttgtatgtgtttgagacccaactatttccttggttcgtgttatcgcacacaagggacgacacacaccactgggggtctttgttaagttgagtaaaacaccttctgagtaattgcttggttgggtataaacagaaaagatatatttctcttgtgtgctccggtcgccactaacgctttatgttaccctacgggtgggatgaacagaaatttatcttctctcggttgcctcgctccgcaccccgcctgtcgccgtgtgttgttttttgtgtgtcgcgcgcggggtggtttattccatctttctttttggtgagggtgacaccactgtgcgttgttcttattggcgaaccatgactaatgtcctgctcccatcgccctcatattcagcaccaccggtgtgtggtagagatggttcttccccccaccagcccgcccagcactgtggctgctttgtggggaggtgtctcccctccccccctttgaggttcttcccccctcccctctccgtgtggaggattttcttatataggggctcctcacaaacgatgctgttccccaaaggtttataccctttgggatgattcccccgttgtgaagactatttttctccggggggaaattatttgcgcccaaagttcttcccactacgcgctacaccagagaatggtctcccacgagtcgcctccccacttgtggatgagtgtcctcccccccgcggcgccacatattttctccgccccctgtctgagcagggcgacacactctgtgagagacatggtagagagagtatctctgtgtagaaaatgctttctcccccgctgtccttttgatgagatagttctttgcgcctcctctgtatactcccacagcagagagagaattttttctccacacacgaacacactttgtgccccccggggtgggcccccccggtggggccccccccccactgggctttatagcggcgccgcgagaggggtgtgtctctttcgctctctatttgtcttggtttctctcacacctgatacccccctctgtgtttctctctctttgagcacacacgcgagtgctctctctgtgattgtctctcacacctcttctctctctgtgtgtctcctctctgggcgtgtggcgtgtgacacacacagagagagagttgtgcccactcttctctctctttgtcacagagagtctgtggcgctctctcagagagtgcgcacacacatgagcgacactctgtgaagtgtgttctttgcgcacacacacaagttctaacagnggagacccatcggcttgcctcgctcctctggggagacggacacaccacaattctcccctctctgggccctcttttcggcctctcttggagacccctgggcccaaggccaagggaatggcccaaggtctgttgtttggtttggccccagttccccctcctttaactccccccgactgctgcccttaata

SEQ ID NO: 713515 - DNA, 148 bp, Homo sapiens
cttctgttggtgtcatgtagtaaacatttctttagtttattgaaagaaatgtttacaacatgacaccaacagaagggatcaaagtgtgtcgtgtgtaaacatttctttcaataaactaaagaaaaattattaaaggacgaaaaaaaca

SEQ ID NO: 713516 - DNA, 438 bp, Homo sapiens
  misc_feature (21)..(21): n is a, c, g, or t
  misc_feature (39)..(39): n is a, c, g, or t
  misc_feature (56)..(56): n is a, c, g, or t
  misc_feature (102)..(102): n is a, c, g, or t
  misc_feature (117)..(117): n is a, c, g, or t
ccatcaagctagtgttaaaancccagccctccccactcnaaggggaagctgaaaanacctgtaagagagagaagtttaagtgtgcccatgagatacatgcancccaggcttcctatncccaggtcaaatttggggagcagcattgaatgcagttggggaatgatatggtttggctgtgtccccacccaaatctcatcttgaattcccacatgttgtgggaggaatctggtgggagattattgaatcatggaggcaggactttttcatgctgttcttgtgataatgaatgagtctcatgagatctgatagttttaaaaatgagagtttccctgcacaagctctcttctcttgtctgccaccatgtgagacatgcctttcaccttccaccctgattgtgaggcctcccagccacgtggaactgtgaatccaataaacctc

SEQ ID NO: 713517 - DNA, 973 bp, Homo sapiens
tggcgtcaccgataacggacattacagtcccgactagtgatgcggacccaggggagcctgcggatgatcctcaaaccaatgctgtgggctcagatgcgtgatcgacgaggccagcgagaagagcatcgcatcatagcatgagaacaccgagtaccagtgtcgtgacggttcttcctgattctccggccgaagctccacaggacgacaggtcagttgtaatgcaggccctgcaccagcagcatgctggggctgcgccggccggtggagcaatggagcttggaggccagtgatgcgctgcgctctgagtgttggggcagcccatcctgtcgaggagtgacgacggcgacgatcgactgagtgtcctggctccttcagtggccgccgcagcgtggtgctcggtgatcgagcggggcacggggccagacctaccgtggcagcgtcttggtccggctcggggctgccccgtggtgctcaccgataggctttgtgttgttgtccgtcttatttcaacgctgggggcctcgccttgccaggccttgttggagaggtcactagctgggtccagggacggagcacttgggcagtggtctcggtaggagcccctcggtgagtgtgggtggtcctggtgccttcgcgcagacaagggaagcccggttcataaacagaggaacatggaaccacaaagacattgttaatgcatgttaagttgaatagcctggattatgtcgtctctacctgaccttgggacacaagctggccaggtacctaacgcgaaagccaggttggcatccgtgcaaggacacgccaacaattccgagagtacacagggtacgggccgaaaccaggttgtgcctcggcctggtcgagacaccaggccggttcctggagatcgacacagcgtgttaagcaaagtctggcgtgttacacaaatctacggaggcatacatttaaacgaccgcccgaataatacccc

SEQ ID NO: 713518 - DNA, 119 bp, Homo sapiens
atccgcctgcctcagccttccaaagtgtattttttacactttttgtatttttagtagagacggcgtttcaccatgttggtcaggctggtcttgaactcctgacctcatgatctgcctgc

SEQ ID NO: 713519 - DNA, 406 bp, Homo sapiens
  misc_feature (24)..(24): n is a, c, g, or t
  misc_feature (28)..(28): n is a, c, g, or t
  misc_feature (31)..(32): n is a, c, g, or t
  misc_feature (139)..(139): n is a, c, g, or t
  misc_feature (233)..(233): n is a, c, g, or t
  misc_feature (254)..(255): n is a, c, g, or t
gctaaagaatatggtttagatcantgtntgnnatgaaacatgcatgtaacttttatgaataacaaaaaggttgaggagtgatcgattgtgtatagtttcagcccatcgtttgaacaaaaggaaatgcttgaaaaagtgncagcttttatgaaggaatatgtatatccgagtgaaaagtatatggtgccgcatcgtggactgcctgaagaaattttgaaaccgcttcaacaaanagtcaaagatatggggctttnngctgcacacatgccgaaagaagcggggggatcaggattaggtcttgtgtctttggcattgttatctgaagtggtgggacgtagtcctgtagggccttacgtttttggtttcatggctccggacgcaggcaatagtgcgtggggtaggaggt

SEQ ID NO: 713520 - DNA, 571 bp, Homo sapiens
  misc_feature (257)..(257): n is a, c, g, or t
  misc_feature (402)..(402): n is a, c, g, or t
  misc_feature (420)..(420): n is a, c, g, or t
  misc_feature (447)..(447): n is a, c, g, or t
  misc_feature (542)..(542): n is a, c, g, or t
  misc_feature (556)..(556): n is a, c, g, or t
cactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccnctgggctgcctcctttcccgctagttgtgcctgagagttgctgttgttcctgctttcccttcccttcctttcatcccctgaagggctagggtgtggttttccgtgcccggtttccccacacaccccacacgggaaacctttttgnagaacccaagcagggccntcacccccttaatatttaaactggagncccggtccaaaggcctttagaaatgcccttacaaaccaaaggctcaagttttgtccttttttggggaagaaaaggcaaaaatggccccaacttanttttggcccttttnccaacaaaaagaaag

SEQ ID NO: 713521 - DNA, 165 bp, Homo sapiens
ccaggggtccgcccaggggtccgcccaggggtccgccctattgaaaataagaatttgaaaaaacatttgttttttcaaatatttgctatgagggggtgagggattaattaaataagtcaattcctggaatgtgagagggcaaataaagccctgggacccttccca

SEQ ID NO: 713522 - DNA, 221 bp, Homo sapiens
  misc_feature (14)..(14): n is a, c, g, or t
acgttcagccttgnaattgttcccacaaccatccccatcacccgttccagtgctttcttgaaccccaattcattgcttatcatcaccataggtactcaacttgcccaacagctcctccgccgtcacacgctgtatctcaaggccttctgggactccatttttgagccaaaactgtgcccacgagagacgtcacctcctgcctgagtcgacgcggccgcgaa

SEQ ID NO: 713523 - DNA, 451 bp, Homo sapiens
cttttggggtctttgctcctttatgacttttgggtaaataatgaaattaaggcagaaattaagaatttatctgaagctaatgagaagaaagatacaacatgccagaatccctgggacacaactaaggcaatgaaaagagggaaatttatagcactaaatgcccacatcaaaaagttagaaagatctcaactaaccacctaacatcacaactaaaagaactaaagaatcaagagcaaaccaaccccaaagctagcagaagacaagaaataaccaaaatcagagctgaactgaaggaaatcaagacacaaaaaaaattcacaggatcaacaaatctaggagtttgttttttgaagaaattagtaagacatgctgctagctagactaataaaaaagaaaagagacacaatagaaatagcaaagaccccaaaaggggtctttgctgaataaccat

SEQ ID NO: 713524 - DNA, 666 bp, Homo sapiens
  misc_feature (17)..(17): n is a, c, g, or t
  misc_feature (303)..(303): n is a, c, g, or t
  misc_feature (469)..(469): n is a, c, g, or t
  misc_feature (656)..(656): n is a, c, g, or t
cacgatggggaccgttntctgcaacagaactcactggctatccacagagtgtacacgagctgccagctagtctgagctcgctgagcaagaattgcgagatagttagagactgtcgtgtttggtcagtcaaccatgagcaacggcatgcgagatgatgatcacttgaggtgcagaacacgcgctgacatagccatgatgtcggtgagtatcatgatactagctgcagatcactgaatgactgctgtggagacactctaggcgcagaagccacctttgatgacacctatggagatgaggtgagcncgtgtgcataacacgaatctgctagagattatggctgactgtgaggacagagagcacaactatagccgtcgcacgagaggtgtgactcgacgatgattgtgagtacactgctttacaggacactgaatactctgtctcgctgatgttgtgatctgcaatgccctangacactcctccctataggcgcccggcacctcccgtttctgctgaatggtataccaaagttgttcctgattgtagccatcctgtggagagcctgctacctgttcgccaaattgtgagcttttgatcactggagagtccgctgcccaagggctttaggtgcgcccccgtacgcggctttcaacttgggngggttccgcc

SEQ ID NO: 713525 - DNA, 441 bp, Homo sapiens
  misc_feature (283)..(283): n is a, c, g, or t
tccttgtaatccaagcagtcggcatcatcaccatcatcatcattattttggtttgtttgtttttgagacagatcttgctttatggcccatgctggagtgcagtggcataatcacagctcaccgcatcctcagactcctgggcttaggtgaccctgccacctcagcctctcaagtagctgggactacagacacaagctaccatgcctggctaattttttgttttctatttttggtagacagaaggttaatccaagcagtcgaatcaggctgagatacgacatanattttggagttatcagacaggaaatttaaaataactatgattaatgtgtaaaggactctgatgaaaaaagtagacagcatgcaagagcaaataggtaatataagatagatgaaaaaataaaaaagaacgactgcttggattacaaggagggtaccgag

SEQ ID NO: 713526 - DNA, 250 bp, Homo sapiens
gagattcccactgtccctacctactatccagctcggccaagttcggccagcgtcccgccgcgcctcggccaaggtttcaacggaccacaaccaaattgcctcttcaaattgggacacaggcattggaaaccaagaatggttacatatttcacaaatttcgctctggggatataagggctcaattaacacacggagggagctctagagtactcacatgagaaaggaggtgtctcctgagatttttgagaac

SEQ ID NO: 713527 - DNA, 254 bp, Homo sapiens
aaacagcacaaccaatgacaggatgcaagaactgatagggcgccgcaaaaaaaaagcgggccaaagatgaagtaaataaacgtaagggaggtaccgaatctggggggcttggcgtagagtaagggagaggagcttcaactatctcaataagggcaagaaaacacaaacaactccttcattcgtccaaaatgcttctgaattgcaccacaattgacacacacacacctcaaagcagaatccgcactgacctaagt

SEQ ID NO: 713528 - DNA, 345 bp, Homo sapiens
  misc_feature (308)..(308): n is a, c, g, or t
taatctgtactcatgcgcagagttcatttgcttattcattcaaagatgtgtatggagggcctactctgtgccaggtagtgttaagtgctggagccataacactaagcagtctttttttttttgaaacggagtcttgctctgtcgcccaggctgaattgcagtggggccatctcagctcactgcaaccttcaccttccgggttcaagcagttctcatgcctcatcctcccaagtagctgggattacaggcttttgccattatgcctggtaattttggtatttttagtagagatggggttccatcatgtngacagactgtttgacctgacctcaggtgatccgcccg

SEQ ID NO: 713529 - DNA, 142 bp, Homo sapiens
taatgcgtcaagacatatgttctgcaagctaacatgtttacagctcagggtcctttacagatgaaactggctgatcacagagctacatgtcctagattcttcccaggttaaaggatgattaagtcctcgtggggtaggaggt

SEQ ID NO: 713530 - DNA, 216 bp, Homo sapiens
tagaggatgctaacctggaataccacccctactcaacacacatgaaaaacagggcgggcagcgggcacactgcactgtcaatgaataactcacctactgtagtgaaccctgggagctagagcaggagggtagaaacggggaaggccggtttcccactaaactaggcaggcaaggcaaatagtgggctgtccctatggccctctctagcaggtgcgg

SEQ ID NO: 713531 - DNA, 120 bp, Homo sapiens
ccggggggttttttttttaaacttccatgggcccagggttccatcctggaatttttttttctttgtttggatatgggtaaatggttttaaaattaaactgttaaatatttgttcggagga

SEQ ID NO: 713532 - DNA, 988 bp, Homo sapiens
tcccgacggggaatagtgagccctcctccttgtgataagtgatccacctcgtcgatagagggtcgtcctcgcaattatgctccacggagggttaaacacgctgtgtacatttcccgcttgagtcacacgtggtgacattgttgtgaagacaaaccatattgggattctgctaacgggtatgtgcgctctgcacgaaaggttgccccaactgaaaagaaattaggggtgcaaacttgttccccctagtgcgcccccccaaggcgttgttaccaaaaggtctgtattttcgtctttgaattcaaggggccccacgtgtaccccacggggtaggcaccatggcgccaatctctggcttatggcacacccctgaacctccctgggggggcaaacaaaataacttgtgtcccttagtgcgtttctcctgggtgtgaccccaaacaataaactggtgcgggtgtacccccccccacccccggccgaaattgtttatattaataaaaaatttgtttgtgaaaagggtttttttctcagtggttcccccggtaggtgttctttaaaacatcagtacacagacgaggcgcctccacacaacgggtctgcactccccaacctcgctggcgggttaccactgttaagccccccgtgcccccgtccgtcttgcacttttcacatgtgcagacgttcactcttggttctccccatatgtacagcagagccacacacaattcgtgctcgtcgtcgttggcaaagaagatcatcagtgatgccagctcactccctagaggaccacaagagcagcaaccatgtcccgccggtcgcgcccttactctggggagaaccaaccaagtgggtgtagtcgttaccccatgtaaatgttgtctccccggcattgtgaataatattgtggtctcttgcattgggataggaagcataagaaaacagccaggtgggggtgtaaattcaaaccaaaaaagcctccaaaaagaca

SEQ ID NO: 713533 - DNA, 351 bp, Homo sapiens
  misc_feature (3)..(3): n is a, c, g, or t
  misc_feature (7)..(7): n is a, c, g, or t
  misc_feature (10)..(10): n is a, c, g, or t
  misc_feature (337)..(337): n is a, c, g, or t
tanggcnttnactatctggatccaaaccagggacccaaagaaatgagattctagataaaggtaaaccgttctcaagatagagatgacctcaatttaaatagtaaaaaggagaaccaatcagaagagatcaattacgaaccccgagaccggcgtcagaagtaaggaacgataaagaacgggtcaattatatccaaatcgaataccccctaaaccatactatcgaccgaataacatcgaaaatatcacaccctgcgagtgatcaaaagatgtttaatagggagattatattctacaaaccgacctttccgttgtaggatcgttggtgccaattgattangcggatggcaacgg

SEQ ID NO: 713534 - DNA, 515 bp, Homo sapiens
gcaacaagaacaagactccgactgaaaaaaaaaaaaaaaaaccagaagggtaaggcagatagccataatgtcatctttttttattatcattatgcttaaagttctagggtacatgtgcacaacgtgcaggtttgttacatatgtatacatctgccatgttggtgtgctgcacccattaactcgtaattaacattaggtatatctcctaaggctatccttcctccctccccataatatcatctttaccggacccttgtaaggaccaaaaggggatttatgtttgcagaaaaccaaaattaaccaattttgcctgttaaaccagggctaaaactgagtcacctttcctgccccccccatgagacttccatagggtgaaaaaaggtgggggaaatgtcctccctggcattcagggccgggggccccattcccagggtgttcccataatggacctggctttctgcccttttgggcctctttggcctttctctggctccacgggggaacatccggtttgg

SEQ ID NO: 713535 - DNA, 286 bp, Homo sapiens
attctctagatggatctctctgaatctgacttccatcattcagtctaactatgacagttgttagtagtgtatatttctaaaaggcaaaaataataatcctgggtaatagatgagtagctcatagagaggcttagtccattttgtgctgctaaaacagaataccacagactgggtaatttataatgaacagacatttattggcttatagttctggaggtcgagaagtccaatataaagtactagacatctggtgacggccttcttatgcatcataatggtagagata

SEQ ID NO: 713536 - DNA, 356 bp, Homo sapiens
actacttatcaatctatttcaaagttgaaaactacaattttcatataatgggacctttctgtctttctttgcaccacgcgccaaatctgtcagctcattcccgccttttctgactgcttgctttatgttaacctgagaccagggttttcacctctcagtgttctggtaaagacagaattttatggtgactggccaggtaatgaaagtgtcatatctccctttatattagggacactagagaattatgcctggtgcattccaacccttcctgtcatttaagactgtacaattttttatgcatataatgtttctctgggaagtataaaagtaggaaatatctccatatgcttttaaat

SEQ ID NO: 713537 - DNA, 181 bp, Homo sapiens
tttttttaagaccctcatcatttaatgtggggggacatacaggaaatagtcaaaaccaaatcttacaaaaatcgccagtatcaaggcgggcgggttttgaagccaaaatgtgatgtgtgtgtgtgtgtatgtgtaaaatttgtgtggatatatatatatatatgtgtgcgcgcgcgtgtat

SEQ ID NO: 713538 - DNA, 100 bp, Homo sapiens
gcccacattatgacatgaggtcagcatatacacaaaagtagtatgatcttaggaagcttaataaagagaggggtctaatcaaggttacctgtaggatctg

SEQ ID NO: 713539 - DNA, 166 bp, Homo sapiens
  misc_feature (89)..(89): n is a, c, g, or t
taattttaaaatattttattgataaaaatgctaacacagagacatgaagtcagcacgtgctgttggaaaatggcactgatagacctgcncaatgctgggttgccacaaacattcaatttgtaaaaaaatctaaccgcggagcataataaagcaaagtgccataaaa

SEQ ID NO: 713540 - DNA, 279 bp, Homo sapiens
cgtcggtacctgatgcagagaaccgggaggcagaggtgcagtgagccgagatagtgcactgcactccagcctaggcaacagagcgagactccgtctaaaaacaaaacaacaaaaagaccctgaagagcttctctgccttttctgccacgtgaagacacagcaagaaggcaccatctatgaatcagggagtgagccctcaccagatgccgaatctggtggtgctttgattttggacttcccagcctccagtactgtgagaagtaaatttctattgtttat

SEQ ID NO: 713541 - DNA, 1052 bp, Homo sapiens
gctaagcagggaacgatcgcagtcacaacagtcgggcccatgtgtgtgtcttacttcaagcctttggtgtgttctatggtgcagttgtagaggagacctctatacaaatgtgactatattcaaaaaattacaaaaaccatgccggcatgctcaacgactgactttgcattcatgcaatgtaaacccagcaaccagcacatcacacacagcacatcatgcaacatgttcatttctgggtttcgaacatgcaagcacaatgccatcacagcgacacatcactgcatgcactcatccagcgttaggagcacgacctgtgtgcaacacatccatcacgtttagccaatctcaaggcaacaacatgcaacagcaccttcatcctcactttcaggacaacagtagcttccgagtgtgccgcaactttaaaccacttcggcattttcaccgtcagcaatccagcaacagcattcacatgcacacattcacgaatcacacagtttagccaccaggcaacatcagccaaaggcgaactgcgatgggtttccaggcccaggtagtcataggccaatcatcgcacacttggatgcagtataccatcagcaatcgtcaaaattggaggagctggaatggaggatggagtatgatactatatagtctacttgaacggtgtagcagtacattcatttataatagggtagacgttacattttaacatccataaggtataacatgtaaagatttataagacatggtatcactaacaacatactacagaagacacggttaaacgaacgaaggaaccaaccccatagggaaaggataaagaaaccaaagacgtccataattaccagagccaccagcgacacaagaacaatatggcgagcacattacccatgtgatacaggacgcagtagaaaatacatcagcaggatcacgccgaacgaatagacaagtaacagattcaacgggaacccaccttccaaattagaacgtcatacagggaaccactatccatatgtacacgggccatcacgtgggaataaaagcaagatgac

SEQ ID NO: 713542 - DNA, 163 bp, Homo sapiens
atccgaggatcccctacataaatgtctaagttgttttaagtccactttcccttcacgtttggtggctgacctgaaaagaggtcccttagtttttggtcacttgttctcctaaaaatgctatccctaaccatatatttatatttcgttttaaaaacacccatga

SEQ ID NO: 713543 - DNA, 753 bp, Homo sapiens
cccgcagacggggctgtgtgtgttaccaagcacgcgggcgtgtgtgccacctcggcctcacgtggtagttaggttgtctcgccgccgacttgcttcctcccgtcagacgtttgtctaggcgtctcacctagcgaggagaattgtgttgctgcccccccgcctccacgtctaggtccactccgctgaggcgccatactccacactgccgcccacatggactgcaacccctccgggcggtggcggtgtctctgtggattgatgtttccgtaggccgccacgcatatgtgatctgtatgacgttacggggatggcacacgcaaaagtccgcagataagtttgtatccgacgcggtggtttgtatagagaacacgcccgccccacggagatggggtcttctccgggtaccagaaaccgcgcggctgtctatcttcatatctccagtggttgcccaagctgtcccccatttctgtgtatatctccccacccggtaggtattgttttatgtacgctccgaggatagatctgggaatgtgagaatctcttacgtatgtgagaatgtcctatgttttatctgtgcgtgcgagagcacacctcttctctccctgagagaggatctctgggcaacaagtctcacttaccaccgccgtaggggacaccacatcttctgtcttatcatacgccccggctgtggtcctattcttctctaacaaaataaggacataataaacagacacaacaaatagaccaagaaaa

SEQ ID NO: 713544 - DNA, 112 bp, Homo sapiens
caggggctgcatgtggaccccccggcggcccagggaccacgccccgacccaggggctgtggacgatgtacaggcaaaagacgtacgcactcctttccttttggaagcaagaa

SEQ ID NO: 713545 - DNA, 167 bp, Homo sapiens
gggaaacccgtgtgctattagccatggtcaacccaccgtgtttcttgacattgccgtcgacggcggagcccttggccgcggttctcctttgagctgtttgcagacaagggtccaaagacagcagaaatttttcgtgctctagcactgagagaaggactttggtacta

SEQ ID NO: 713546 - DNA, 131 bp, Homo sapiens
taactcgatcaaacaaaaaatccagtgatttgagaagatcaatcatattgatcaatctctagctcactacgtagataaggatacaagaaatgtaacaggaaagaaagattggacatttacccagataatac

SEQ ID NO: 713547 - DNA, 168 bp, Homo sapiens
gactaatcaaattaacctcaaaacaattgttaaccttacacaacattaaagggacgaacctgtatctcttatactagtatcccgaaacatttggtatggccacatctaatccttccgcggtactccggtctataacttaattaacaaccacccaacctatttttttat

SEQ ID NO: 713548 - DNA, 136 bp, Homo sapiens
  misc_feature (114)..(114): n is a, c, g, or t
acagactgcgcgggggtggttttcagcctgggggcgttgaaagctagcaaagggccgcagcccgtcggtgtttgcgccctggcggctctccttggtcctgtgcggcgggcgcangctgtgagggggtaccgagctc

SEQ ID NO: 713549 - DNA, 511 bp, Homo sapiens
ctttttgaagaaattctactttcccccatccgtcaacgaaatggttcgaacactacataattgaactcccccgagcacgattactcttgtgtatattatcccccctctccagagcacactctgtcgaccaatttggaaaggtccccctcgaattagtagaagctctgtcccattactccacacgtctcctcaatattatccacgcctcgttacctgctacttgcttcttctcccacctataaccgggatcacgaacagaacctcttcagttagtactttcgaactcaagcctgtcgctagaccttttcttcaagcctccgctgtctcagacaactaacttttaatgacagcttttgactcgatcatttaccactccattaccatgcaatttcatcataagattacgtgccacctttggtcaacaaccccttctattccccacttctacttcttctggccaatactccccactctgtcccccccccctccccccttacggacacacataaca

SEQ ID NO: 713550 - DNA, 351 bp, Homo sapiens
tcagataagtgaggttaagtggcaagagagaaatggtgagaactccactcaaaggaaatcttggattcagtgaagctctgactcccaggagcatacaggagggagcagggaagagctccatttgggttcggagctgtactcagatcctgagtaccacataagagctagctaggtacagcgtgggcctgccataccacagtcttcccaagatccacagttgccaggcccacgaaaacagagaagacactccccacaatcattcatcaaaaccccaatcacatataagaagatggaagccactggtagaaaactttattcaggacgttccccaattaggaggcaggtcgacgc

SEQ ID NO: 713551 - DNA, 970 bp, Homo sapiens
ggccgcacacggttcggttctgtatgtctctccttccccagaagaagccactaaaagcacgttgactcgaaatgaattggtaggaattgtggacagcataagccacttgtatgttagtctttagctcaccgcaaataagacggcgcccagggctcacctcactaatcagtatatgcatagaatggcaagtgttacgagctgattcccaataccatgctacatcaattcgcctaccagggccaagcatcgctccttcgaggttagcttctatggcacgttagtcccacgaggacttcacgaacctgtgctagcaatactagtccttccgtagccagaaattgcttcaactaagaccaaagtccgtcgctggactgctcaggggtgccaagacctcaatcctatgcctaaaactaattgccctggtgcttttccgtccagctgctcctagaccaccatttaagtactatgagaaccagcttcttcacgagggttccacgagtcatgtcgaacgacagacgtgtggctagacacatcaacacagacgaatgggtccacgtcctgcagctgcagccgctgcagctactcctgctgtccgcaccgttccacagtataaatatgctgcaggagttcgcaatgcctcaggcaacactcttaatgcacagccactagttacaaagtgcaacatgctgctgttcatgtacaaagggtcaggaacctttgactgcttgcatgtttggcatcttgcccctcctcaagaggcaaagccaaatgttgcggtgaacgggtgttttcctcttattcaagcatggaccctacttctttgcggtgtaaatccctggctgttgttggagatggtaagtccacaacttttcatatagggcgagatctcccaagagacccggctaaggtagagaagcgtgctttttaaaagccccagtaaaggtgcccaaacattaagccccggttcacg

SEQ ID NO: 713552 - DNA, 162 bp, Homo sapiens
acttccaccatttctactcttcagtgcccttggtcctctaactcgcatcctctaagggatacgttctgctatgcaaagtatactcttcagtgtattggaaaatatggctttaccttctgaccaaaattacattcaactgcacagttgtggcagagaacatgc

SEQ ID NO: 713553 - DNA, 102 bp, Homo sapiens
atatatatatatatgtaaatatatattcacacatctctatatattttaatgtattgcacatgtatatttaaaatatatacgaaagaactgctaaaaaaaaaa

SEQ ID NO: 713554 - DNA, 411 bp, Homo sapiens
ggtcccagctacttgggaggctgaggcaggagaattacttgagcctgggaggcggaggttgcagtgagccgagatcgcgccactgcactccagcctgggcaacagagcaagtgtctaaataaaaagaaagaacacgacagacagacaggaaggaaggaaggaaggaaggaacagcggaaacgaaaggcaggaacggaaggacaacagcacagacacggaaggaacggacagcggaacgcgcaggaagggaggcacgaacagacagagaagacgacaacgacagtgttacttccttatttcgccacgggtgacgggtggcggacggcgacaaactagcgcctgttaccctctgtataataggcccctagaattaggccgacaggcagacagagtctcacttctgatcgccat

SEQ ID NO: 713555 - DNA, 681 bp, Homo sapiens
cgcagtggctcacgcctggaatcccagcactttgggaggccaaggcgggcgaatcgcaaggttaggagtttgagaccagcctggccaacatgttgaaaccccgtctctactaaaaatacaaaaattagccaggcatgatggcaggcgcctgtagtcccagctgctcgggaggctgaggcaggagaattgcttgaaccagggaggcggagattgcagtaagccaagaccatgccatcgtactcttgcctgggtgacagagtgagactccatctcaaaaaaaaaaaaaggtgggcttctttgaccacagtccttctcaagctgccatctcatagtggtcctctctcctttctactttaaaggacccttattgattatttggggcctacattagataattacagaattgatctccctactttaaaattcaacgtgtttagcaactttaattcccattgggcaaccttgtgtaccattaacattacgtcacattttggggcatttagaccgtggatatcatggggtgggtgagaagcatttatccagtttaccacttacaccattctattagaccaagaacctaaaaccacttgatcatctcattagacaaggaaaccccattgggctgggtacggtggctcatgcctgtaatcccagcctttgggaggctgaggccggaattcg

SEQ ID NO: 713556 - DNA, 186 bp, Homo sapiens
gtcgagtcggagctgtacttccttatcgcccggtacctatcggcgggcccgtgtcggagagcggcccaggtgctggtgcaggagctggagcagtaccagttgttgccgaagagattggacttgggagggcaacgagcacaacaaggagcttcaggagggagttggtcttgtccattaggcatttgg

SEQ ID NO: 713557 - DNA, 658 bp, Homo sapiens
acatctgggcccttagttttattctgttattatatgtctctgtctctctctatgtgtgtgtgtgtgtgtggtgtgtgtgtgtgtgtgtgtgtgtgtgggcagagagtgccacccacagggctgctgacaactctctctattcacctccatgtgtgtgtgtgtgtgtatctgtctgagagaattccgcggggcgccatgcagggcgtatctcgagaggggagagagcgcgctctctctacgtcgtgcgcggccccgtcgtagacacagcaggggtccaccccaccagggacgacccagacgcgtgtggagggcgcctatgcagacgactggggtgtgtggctggctgacgcagagcagagaccccccagatacataagacgtgggcataaacagagggagaaaggtagtggccaacccttctctctctactacctacctattgccataaaacgcccagagatgacagctcgtgacaaagctgctctcggtggagaacaccctggacacgttggagaggagaagcggcgacgagaaaacgaggactctccccatcgggggccctgatccagatcctgtgcaccaacacaaagacaggtgggggtcccccgtggagaaccccgtcagtgtgacaggcccgctctgtgcgccacagatcggg

SEQ ID NO: 713558 - DNA, 874 bp, Homo sapiens
aggtgggctttcccctcacttgtcattggaggcatctttgggaagtacgacgccagcccctattgaagcacccttgtcgcaccgcagaacgatcgcccgggagattccacgcccagccatggtacaagtctactgtcatcgcacatgactgttggaggcttcctgcctttacagtgcacatctactgtggacactgtactacatctttgccacagtatggtgctcgggagcagtacactttgtacggcatcctctctctgttgtcattcgccatcctgctgagtgatgggtggacttgcatgctcacattgcagctcactctacattccagatttgtttctgcgggacgggacttatccgcctggtagagtggacgagtcatgtggctgagtgatattggctccacacggcctcgttcatcgttccctctactgcagttcttctagttagtgcctcggcgcttccaacattgtcttgggtgcacgtacacgagcagctagaagttcatctcggctagcatccgttagctcacatggtctaatgttcttcttcgcgtcagtgcatgggcagcgcagtctcccgttatgtttgtcgttctcctaaagattcatgccggtagtatactagtgttaagcctcaagtactggaactgagttgcgtgtactggcagaactatttgcatgttctctcccgtgtcattcactgccctgttgaactctcgctaccagcgtctcttctgattgactgaattgtgtgatggcatcgttgccttcccttttgccctattgggcattccttccaccagagagggcctggaaattataaatctctatcacataaggattatatatataactcttggagtgcctttagt

SEQ ID NO: 713559 - DNA, 317 bp, Homo sapiens
ggggggggggaaaaaaagcatttagtataatgttgccttatttgttagttaattaagtacccttttaccagatagtactgttgttagctaagattaagatttgtaaagagcgcgcaacatgttcaagagccagtccgcagctttttagtgaatgggacctcttatgcaagcctttttaaataggttaaagtgcgtttttcacctgaagcatgttatttaagctgtttttggcagtattgttgagaggtgccaaaagtacatgtttgcacctttctagttgaaaataaagtgtatattttttctataaaaaaaaaaaa

SEQ ID NO: 713560 - DNA, 1082 bp, Homo sapiens
  misc_feature (10)..(10): n is a, c, g, or t
  misc_feature (46)..(46): n is a, c, g, or t
  misc_feature (141)..(141): n is a, c, g, or t
  misc_feature (200)..(200): n is a, c, g, or t
  misc_feature (202)..(202): n is a, c, g, or t
  misc_feature (220)..(220): n is a, c, g, or t
  misc_feature (244)..(244): n is a, c, g, or t
  misc_feature (277)..(277): n is a, c, g, or t
  misc_feature (283)..(283): n is a, c, g, or t
  misc_feature (287)..(287): n is a, c, g, or t
  misc_feature (310)..(310): n is a, c, g, or t
  misc_feature (328)..(328): n is a, c, g, or t
  misc_feature (337)..(337): n is a, c, g, or t
  misc_feature (353)..(353): n is a, c, g, or t
  misc_feature (359)..(359): n is a, c, g, or t
  misc_feature (375)..(376): n is a, c, g, or t
  misc_feature (383)..(383): n is a, c, g, or t
  misc_feature (408)..(408): n is a, c, g, or t
  misc_feature (413)..(413): n is a, c, g, or t
  misc_feature (415)..(415): n is a, c, g, or t
  misc_feature (419)..(419): n is a, c, g, or t
  misc_feature (435)..(435): n is a, c, g, or t
  misc_feature (450)..(450): n is a, c, g, or t
  misc_feature (455)..(455): n is a, c, g, or t
  misc_feature (462)..(464): n is a, c, g, or t
  misc_feature (480)..(480): n is a, c, g, or t
  misc_feature (494)..(494): n is a, c, g, or t
  misc_feature (503)..(503): n is a, c, g, or t
  misc_feature (528)..(528): n is a, c, g, or t
  misc_feature (539)..(539): n is a, c, g, or t
  misc_feature (549)..(549): n is a, c, g, or t
  misc_feature (589)..(589): n is a, c, g, or t
  misc_feature (598)..(598): n is a, c, g, or t
  misc_feature (610)..(610): n is a, c, g, or t
  misc_feature (618)..(618): n is a, c, g, or t
  misc_feature (631)..(631): n is a, c, g, or t
  misc_feature (633)..(633): n is a, c, g, or t
  misc_feature (673)..(673): n is a, c, g, or t
  misc_feature (739)..(739): n is a, c, g, or t
  misc_feature (855)..(855): n is a, c, g, or t
  misc_feature (867)..(867): n is a, c, g, or t
  misc_feature (896)..(896): n is a, c, g, or t
  misc_feature (912)..(912): n is a, c, g, or t
  misc_feature (952)..(952): n is a, c, g, or t
  misc_feature (1019)..(1019): n is a, c, g, or t
  misc_feature (1068)..(1068): n is a, c, g, or t
attacaaaanaaattttattattacaaaacatacaatctcacaaangtacaatttgaaatacggggacacccttctaactaccacccaggtgaagaaacagaactttgtcaggcaccccagaacccctccaagtgcctcancacaatgacaactccttccctctagaagtagccattattcttgtatagtactgactgtntntctttatggttttatctnattttttagagacagggtcttgtnctgtcacacaagaacaagtggacaggtggagtncagtgntgtncatagctcactgcatcttgagcncctgggctcaggtgatcnccctgcctnagcctcccaaggtgcngggatnataggcgggtgtcacnncacccancccagttttattttttttttgaganggggncntgcnctgtcacccaggtgtngcccaggcttgagtncagtngcgcgannncagcccactgcaaccnccgcctcccaggtncacgcaatnctcctgcctcggcctcccgagtagngggatacaggngcccgccccntgcctggctaattttttgtatttttagtagagacggggtncaccatgtnggccaggctggnctcaaacnctgacctcaagtnanccgcccgcctcggcctcccaagtgctgggattcagatgtnaggaccgtccaccgtgcccggccgagttttattcttgaatcgtgcatgtctctgttcactacagtntagtgcaccatttaaataaatttgttgtcttttaagttcatcaaaaatatttcttttgaagcactataataatgctggtgatggaactcgccaccattattccctgggagcttctngcagattctgtnagttggaatctctaattcttttctcagtngacctttttacttgantcccacagtactttaagtagcttctttttttccagggttnctttgctctttttttcctttcttgtattttcttcgccgcttctcgtttttctttgttaacaggactntcttcaccattgtagaaacatctactttctcttgtaggatttccgagcnagcttctgtgctga

SEQ ID NO: 713561 - DNA, 125 bp, Homo sapiens
ttgaattatgacctgcttttttgcgggacagttttaatttgtttggaggagtgtgtaccaaaagtacatgtttgcacctttctagttgaaaataaagtgtatattttttctataaaaaaaaaaaa

SEQ ID NO: 713562 - DNA, 802 bp, Homo sapiens
  misc_feature (16)..(16): n is a, c, g, or t
  misc_feature (37)..(37): n is a, c, g, or t
  misc_feature (40)..(40): n is a, c, g, or t
  misc_feature (43)..(43): n is a, c, g, or t
  misc_feature (46)..(46): n is a, c, g, or t
  misc_feature (58)..(58): n is a, c, g, or t
  misc_feature (62)..(62): n is a, c, g, or t
  misc_feature (84)..(84): n is a, c, g, or t
  misc_feature (91)..(91): n is a, c, g, or t
  misc_feature (96)..(96): n is a, c, g, or t
  misc_feature (111)..(111): n is a, c, g, or t
  misc_feature (116)..(116): n is a, c, g, or t
  misc_feature (125)..(125): n is a, c, g, or t
  misc_feature (153)..(153): n is a, c, g, or t
  misc_feature (182)..(182): n is a, c, g, or t
  misc_feature (194)..(194): n is a, c, g, or t
  misc_feature (197)..(197): n is a, c, g, or t
  misc_feature (206)..(206): n is a, c, g, or t
  misc_feature (210)..(210): n is a, c, g, or t
  misc_feature (213)..(213): n is a, c, g, or t
  misc_feature (249)..(249): n is a, c, g, or t
  misc_feature (254)..(254): n is a, c, g, or t
  misc_feature (259)..(259): n is a, c, g, or t
  misc_feature (280)..(280): n is a, c, g, or t
  misc_feature (287)..(287): n is a, c, g, or t
  misc_feature (290)..(290): n is a, c, g, or t
  misc_feature (292)..(292): n is a, c, g, or t
  misc_feature (300)..(300): n is a, c, g, or t
  misc_feature (313)..(314): n is a, c, g, or t
  misc_feature (316)..(316): n is a, c, g, or t
  misc_feature (344)..(344): n is a, c, g, or t
  misc_feature (348)..(348): n is a, c, g, or t
  misc_feature (354)..(354): n is a, c, g, or t
  misc_feature (356)..(356): n is a, c, g, or t
  misc_feature (359)..(359): n is a, c, g, or t
  misc_feature (362)..(362): n is a, c, g, or t
  misc_feature (365)..(365): n is a, c, g, or t
ggcggtcacgcccggnaggctttctctggctggtaancgntantcncggacaccagancacngcttccgtacacaggggcccgnatcccancctcncggacctaagagccngggtnccctgtatncggaggtccgcttcccgggccccagatnctggcatcccagccctcagtgtccaaganccaggcagaccnggntccccgacngccnggntccaggcgtccgggatctgcgccaccagaacctagncctcnctgcnagacctccgccatctgggggnactcaanccncntggagccnaggtgccccacgnncncacccagagaaactctcgtattcccagnttcncaggangnaanccnggncgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaacccggtgcttcccatcatggtggccgatcctcctcgagactccaaggggctcgcagcggcggaggccaccgcaacgggggccttggcgctggctccatcgaggaccaaggcgcggcagcaggcggtactggggttccgggacaggtgcgccgtgcttcgagccaactggctgtgctgctgaacagtgggg

SEQ ID NO: 713563 - DNA, 248 bp, Homo sapiens
ggacaactgggacacgggggacgagttggcgtgggatgaagaactacgaggggctccagcagctggacagtctagtccacttcattttagtactggaaagactcatcgccggtttcatgtgagaagacccgtgcggatgagggcttctgtcaccgaaaaggggtctgcagttggcagaggggcgacgatcttcaaagtaacccttcttctcctggccaacagtccggggaatgcgtatgctggcgcta

SEQ ID NO: 713564 - DNA, 264 bp, Homo sapiens
atactaccagttgaaattagacataggcgtaatcaaagtttaaacacaggcgattttgcctagtacctaagatgtcaatgttccaggaaatgaatatgaatcagtcttatttcttactccaatgatttgtgaaagggatcactcaaatatggtccaaattaagatgtaactgttaaacttctaatctgtaaagttcatgtggtcttctgtgagaaacacaatgttttatttttatataacttccagtagaattcactcaaaact

SEQ ID NO: 713565 - DNA, 400 bp, Homo sapiens
gagtgcgcgaagaaacggcggcctcagcgtgtggcacgtatggcttctcccgcgagcaggaacaacaggaacagttgatctacagcgacgaaggcatcgtcgggcaggccgcccagcgcgatcgcctgattcgcctggacgatgtgccggtggattacttcaaggtcagttccggcctcggtgaaggggccgcccgcagcgtattggtggtgccaaccagcgatgatgaccgtgtcaatggcgtggtcgagctgggtttcctgcgcccgctggatgagcgtgatatcgaactgctggaactgatcgccggcaatatcggcacctccatcgaagccgcgcgctatcgccagcgcttgcaggaagtgctggccgagacccagcagctcaacgaagaactgca

SEQ ID NO: 713566 - DNA, 584 bp, Homo sapiens
ctatgaggagataggcatcttcgtggagaaggctcaggatagatcccagcactgtccgtgttccgggcccagactgggctgtccttcctggtgccctgagcctgaggacctggagggacctgtacagccgctacaagaagcttgcagcaagagctggagttcctggaggtgcaggaggaatacattcaaagatgaggcaaacatgaacctttgaaaaacggaagtttctccagtgcccagggacggagcgttgaccgcgaagtccaaaggcatctccgcttggttcactcgtgagcaagtttccttggcacgggctggtggcatcacgacatatccagggtcaatcgggtggggcttcctacccaacgaggggcgtcccagaagcgtaatatcagtttggttgccagcgagtttcccgttggagggccagagcccaattccggactcccgggggaaaggccttggccttccaagaaggcccgcaaagagtggcccgttccatgttttggtgcccccttccccaaggaaaagggcagacaatggcgaagagttcggcagccttggggttggggacccagttagcg

SEQ ID NO: 713567 - DNA, 761 bp, Homo sapiens
  misc_feature (761)..(761): n is a, c, g, or t
aaattctgcatgcttaaagacacccatgtttaagatttttcatcactaacgtatccattaaaagtatcaactggccaggcagggtggctcacgcctgtactcccggcatttgtgaggccaaggtgggtggatcacctgaggtcaggagtttgagaccagcctgaccaaacatggcgaaaccccatctgtactgaaaatacaaaaattaggcatggtggtgcatgcctgtagttccagctacttgggaggctgagacaggcgaattgcttgaacctgggaggcagaggttgcagtgagctgagactgtgccatgcactccagtctggttaacagagcaagacactgtctcaaaaaaaaaaaaaaaaaaaaaaggtttccacccacaaattgttcccaaaatacggggactccaggggggaaattgtcccttataatttttcaatcccttttccaaaagagggctgggggctttcccacttaaaattgggaaaacggggtatattacaccctaacatctcaacatcttccaacagcagaatgagggttttcgggaaatgccccccttaattatatatctaaagtattcctttctcacgaaaatttggacactcggagattggtgttcccccattctgttggggcccattaaacttcacatcttgcactccacgtctatcggacaggaataataggccccctgggtgtaaactgcaatccctcatcggagacggcgccggcttcgatgggttgaaccgacattn

SEQ ID NO: 713568 - DNA, 928 bp, Homo sapiens
gccccacgatgatggctggcaatggctggtggctgctgcggggattagcgagtggctgcttcctggtggcgtgacgcaggccgtggcggggctggggtgcgtggtgcgcggctgcgtgggcgcagcagcagggtcatgcgggactatgatctcctgtgtggtcggcgtggggatcttggtgtgcctggcttgtgccaaggatggcctgctcaggctgtggaagtgaaggtgtcctgtggtggactacgtggaaccttctccccaaggcacccgcgtggggcctcgcgctggcacctgctgtcaacgtggtgcttgcatccccaaagaagctgatgcaccagtgctggcactgctgggaggcctgatccaagatgcccccaactatggctgggagtgtggcccagaccgtgccgcatgactggaggaaagatggcacgaagctgttcaacaatcacgtgaaaatccttgaactggggccaacccgtggtccagcttcaggacagaaaaagtcaccgtactttaacatcaaagccagctttgttgacgacgcaacacggtttgcggctgttgccaagatggtgggaacagagattctgctgtcagccgatcacatcatcatttgctactggattggctggccgagattaccccaactgcaacatcgaaagtgtgcctttgagaatacttggaatcaccacgtgattgaacatcttctggcttgaacggaatcccctggaaaaaacgatggtcggtcgggggaccaggatattgttggggcctgggagtattggttgcttcctcaacctgacgattgtgcttggacaacaccaataattgatgcgcagaattcccctcggcggtatcagacaggcgagatgtctcactggtctataagcacattggaattccatggcaccggtcctaaagg

SEQ ID NO: 713569 - DNA, 107 bp, Homo sapiens
cctttgtcttaacttagctcataacatttttgcagtgttggaggttaatgagctggagtctcgctctgtcgcccaggctggagtgcagtggtgcaatcttggctcac

SEQ ID NO: 713570 - DNA, 111 bp, Homo sapiens
gacgtggcaagtctcagatgcatgtttggagagtcagatcttactccttgtaatatctttcgataaacagcaaggtggtgtgatcttaatatatttgaaaaaaacttcatt

SEQ ID NO: 713571 - DNA, 1035 bp, Homo sapiens
ctgaaaggcaagcatttcacggatcagtcaataggcagcaatgcagtatagactcaagagtgtcgtgacaatgatgtatatacgagccaggcagctgtgcactgacatgtgccaagccacgactagtgatctgtctgtgtcgtacatgtaagagtgagggagggaaggaaggaactacagagagcagtcggcagcatgatgacagtcaggacacaacaaatatccccagtgcgcagttgaatgcgtctgtggttgaccagcatgattccttgcagatctaggaatgcatacgcaatgcacaggtccatgaaataatcaggagctgtaacgtaaagatgtaggtgaatgacgtgtaaagcatcatgccgtgaaggtcaaggcaggacaaggtaagcctagccattggtaacgagaatagcgtcaagcgtgacaaggacatagcagaatcgacatgtcatgtatccatcgtcccatgcgcttcctctactcaaggacttgtcccgtcgcgtggaagagacggcttagggtaagatcttgggcacaggcaagctttctcgttaactgataaaagttggaatagacattacaaacaacaccagtgcgactattccaacagaattatagcgcaatgtagaaattagggatcagacggagtacgtaattgtccagaaactagatggataaaagcatacaaccatagggagcgagtatagctggaggtgattagcgacaattgtggcggtattaggaacgcacagtgaggagcacaataagggcgtaaattgtatgtaggaacagtggagcaccgaggagattgcgtggtacaagtggactggtgtaaacagtaatgcgccacataggtatgaaaactgcgtaaccaaatataggaaggtcgataggcctagagatgcgggaagggacagcgaagtctcggggaaggcattacccaaaggattggacgaaagtaatcgggcacacactcgtgagacataccagaaatcgcaagagttccgaagaaccaacaacaacacaagg

SEQ ID NO: 713572 - DNA, 881 bp, Homo sapiens
  misc_feature (19)..(19): n is a, c, g, or t
  misc_feature (48)..(48): n is a, c, g, or t
  misc_feature (85)..(85): n is a, c, g, or t
  misc_feature (122)..(122): n is a, c, g, or t
  misc_feature (125)..(125): n is a, c, g, or t
  misc_feature (127)..(127): n is a, c, g, or t
  misc_feature (238)..(238): n is a, c, g, or t
  misc_feature (248)..(248): n is a, c, g, or t
  misc_feature (254)..(254): n is a, c, g, or t
  misc_feature (262)..(262): n is a, c, g, or t
  misc_feature (291)..(291): n is a, c, g, or t
  misc_feature (393)..(393): n is a, c, g, or t
  misc_feature (408)..(408): n is a, c, g, or t
  misc_feature (416)..(416): n is a, c, g, or t
  misc_feature (420)..(420): n is a, c, g, or t
  misc_feature (422)..(422): n is a, c, g, or t
  misc_feature (444)..(444): n is a, c, g, or t
  misc_feature (459)..(459): n is a, c, g, or t
  misc_feature (481)..(481): n is a, c, g, or t
  misc_feature (630)..(630): n is a, c, g, or t
  misc_feature (669)..(669): n is a, c, g, or t
  misc_feature (684)..(684): n is a, c, g, or t
  misc_feature (693)..(693): n is a, c, g, or t
  misc_feature (738)..(738): n is a, c, g, or t
  misc_feature (759)..(759): n is a, c, g, or t
  misc_feature (762)..(762): n is a, c, g, or t
  misc_feature (770)..(770): n is a, c, g, or t
  misc_feature (777)..(777): n is a, c, g, or t
  misc_feature (798)..(798): n is a, c, g, or t
  misc_feature (880)..(880): n is a, c, g, or t
ctgcgactcagcgaggccnacagccgcgtgcagtcatcgcagttcganatcggagagctatacgactccatcacccggccctggngcgctgctacgtgggcaaccgccggcccatctcccancanantggcgccatcatcttccagcccatcaacaggacggtgcctctgcggtgcctggaggagcattatggcacctccccaggccaggcccgggagggcagcctcaccaagggaangccggatgtngccaanaggctgancctcaccatgggtggcgtccaggcccgancagcagaatttcgcccacgcgggaaacctcctcagaacacaaagcaaaagacgttgtgtatccagcccgcctgcctgtgatcacatcgcatggacagaaganccttgtccctcaaancccaccantcananagctacctgccgattggctgcnagctgtccacctcantcctcgggtgtggacacaagcncctgcccaaactcacctgtgttcaggacgggaagcgagcctgccctgagcccaccagtggttcggagggtctcctcagacgccagggctggggaggcgctgaggggatcagcacagtcaactgtgccctaagcccccgcctaagccctncaagtgccgttcctcaaggttccctcgtctccctctgcntggctcaactcagangccaactantgtgaactgaacccagcgtttgccacaggctgcggcaggggagcnaagctaccctcatgtgcccanggnagccacanagaactnctcacagccaagcagaatgangcgccaggtacccggaactctggcgtcaactacttgatccttgatgatgatgacagggaaagaccttgggaacctgcggcanc

SEQ ID NO: 713573 - DNA, 755 bp, Homo sapiens
tgaggggcagtgctcgcggtcggtgaggcggggtgtcatggtgagaccaaaagtcaggcccgaagacgtgaccgggtgctctaacagacatgtccttacatcccggtggccgaggattccgacttccccatccactattctgccctacggcgtcttctcgaccagaggcgacccaagaccgaggataggtgtggccattggttgttcagatcctggacctcagacatcatcaagacacctctttactggtacctgtaccgtactccaaacaccaggatgtcttcaatcagactacatacaacagcttcatgggccatgggtcaggctgcctggaaggaggcagagagtgttcttgcagaacttgctagtctgtgagccaagccagggctcagagatgacaccgacacttcggaagtgtgcatacatcatccacaggattcatgccaagatgcaccattccagcacaacataggacgaataccacaagacttactataaccttctcggacagacatgataaccaaacgtcgcgaatcatgtacaagcggacaacggagaatgccgtatgatgcacaacatcgggatagaacaaaaccagaggagctaccattggcacgaagccatccatcatggtcgagcgctgactgtgaacacacaacacccgaaaggcccatgggaaaaggatgaaccatgatgacactaaagccaccggacaatgggagcaagcaagcacgagggacaaggcgcagggaaaa

SEQ ID NO: 713574 - DNA, 424 bp, Homo sapiens
tctcgcgttgggctatgcttatgtatagtcgaagtggtatgtgcgccctagattgtctattgctagtatgctttggtatgcgggctctttatcattcatatgaatataggatgcttttccagcttgtgaagaatgttggtgatactgtgatgggaatagcactgaatatgtagattgcttttcgcagtatggtcatattcacgatattgattctacccatccatgagcatgagatgtgtttccatttgtttgtgtcatctatgatttctttcagcagtgttttatagttttcattgtagaggtctttcacctccttggtaacaggtatattcctcagtattttattttattttttgcagctattgtaaaagaggctgagttctctgattgattctcagcttggttactgttggtgtacagcagt

SEQ ID NO: 713575 - DNA, 117 bp, Homo sapiens
tatgtctctcgttatccatcttggtgcatcctgactaacaatcaagatgatgctcacagcagctacaaatatggcttttgcagctgtgaactacagtcttacaagtttgtttctgga

SEQ ID NO: 713576 - DNA, 707 bp, Homo sapiens
cacatctctgcaggaagtcctcagtccctccaaggaactcacgttcactaggtcaagctcatcagataatctgtctatcttatattggaccgacttgggatctcgattacatctgttaactcgttcatgccatcaatagtgacacaatcacaggagtgacatctcctcagtagctttgtctacactctggaggaagtgattatatatgagcacagatcactgggggtcatctcaggattctgtgtaccataatattataaagacacagctattaaaagagtataacagatttctgcttctgtctggtagaataaatcatatcacactaaccctgcctgcataaaccgtataatcggtttcatcagtgtacaccaggcagtccacgagctcaagggggaagccccacgacttgctagatgtctggggagaatttctcaccagctgcatagtgagctagagtgcactcatggcagggcagctcactgagctgagaaggcacagatcacagttcatgacggctgtagcaactgcaatctgcagggcagggcaccacagtggagacagctcgtctaaggtgcagctctcatagtctatgtggagagtcatgtgcgtacttatcatgggagtggactctacctgcacaacgcacatgtacttgaggtggaagaaggttggcgattgttataggagggtctgcctcctgttgg

SEQ ID NO: 713577 - DNA, 329 bp, Homo sapiens
tctgctgccgcccgcaagcagagggactcggagatcatgcaggggaagcagaaaaaggcaaacaagaagaaggaggaacccaagcagctttgcggcttcgcgtccaaccctcttgcccttcacctacgcgcctagagccagtcccaccacgctcgcgtttcctcctgtagcgctcacaggccccagcaccgatggcattccctttgacctaagcctacagcaggccccttttgtgcttccttcccctcaggcagcctctttccccctgggccactcccgggggtgagggggttgtccttcccgatgctttttgttaccgtggggtttgc

SEQ ID NO: 713578 - DNA, 945 bp, Homo sapiens
  misc_feature (382)..(382): n is a, c, g, or t
  misc_feature (426)..(426): n is a, c, g, or t
  misc_feature (430)..(430): n is a, c, g, or t
  misc_feature (436)..(436): n is a, c, g, or t
  misc_feature (438)..(438): n is a, c, g, or t
  misc_feature (452)..(452): n is a, c, g, or t
  misc_feature (466)..(466): n is a, c, g, or t
  misc_feature (472)..(472): n is a, c, g, or t
  misc_feature (485)..(485): n is a, c, g, or t
  misc_feature (530)..(530): n is a, c, g, or t
  misc_feature (578)..(578): n is a, c, g, or t
  misc_feature (605)..(605): n is a, c, g, or t
  misc_feature (612)..(612): n is a, c, g, or t
  misc_feature (616)..(616): n is a, c, g, or t
  misc_feature (650)..(650): n is a, c, g, or t
  misc_feature (667)..(667): n is a, c, g, or t
  misc_feature (669)..(670): n is a, c, g, or t
  misc_feature (735)..(735): n is a, c, g, or t
  misc_feature (755)..(755): n is a, c, g, or t
  misc_feature (865)..(865): n is a, c, g, or t
  misc_feature (873)..(873): n is a, c, g, or t
  misc_feature (919)..(919): n is a, c, g, or t
ggactccagaaagcctgaaaagctatcatggcagcaaggcccaaagcatccactatcccaacggaagaggccggatggagtccgtgagatgggttttagctagccagccggagtcgagtttagatgaagaatttctaggaaacaaaagaaacagttagtacaagttgcagagatggtaaccacctgctgttccaacaagtagcccatgggtgaaattgacgggatgaagttggtacagacccgaagcattctccactacatagcagacaagcacaatctctttggcaagaacctcaaggagagaaccctgattgacatgtacgtggaggggacactggatctgcatggaactgcttatcatgcatcctttcttaaaaccagnatgatcagcaaaaggaagtggttaacatggcccagaaaggctantaanttggantnctttcctgtgtttnaaaagattttaacngggttnacggaacaaaggnattacttgttgtgtaatgcagctgaggccttggcagagtgtgatntttactccaaaaccatttttagctctagaagagaaaaattccataaanatccatgtctgaatttcctttcctccnggaatanacangtgaaactaaagtactatccctacaattaaaganattccttgaacctgggngnnagaagaagcctccccctgatgaaatttatgtgagaaccgtctacaacatctttaggccataaaanaacacatccatgtgtgagtnacagtgtgttcctagagatggtattgtctacagtcatgtcttaatggatcccagctctgtcatggtgctatctatgtattaagttgggtctaagttgggtcttttgtgtnaagagatntctcttctagaatatcaccttttttgtcagtaaatattgtaagggntcttattggaaactttttggagaggc

SEQ ID NO: 713579 - DNA, 666 bp, Homo sapiens
  misc_feature (582)..(582): n is a, c, g, or t
aattcaggcttaccaacattgaactcgatcgacaagtctgagtgcgggtctgacgaagttccgaaagagatcttgacaactctggtgtgacggcgttgactgtcacatgccattggagccgacgacatggtcggcacgtgatgagggtcagcaaggctgctggttctcacctgatggtcccagcaccgcaccgtaggagagccgatgaggtttcgtaccgctgtcaccctggcactgtttggagcgctcattggcggtgctccaggcgcagtcgcagcccccaccgcttccgccacgaccaccacgacctatgtagattgttcggctcccacgcccggcagggggaccgaaacgagcccgttgaactccctaacccagctcaaaagtgcctttggcccaggcaggaaagtgctgttgcgtcgtggtagtacgtgcgttggcactgtcgtcatcaatgcctccggacgcgccggtgccgacactctactaggtgcctacggtgtggggaagactccggtgatcgacgccaaggcctcggcgcacaatccgcgttcggccatcgaggtcgacaacaagtcgcanttcgtcatccaggacctcaccgttcgcaacggctatttcaatgacatctccgtcgaggctcaatgcttgctgggatcctctgag

SEQ ID NO: 713580 - DNA, 259 bp, Homo sapiens
ccctatgagaaaatagcagtagtaagacattgacactgtgaagaaactacatcacacaatgggcaaatacccagctaggatcaaattcacacataacactattaaccttaaatgtaaataggctaaatgccccaattaaaagacacagactggccaataggctacagagtcaagacccattggtgtgctgtattcaggagacccatctcacgtgcgaagacacacataggctcaaaataaaggggtggcggtggtatag

SEQ ID NO: 713581 - DNA, 357 bp, Homo sapiens
taaggatatctaatggccaaagttcatgatagactcactgctgccactatcatgctagtaaatacatactcaatgctgtagtcaggtcacacaggcagccgatagattatgtactggaagtattaggagagtccagagagaggatgtaagccaggactgtgtactgaaatgccagaggcaactatgtggatataacctgtaatcccagcactatttgggaggccgagatggacggatcatgagctgcaagagatcgagaccatcctagccaaaatggtgaaacaccgtctctactaaaaatataaaaattagctgggtgtggtggtgtgcccctctagtcccagctagtcaggaggc

SEQ ID NO: 713582 - DNA, 839 bp, Homo sapiens
aactacaagttgaggtcagtggcacatctgcctgagaaggcattcgcgtacaaggctttcaacaccttcatgaatgacgtctttgctttcatcatcagcatgcccacgtctctacggctggcctgcttcagggacaacgtggtgtatctggtctacctgtacgagcggtggctttatcctgtgcataaacgcagagtgaacgagtttggggagtcctacgagaagaaggccacgcgggcgccccactcggactgaaggccgcctgggctgccgccagccaagtgcaacttgaattgtcaatgagtatttttggaagcatttggaggaattcctagacaatgcgttttctgtgttgccaaaatcccttcggacatttctcagacatctcccaagttcccatcacgtcagatttggagctggtagcgcttacgatgcccccacgtgtgaacatctgtcttggtcacagaagctgggtagctgcccagtcaccttgagactgtggtggctacccaggcacacgagatgtcccggggttacgagccatggtcctacacagcgggacagagtggtgtggaggccactcaccagagcaacgcgggtgcctgtgtgtgatgttcacatattcaaggatgggtttctcgtagagctgcctcccttatagtggatatattcacagacacccgtatgagaaattccatatccgacactgggcgtcatggggatcataaggtcttctttgcctactttatgtttgaagaggttgcgttgtatttaaagactataatcgtactgtttcctatttttaaaagtaaagttgtttcaagaactgtggcaaaaag

SEQ ID NO: 713583 - DNA, 854 bp, Homo sapiens
gggagttcctccttgctctcgcccctactctttctggtgttagatcgagcaaccctctaaaagcagtttagagtggtaaaaaaaaaaaaaacacaccaaacgctcgcagccacaaatggggatgacatttcttctggacatcctccgtgcttctcccgtactgatcgtctgctcccttagagtccttcgtgaagcttttattcctaagaggagaaattcagtcaccggcgaaatcgtgctgattacaggagctggcccctggactggggagactgactgcctatgaatttgctaaacttaaaagcaagcgggttctcggggatataaatacagcttggctctggaggaaacccgctgccaattgcaagggactgggtgccacaggttccatacccttgtggggtcaactgcggacgcgagaagatttttacagctctgcacaagaccggtgacgggcagaaatgggagatgtcagtattctacgtacataatgctgggtagtctatacatccgatttgtgtgttaccaagatcctcagattgacacgcctttgacggtgcatgtactggcccttttcgggctacaagggctttttcctgccatgacgaggatccgcatgccctatgtcgtgtgctcgggcagtgggctgtcccggtcctctttactggttatgttcaagcaggtgcgtgggtggttctcaccttggccgtcgccggcctccattctggtccaccctgtggccattcggacggtctccactcgcgtgggccccggtcggggtgacggggtggttctggcagttccctcgtacaggggccgtcgcacacctggtgttaccctttcttttttctttt

SEQ ID NO: 713584 - DNA, 187 bp, Homo sapiens
gttcagaggatcccaagcttacgaggtcaggagatcgagtacatcctggctaatacagcgaaaccctgtccctgctaaaaatacaaaaaaattagccgggtgtggtggctactcgggaggccgaggcaggagaattgctggaacctgggcaggtaggaggttgcacgcgagtcgactatcatgccat

SEQ ID NO: 713585 - DNA, 172 bp, Homo sapiens
ctctgctcggaccctcataatgtagagcatttcctggaatatcttctgcagccccaggttcatctcgagcgcaacaccgggcgggagcgcaacaccgggcgggagcgcaacaccgggcgggagcgcaacaccgggcgggagcgcaacaccgggcggagcgcagcaccgggcg

SEQ ID NO: 713586 - DNA, 356 bp, Homo sapiens
acccccggtgtgggctcgttggcagtgacttgcacgatcaggctgagcatcccccgtgtgtctacgtgaaccagcgagtcgtaaagcggaggagggtgcttcgtatcgcaaggtagggaggagctggtgctgcctctgcagtcatctgggcagcctgaggtggctttcccatgatctagcctggcctccagcctccatctcctcagtaccttatggggctgttctaggaattcctcaaaacaacgtgtgtgagcgcaacaccgggcgggagcgcaacaccgggcgggagcgcaacaccgggcgggagcgcaacaccgggcgggagcgcaacaccgggcggagcgcagcaccgggcg

SEQ ID NO: 713587 - DNA, 180 bp, Homo sapiens
ctgccaggaaaaggtctgtgcgggtgagggagcgcatcctatggatatctagaggaagagcggaacaccgggcggagcgcaacaccgggcgggagcgcaacaccgggcgggagcgcaacaccgggcgggagcgcaacaccgggcgggagcgcaacaccgggcggagcgcagcaccgggcg

SEQ ID NO: 713588 - DNA, 267 bp, Homo sapiens
taaagggtatggctttggtgatagcataaataatggtttccctttttggtgaatggtaaattaattggctgggcaactttggtattcccatagacgggggaagcttaatggcctttacaagtacttatgtacaacttggtatcaaattttctggtaatagttaatgctttagtactattattttgtactaataattttatctggacttctggtgttatatcatttggtgacaattacatgggttggtaaaataaacttttaaacctc

SEQ ID NO: 713589 - DNA, 455 bp, Homo sapiens
  misc_feature (107)..(107): n is a, c, g, or t
  misc_feature (209)..(209): n is a, c, g, or t
  misc_feature (218)..(218): n is a, c, g, or t
aactgttaaagcgcgctaacagtacctgccctgtatgcttcacaagggtatgattattgcaatctgaaagaattttgtttcaacaaaagcaagtttgcctgaagganaatgagctgtgtaaacagttaacgaattaggaatgccactccatatgtacagaaagtgttccaagaacactggcttattcactaaacccttactgctactgnacagggttngtgtgccaaattctgtgctagtcactttcatgtattgtctatttcacatttctaaaggtaataaccaaaatctggatcatttgaaagatcctacaaatttactttataacagaaaagtcatacctagaataatgtctttgtctggttgtgttgccataaaggaatccctgaggctgggcagtttataaagaaaagaggtttatttggtgcacagttctgcaagctgtacaagaaaga

SEQ ID NO: 713590 - DNA, 468 bp, Homo sapiens
  misc_feature (196)..(196): n is a, c, g, or t
  misc_feature (240)..(240): n is a, c, g, or t
  misc_feature (268)..(268): n is a, c, g, or t
  misc_feature (329)..(329): n is a, c, g, or t
  misc_feature (393)..(393): n is a, c, g, or t
  misc_feature (422)..(422): n is a, c, g, or t
caccactgttgtatctggtctctgctcaatcacgggtgctgccagctagtcacccagactccagctagagtgttactataaacttcattctcttctattactccttgtcccttttcatgcacataaatcccaccaatgctggccatcatgacattttgttattgccagaacaagttggacaactagtttgtcctanatttgaattcctgtctaatgcattgccataatatgtcatttccnttcatataaggcctctgtccatcaccanaagatgtaaactctctccttgatttcctattaaatatagcaatttccctcttattgttggngtcactaatttgacggtatatcctatacacctgcaaatgttgtttgcatagcattttattctcntatgaattgtcctcttctctttttcatgngacatatattcctccagtctggccatggtgaatttcacatcgaacc

SEQ ID NO: 713591 - DNA, 133 bp, Homo sapiens
  misc_feature (1)..(1): n is a, c, g, or t
  misc_feature (110)..(110): n is a, c, g, or t
  misc_feature (123)..(123): n is a, c, g, or t
ntgatcacacactttgaaaggtccaaaatggagtaaggaatgggaagatttcgcagttaaagatggctaccatcagggaaagagatcaagcatctgtgtcacgcttctgngcttaatttcagncgtgccagtg

SEQ ID NO: 713592 - DNA, 372 bp, Homo sapiens
agaaatgtgtggaatttatatgaagatacagggttatgtacctgaagcactctaccgtgtcagcggcgaaataaaactgaccaaggacaatattcaaaagcagtttgatcaagatcataatatcaattctagtgtcaatggaagtaacagtaaatgctgtaggtgggggcccttaaagcttactttgcagatcgtgccagactcctttacttccatatgctcttcatccagaactataggaagcaagcgaaaatcccggagtaaaacagaacgtctccatgccttgaaaggaaatggtcgagaaatgacaatccgtgtaaactatgatgtattcagaatacgtgaataacacatctaaacagggttagtcag

SEQ ID NO: 713593 - DNA, 150 bp, Homo sapiens
ctgatatttctggaagagattgacatttgaatcagtaaactgagatgaagcagattgccctcccgagtgtagggtgggcctcatccaacccatggcacggcttgaatacagctgatgggtataagaacaggtttctagctccactgtctt

SEQ ID NO: 713594 - DNA, 166 bp, Homo sapiens
  misc_feature (139)..(139): n is a, c, g, or t
  misc_feature (147)..(147): n is a, c, g, or t
ccgagctcgaattcgtcgaggtggcggccctgtccgctcccaaggcttaggtatccagcgcagggcatctggtggggaggcctgctggtaaaggtcgacgcgctgggtgcggaagacaacacaagaaagcctccggcgngggcttgngacgggaaccgaggccaga

SEQ ID NO: 713595 - DNA, 456 bp, Homo sapiens
  misc_feature (75)..(75): n is a, c, g, or t
  misc_feature (84)..(84): n is a, c, g, or t
  misc_feature (335)..(335): n is a, c, g, or t
  misc_feature (383)..(383): n is a, c, g, or t
  misc_feature (385)..(385): n is a, c, g, or t
  misc_feature (409)..(409): n is a, c, g, or t
  misc_feature (429)..(429): n is a, c, g, or t
  misc_feature (449)..(449): n is a, c, g, or t
attcggcacaggggtgtgccccgccatccagggcacttactgtaacagctctcgcaggcccggccagccccaggntctggccgncggcccccgtgccgttcaccacaccggccttgacgttgttgacgctgatttggttcggatttggcttgttacttaaagagggaaaggagagacgagaggagttgcaggagcacaaacctcgagggcccatgtgccagcaggcaccgcggctgaccaccccttgtccagaaccacgtcctcgcacccctcggcctcggcagggatcttcctttctcccctttcagttcctggggagccattgttgaggtctnagcccttcttcagggcccccgtgcttccccttagcattggagcccagntnaggggactgaacctgggcggtgtngggttggaattcccaatggnccctttattgaaccaagganggcaagg

SEQ ID NO: 713596 - DNA, 164 bp, Homo sapiens
acctatctgtactgactatctatactggacttatctatactgacctatctatactgacctatctataccacctatctatactacctatctatactacttatctatactgacccataattgtcggcgcggaggtatagataggtagtatagatgcgtcagtatag

SEQ ID NO: 713597 - DNA, 212 bp, Homo sapiens
gctcccccctccccccgagcgccgctgcggctggcaccgcgctgcgtctgccggagtgttgcaagtctgcgtggctgaaggtgaggcgcccctgcgtgcggtgctgccccgtgcaagtgcgcccatgcatggatgtgatgctgacccccggagcaccccccatgcagcccaccgatgggagatggtgtgtcgccgcacatgtgaacaaaaat

SEQ ID NO: 713598 - DNA, 249 bp, Homo sapiens
  misc_feature (5)..(5): n is a, c, g, or t
tccgnatctcagtgatcgagtgtgtatcgacacagcgggggctggtagactgaagatgaattccggaaagatgcggccgctgacttggttgagctagctgagcagttccaagtagagtgacagggaccttgccccttcttgttgcctctctcgccaatgagccagtcaaggcctgcttatgcaggccttgactggggaccagaaagcctttgtaaaactaacactttggccacaagattagaaatgacg

SEQ ID NO: 713599 - DNA, 433 bp, Homo sapiens
  misc_feature (6)..(7): n is a, c, g, or t
aggggnnaaaattttttcccccccctgttttgttcttttgccaagaaatttttttttccccttgtgcttaaaaagaaaccccctttccacattccctctggggtgggccaaggggggcctttactataaacaaaaactgggttcccccttttgtaagggggttaacccagttaaagcttgccaagtcggcccccagaaaaattttggttccttttgccccctgggaagttttttttccctccccccccccccccttttggctttttttaaaccacctgtgggcccaagtgtttattaaatttttttcccaaaaaaatttaaaaaattggtttttcctcccaataaccacccaaattttttttttacgtaaaaaaacccgttttttttttgcttttgcccccccctttttagttaatttttaagggcttgggga

SEQ ID NO: 713600 - DNA, 235 bp, Homo sapiens
atacctaattacgactagtcggtttgttactcactgagctgcgatgggaactcccccaggtagaatttctgagagggtagcccataccgtaaaagatgcttaggttatggagccagatggtcaagcctgggttagaatcccagcctttgttttcctgaaggcagcaggaccttctgtgggcgggtgactcagcctctgcaggtctctttcttttcatctgcaaggtcaagacacc

SEQ ID NO: 713601 - DNA, 747 bp, Homo sapiens
gaagggcgccctcaccgcgagttgcgcactgccgtcctttggaacgaaaaacgtgtggtcgggcggacccaccaagtgactgttccacccagtgcctagaataaagcgtgatttcttgcccccaacgtctcacaccaaggcttgggagcacccctggggcgcggtcccacaagcccacgggcacgaacatttttggcggctgtgtcccccgtccgaagagccccccactttgacaccccgaggggtctgcgctcccacgggcctccccacgaaggtgggctggcacccaacacaccctctatttccacatatagtgggcactttgccctgggacgtcgcgcctaacttcgaagcttcgggttcacatgaacgccttctcgatatttcttcgtgcacgagaacctggagccaacgtttacacaaccggctcgcctcgaaatccgcttatggccccgccccttcccccaatgttcccgtccccggccccagtcaacgtggcgcctgggcacacttccctgctgcctgtaaatactttgtttaatcccccgttcgcctggagccctccgccttcacactttcccctggggaacccacacgtggctgcgtgcccctgctgctgtcacccttttcccccgggaacctggggcttttgtccacagagttcctgtccccatttgtcggcctccccccccccccaagattatttttcaccccaacctccaaataaatcccctgcgtttttggtaa

SEQ ID NO: 713602 - DNA, 294 bp, Homo sapiens
atactatgctcgtattatgaaactattagctattattcaaccagtagccctagacgacgactgacagacaacattacagcagggcacctataaattcatctaattggaggggccacattagcactactcaacatcaacactataacagcttttatcacatttactatcctcattctattaactattcttgaattagcagtagctctgatccaagctcatgtgttcacactgctagtaagcttatacctacacgacaatacataatgacccaccaaacacacgtcggctaattct

SEQ ID NO: 713603 - DNA, 716 bp, Homo sapiens
gctcacgcctgtaatcccagcactttgggaggccaaggtgggcggatcacctgatgtcaggagttcgagaccagcctgaccaacatggagaaacctcgtctctactaaaaacacaaaaaattagccaggcgtggtggcgcatgcctgtaatcccagctactcgggaggctgaggcaggagaatcgcttgagcctaggaggcagaggttgcagtgagctgagattgcaccactgcaccccagcctgggcaataagagtgaaactccatctcaaaaaaaaaaaaaaaaaagggggcttgaaacttttgaagcaaaaggtgaaagtccccattttttccctttttcccagagggtgatcttttgggggccaatcgggtttcattttcctcccagacacctttctctagggcatttctatgtgcctctatttcacatttttacacaaaattagggacgtttcccttgtgctcccctttaaatggcgcattattgtattcttccacgtctttttttttccccctagggggactctttaataccttaaaagctcacccgggggctgggagcggagggcctcatacggtgtaatcccaggccttgggagccccaggggggaaggattcccttgagctcaggagttccagacaattcccaaggcaaaacacaaagggcatctcgaacactcgtgtgggccaactttagaaaagccccatttttt

SEQ ID NO: 713604 - DNA, 862 bp, Homo sapiens
ggcgtgcgtgagaagccgatgagcagcatagtctctcggcgacaccctgtacgactgctggtgcgggaatgtcctgcacgaggaaccagcgcaagcgccgcatagttcctggatgacggtggacgttgcatatcagtcttgaagaactatgatccccagaaggacaagcgcttctcgggcaccgtcaggcttaatgtctcactccccgcgctaatgttctctgtgtcgtgtccttgtgggggactcatgctagcgactgtgactgatggctaagggccgtggatatcccccgacatgtgacatctgatggctgctgaagaaaactcaacaatgaataacacaaactggtctaatgaatgctggccaatgaagtatgatgcgtttaatggcctcagagtctctgatcaagcagattccacggaatcctcggcccaggtttacaataaggccaggaacagttcccttccctgctcacacacaacgaaaacactggtggccaacagtggatgaggtgaagtccacaactcaagttccaaatgaagaaggtgttatgtctggcctgctcgctgcttggtcacgtgcacgatgacagacgagtgaagctagtgtagtacacattcacctggcatgtcaacgctcctctggatgtccattgctcaacgaaaaactggcagaatgatcccgcggaccttagtattatcaagaagcacccatggtgcaacagggcccccagacggcgtactcttcaaggcgacacttgcactaacagttactagtcaccacggataacaaagcacacgcacccgaaccactgcgaggcacccaaaagaaggcgtgtcgcaaaccggagttagctcacacg

SEQ ID NO: 713605 - DNA, 186 bp, Homo sapiens
ggctgtgggcgcgcctgcagcgcgataaacccaatggctgacctctttgtggcggccggccccattcacgtcgcctgctagggccattggcatttgcccttctcatgcgatgtcctacggaaattcactcagcgcatgctatctcacccatctcacaggtttcctacaagtgccccgcgcccacaa

SEQ ID NO: 713606 - DNA, 593 bp, Homo sapiens
gtgggcggatcatttggggtcaggggtttgagatcagcctggccaacatggtgaagccctgtgtctactgagggtacaagaaagattagctgggtgtggtggtgtgcgcctgtaatcccagctactaaggcaggagaatggcttgaacccgggaggtggaggtcgcagtgagctgagatcgcgccggtgcgctccagcctgggcgacagagtgagactctgtctaaaaaaaaaaaaaaaggaaaggaaacaaggaaaactttggagagaacataacttttctacttttgaaataggataatttttcaaaattggtttaaactccgtggaacattaacgtggtcatttgttaataactgggagtttgagagataccttttcagaggaaaacaagagggctaaattccatggttaacgagctaagtagtattttttgcttaacaattttggcgaaaatttgcttcatagtggagccaaagggagaatacatgtctacaataaattctagtttctaaatatttattcacagatggggaacaggtcttgaaaaagggtaatatccggggattaaatagccctgtaattagatggaat

SEQ ID NO: 713607 - DNA, 202 bp, Homo sapiens
ctgcatgctgcaagtcgatctagattatcccccctctacagaccatgcttctaacctccctgttgcttatgaattcgatacagttatacccccgattccgtctactatcaagctacatacacctcctataaaaaacttcctaccactcaccctatcattacttatatgatatgtctccatacccattacaatctccaacatt

SEQ ID NO: 713608 - DNA, 320 bp, Homo sapiens
tcttgtttcctgcacttcgggaggccaacgagcggatcacccgaggtcgggtgatcccgcggtattgctctatatagggagatccctatatagggtctcactctattgtccaggctggtctggcctggccaatgtggtgaagcctcatttctactaaaaatacaaaaattagctgggcatagtgatgcgcacctataatcccagctactcaggaggctgaagtaggagaattgcttaaactcaggagacagaggttgcagtgagccgagattgcgccactgtactctagcctggaagtgcaggaaacaagacgggtaccg

SEQ ID NO: 713609 - DNA, 280 bp, Homo sapiens
  misc_feature (16)..(16): n is a, c, g, or t
  misc_feature (134)..(134): n is a, c, g, or t
  misc_feature (142)..(142): n is a, c, g, or t
  misc_feature (216)..(216): n is a, c, g, or t
  misc_feature (224)..(224): n is a, c, g, or t
  misc_feature (260)..(260): n is a, c, g, or t
cgcgcacacgccacangtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgngcgcgcgngtgtgtgtgtgtatgtgcgcatgtgtgtatatgtgtgtgcacacacgtgtgtgcgcgcacatgtgtgtgtgtgngtgtgtgngcgcgcgcgcgcatatacgcgcgcgcacacacacangtgtgtgtgcgcgcgcgcgc

SEQ ID NO: 713610 - DNA, 683 bp, Homo sapiens
cgagaagggagcgaaggttttttgcttgcgccaacgcatgtgacctgaagtgctccggtctactctctggcctgtatccttggctgatagattggtgccacgtggatggcttgtggtatcattgggcccctgtgctccatgctcatttgctcgtgctcgtgctgcaggtctgggcaacttcattcgaggatcgagcccctcttcaggcgtgcacaggctggggccatgcgcattcggccatggacaccattatcgaggtgctgtgtgctgggttgggggcccgtggcgcgagatcacccgagtggggcattgcccctgccacttgaaggtacgtgcaaagtttgcggtgtgcacgtaggacagtgttgggcctatatcgctttgacgtcgccctaggttgaatgagggacctatttctcgtaacccagggcgcaagtcgtgggcactaccttggatgcgaggtggctgcgatggctcaaacaacaaatatggtcgcgtctattcttgggtcgggtactccaacggggacagaagcttgttgcattccgcagttcttggggtgttagggagacttgtggagtctaaagagggcttccggaggtgcaccctgaaggtttagaaactcccaggaaccaaggaaaaccttgccagtttccacgagcaggatttgactgaccgaggca

SEQ ID NO: 713611 - DNA, 851 bp, Homo sapiens
agtgggactgggggactcggcactgatttacaccttcacacaggaggggaaccaacaaatcgacttgagatcttatgacatgccatagtgccactcgaggcagtcagctgtcttgcatacagctcaggaaggtgcccgaaaactgctggtcgtggggtcttatgactgcacaattagtgtacgcgatgcccggcaatggcacgtgctcctcataactctggagggccatagcaaaaccattctttgcatgaaggtggtgaatgatctcagtgtacagatggctccagtgatcagtcagatccatgcctcacaacattcacactggtgagactcgtgcggatctatacaaggtcacaatcatgcagtgactgtggtgaactatcctaggaccacgtgatggtgactgcttgccctggataccatttgtcacgtgtctatgaattacagtctcatgatcgattacaaggatcatggcaggacacaaaggacatgacttatgtgtatgaaccactccataaaaggcatgattcgacactggactgatcatgatggccagctattcagggcaccgtagaacgcttaacatcgtgatgcagcaaattacacgcatgttggatggccatggatgcagcatctgcataatgctggcagatagatagagtcattttagaaaagaaagcacgtttgcagaacacgaaccagcacataattcccgaacatataccaggacctccctgaaaactgttgcgctgggacagaaacctgacgcattagctcgtcggcagcactgcggtacggaaagcggatcaccagctaggaatggctggacaggacgttctagggacccgaac

SEQ ID NO: 713612 - DNA, 298 bp, Homo sapiens
ttctacttccacgcaaggatcaagggaacaatgggaaaggggattgcggtgtgtgtgtgtgtgtgtgtgtgtgtgtgtgtgtctgtgtgtgtgtcgtgagtagagtgtctgtctctcctccagaaaacacagacttatactggagctcctaccatgctagcgagaggtctatgctgtaaggcacagtatatggatgctacagaggggatgcaggcttcccccgagacagagcagaagccaacacattcatttgaagaaatctctcttgtgcttcagctttgccgtctaggagcgtact

SEQ ID NO: 713613 - DNA, 430 bp, Homo sapiens
gtagtgcactgtgtgggatatagggtgccattttaaaatgcattcgtgattcctcgttcgtcatagttgtgtgtctgattttgttatcgcctagtctatagggaacctggtgtttgttggcaggcagtttgactgttttgcttttaaggcagtgtcatatttcaatgcagacatttcccatgccaccctgataacatgcggaatggatttttgaaataataggaaaaggtagggttgttcaaagtattgtttattaagatttccatgtttttccatgaggcaattctgagttgacagtgacacacaaaccgcataattctgagatgaacttaatgtcccctcctgtactccctgttcactcatgattgcatggcgccaacaccatcataaagtttgcccatgacactacagtgatcaccgacgtcgacgc

SEQ ID NO: 713614 - DNA, 313 bp, Homo sapiens
ttagttgctgcacatggataacaacaaaaatttgattattctcgtgttagtattgttaacttctttaaatgatgtaacgcagtcgcaaaaagaagttaacaatactaacacgagaataatgttaacttctttttgcgactgcgttacatcatttaaagagaatgctgtgtattgtaaacttaaattgtatatgataacttactgtcctttccatccgggcctaaactttggcagttcctttgtctacaaccttgttaattactgtaaacagttgtacgccagcaggaaaaatactgcccaacagacaaaatcg

SEQ ID NO: 713615 - DNA, 801 bp, Homo sapiens
  misc_feature (554)..(554): n is a, c, g, or t
tcttgctgccggtgacgcgccgaagaagccatcgttaaagtctctcttcaccctgccgtcatgtctaagtcagagtctcctaaagagccgaacaggtgaggaagctctcatggagggtcgagcttgaaacaattgatgagagcctgaggagccatttgtgagcaatggggaacgctcacggattgtgtggtattgagagatccaaacaccaaggcgctccaggggctaggggttgtgtcacatatgccattgtggaggagggtggatgcagctatgaattgcaaggcacacaaggtggactggaagatttgtggaccaaagagagtggtctccagagaaagatctcaaagaccaggtgcccacttaattggtgaaaaacgatattgtgtgtggtggcattaaagaagaacactggaagaacatcactaggagattatttggaaccagttatggaaacaattgaggtgattgaacatcatgattgaccgagcagtggcaaggaaaagggggctttgcttttgtaaccttttggccgaccccattgactccggtgngtaacggatgtgtccatttcagaaaattacccatactggtggaatgggccccaactggtacacgttaagaaaaagccctgtcacaaggccaggagactcgcttagggtgtcatccaggccaaaagaaggtccgacagtggttcttggcaccctctggtgggcgtgtccgtcgacggttggttccggctggacatgcacacactcggcgcgggaggaaactccagtgccgggtggctttgttgcccct

SEQ ID NO: 713616 - DNA, 402 bp, Homo sapiens
ggggggttaacaaaataaaaaaaaaaaaaaaaaaaaaaaaaaaaaatttgggggcgcgcgccttgggccctggaaaaagtttttaagacaccaatccggtggggcggcggggcgcccagttgggtaaaggggacacagtgggcgcaaagagcggggtccctagggggaaacccggggcgcaaggaaaagaggggggggatttttacaccaaatataaaaaagcgccgcggggggaaacccgggggggtttgggagcaaaaacccaaagaggggggagtcccagggagggcgcaatacacgggggctcataatcaaaagggggggcccaaagaggagagcctcggaatatctaaaaatttacgcgccccgggcccctgggggtggacacccacagcacacgat

SEQ ID NO: 713617 - DNA, 262 bp, Homo sapiens
ctggagactgctgacctcggggggcaggaggtctagaggaaggagatgcatggcaggatgtgatggggatgatgagccgggcagcagactatggctcctgagcactctgtggggacctagccctgtgagcctcagaaacgccccacaatggcacctcttattccagtgctggagatggtcaaacaggcccagagagaagtcacttgcccagggtcacgcagttcgggtaaggcagagcccctggctggagctcctcctcatg

SEQ ID NO: 713618 - DNA, 335 bp, Homo sapiens
  misc_feature (299)..(299): n is a, c, g, or t
gggaaggatcagagggttgggactttcagtcccacccccgcctaacctccagggaagggagaggggctgaaggtcaagttgatcaccaatggccacggtttaatcaatcaggcctacgtaatgacgcttccatacaagccaaaaagatggggttcagggagcctccaagcagctgaacacatggaggtttctggagggtgatgtgcccggggagggcatggaatctccgtgccccattccacatgcctggccctgtgcatctctttatctgcatcctttgtaatatccgttatcataanccgataatataagtaaagtgtttatccgaaaaaaaa

SEQ ID NO: 713619 - DNA, 927 bp, Homo sapiens
gagagagagcactagtctcgagttttgttatgattttttttgtgtcagaaatggggcttggtcatggtgacccagcttgggtctggaatctcgtgggctcgcgcaatttctcccaccttttgccttcccaaattgcgggtgggattccagggcttgagtcatccattgcccatgcctaggattagagttcagtaacaattgggtcatgctgggggagactggagaaaacgccgggcttagggagcacgcaggctgtatggagacggtggctcgtggtgcgggcgtggaatggatatagccattggacggcaaataaggagagcctctgtgcatggaaagagctcttggaacataaggcggaggagaagaacgcggatagacggcctgggtgatgcccttgtgtggacatgcggcacccatataggcgccaaaggagtgggctctcacgagaggtggaaccgagggggcaagaaaataagaccgaagcgcgggaactcccgaagggggttatgcaaatgagagtggcagaagcacactgtgtactccagccctatgaaatgcctcgagaagagacctaaaacagagaaacaacacaacggacacacaatgataagagccccccaagaggaaagacaaaccctcctacaacgagcgagcgaaacttacctcacgagagtgaccaccgtctgtccatgtttatccagcgaaaatggtcgacggaaaagggtttgagaagcagagttgaattacatcctacggtttaccccaatagagtgttttgtacgacagtagggacgatcccgactttacggtccacttaggtgtcacgacacgaaagcgcggtctatagcccccaaacaacccaaagctaatgtcactaaagacgactatcattctgacacaatacgtgctacccgaaaagcagcg

SEQ ID NO: 713620 - DNA, 571 bp, Homo sapiens
  misc_feature (113)..(113): n is a, c, g, or t
cctttctgggttttccgctgaggtttgttgaaaagacgcctcccagactcttcactcacgaagtgtgttacaaaaactctcccggcaactgtcctgaccctcaccaatcacgntacagcccccattcgattgcttgcacaaagaaaacatttaacacaggtgtgatcaacctcggtcaagatgcagagtcatcaacctcggtcaagatgcaaaaaggtggccttttctgcgaaggccacgccctctgtaaatacagttactacttggtgaaaagcgctctacttcctagctcttgttggtgagagggagagcaaagaaccagggcccggcattcttacgagaggaattcaatgtcacaggcactgcctgtttgaggagaagatcagaaacggtccgactcccagaacgcagcacccagttgctttgcacgccaggccagtcctggggaaacggtgcaacgcttgtctgggcgtcgaggaggctcccttgcggtcctccctgggcccttgccagtcccaaggagttccaaccctgctttctaaccctttaaaatctggagagggcggccgca

SEQ ID NO: 713621 - DNA, 696 bp, Homo sapiens
agagttttagagagagagagagagttagagagagagagagagagatagagagagatatagatagatatagagatagatacctatattgatatcgttctactattttcatatctctttatacatttatacgtctacacttatatttctatgctcatctccttctctctatggctctttctccttttctctccttcttctacccattctctctcattctctcactctcttcccttgttcattttcctacttttccttatctcaccctttcttgcctctttccctcctctttcatctttctcccccttctctcctctccctctctcttctccttctcctccttcccctttcttcctttttcctctctttccctcattctctctctttccctctcctctatctctctcttctacccgtcgccttccttcttttctcttcttcttcctctccccttttttctctccctctctcctcttcctctgtccccccttgttcttatctcctatctctctcttctttcttttccttcctcttttctttctctctcctctctctcttcctctttcttcttctctcttcctcttcccctctccttcttcctctgtttttctcccctcccctctcttctccctccctcttctccccttcctctccttccctctttctcccccctctccttccttttctcccctcctccct

SEQ ID NO: 713622 - DNA, 94 bp, Homo sapiens
ctcaaggtgacccaaggccccggctccgccccgaccagctgaagattctctgctcatacagcttcgcggaggtgctgggtgtggaatgccgggg

SEQ ID NO: 713623 - DNA, 657 bp, Homo sapiens
ctgacttgcttgtatattgtttatcagaaaacttaaattagaaaaaattttttttaattctgagtggtatttagtttacatttggtactctgagacaaaacacagtgatggggcgaatatttatgttctgtttgataatgtgtaaccacaaacagtgttagggcaacttaaactagcagagaaagttgtatgtacatttaataaagtccttagccatcatctaccagtaaataagtttgtagaataatgaaatatttgccatttttgattttttttttttttttggaaacggggtctcgctctgtcactcaggctggagtgcaggggtataatcatgcctcactgaagcctcggtttccggggctcgggtgattcttccaccccagcctcccaagtagccaggaccacgggtgtgtgccacgacaccgggctaattttggtatttgggtagacataggatttggctgtgttccccgttggtgatctcgaactcctagacgggggccttctgccaccttggctcccaaagtgctgggactacaggcatgagtcacggtgccaagcctgtttggattctaagagtccttgcaattgccttggattcctggtggcagttaagcaggaggtagagaccacctgttgcaagatgtgcagtcc

SEQ ID NO: 713624 - DNA, 1034 bp, Homo sapiens
agctgcgacagatgggctactgtagtcgtgttggtcatatttccggacagctactctcctaactaagtgcgtggcgtcgcccgatggaatgatccatagtgagtacactgacacagtagacgacctcgacatggaggtcccctagtaaaacgtcctcctgcttgctgaggtcttgtgcaacctttgaaagagctccgtactaagagtaattagtcactttacaccgggtcgcgactctgtagagtggagaaaatggagacaccagtatatacttttaatgcaacggtgacagattaatggagctgtgttgcggaaaggatgaggttgcagatcgtgtgaactcagcggcaaatgtagtgatccacggcagtccgcctctgcatttcacgatgtggcaatagttgagattggtgtgcttgtgacgtctctaacctgtatgtgcctatgtgagagggagttctgccctatacacagcaacacaggtgtgtcattccaggttgtcggtgtggtacctgggtgaccggagcaatattgcgtggagagtggcttaattagctgtggctgaggatctatgagcccgaaagcggttagagcagggggcatcgatgcgggactgtcatgcctagtcttggagccgtgatttgcccggtgtctggtgggctgggtgtccagtagtactatgatacacttgctgcatgatgcagattgtgttgctgatgaatggtgtgtatgcagcatcaggaatgtgggttgggatcacaagaccggtaggcagtataagaagaactactatgtatcaagtacaagaaacagcaacaggagtggaaagaccaaacaatggtgggacagagctatagcagaagttacagcacattaggaagagaacacatcacaccaggtattaggagaagaagcgaagatggaacgagggggttccgcagagacgatagccaaagagtgacgcagcatgcacgaagagttgtgaaaaaaaagagagaacgagacactcagcacaaacacagagaagactgcaa

SEQ ID NO: 713625 - DNA, 229 bp, Homo sapiens
tccgttacattccgtcacagtggagagacagatgatccagtgaaaccaatggtacactggtggcccctggggcagagtgggctgctcaacctgcggccagaccgacttcgtcttctacgtcggggggtaccccatgtaccttcacgcccccgtcccctggtttcggtttcccccgggctacccgggggcttgggtcggaggttccaacgcagggttaccgaggctcgaa

SEQ ID NO: 713626 - DNA, 886 bp, Homo sapiens
ttctgttgaacaaaatatcacaacaggcagttgtgatacgaatagaacaaaaaaaaagggaaaaacactaaaacttggtgaggactccgatgagttggggacttcaggaaaaatcaacccagcaccagcagctaccaaccaccatcccatctcttcacttgaaccagcattaagtaaagtccagatgtgggaacccttctctgggaagaaagtgcctaatggtgtctcagaaccggtgtaaacaaaccagccagccgccaccttgctaaacctataagctttttaaaatcccaatatatacctgccaagaaatatgcctgtgatagtaagccctcagcccataggtgttattggtttttaaacagaattatatatgtctggggggtgaaaaaaccctttgcattccaaagggtccatactgggttactgggttccattggccaccacttagtgggatgtccagtttagaaccatttggtactggctccctctgggaagccttgcgcagagcttacttggtacatcggtgggagaatacctggctgaatttataacgctggtttcgacgttcgattcgccaccattggcaccacaactcaatatgacaacctattttaactatattcataatctggtgaacacgtattcccacggacacattcggtcatacggtacttaatcacgtagtgatgacacccgcaatacactaatagtactccttgaactagaggtcacaatttatgatggcccattattaaatcgggaacaattgtgacagcggtatgtccgtattacacacgtaaaatatatgcctttgtgaaaccttccctggggatatttcaaacgtgtaaacgtggctcacccaacatcttaaatataagaagct

SEQ ID NO: 713627 - DNA, 858 bp, Homo sapiens
taaggggacagggggggggggttttccggggggtcccaaaaaaaaaatatttctagggggcaaaaggggttgggcctcaatataaaaatctttgggaagaaagtcccagcggcctattaaaaaaaaagaagaatatgggctccgccgcagaacagcacagcacgggcgcggaacaaaaacagcggaaccggcgcgagcggagagcacaagtgccctatgcggggggggggtcgccagaagatagaggcgacgaagtacctcgcgacgcgggggctcttgtgagcagaacacaaaaacgtggcgtagacagagagggagagagacgaatgcggcgggggaggaaagaagggatcatcacctctctcgagcgggggcagccccgagcgaggagaggagagagagagacgaggagagacagaaagatctggacgaagaagacgagtggccccaccttgtataagtcaatcgggctcgtacacgaacaaatctatccaagggcaagtctccccatcgacagacatccctgcagccgagagggggcacggaaaacatgattaccgccccccacaaggaaggagaccgacctcccggccctacctcggtaccaagaattaggcttatgcgaaaaacacccacgatcagcgcggtaccacaacaagttgagctggggccccctctgtatcagaaggagcaagcacaaaagcggactaagtgggtagtcacaatcacacaaacaacgtggtgtgatgttggaatcacccaccttcgtgggtggcaccacaaacgccgcgggggtgctctccaaacaaaatcagtctcaagtccacaacaggggcgcggcggcaaccaacaaacctc

SEQ ID NO: 713628 - DNA, 130 bp, Homo sapiens
ttcgagtaacaaagtataacagaagcctgagatcaaaatgaagcgaaaatctgttcgcttcattcattgcccccacaatcctaggcctacccgccgcagaactagatcattctatttccccgcgctattg

SEQ ID NO: 713629 - DNA, 713 bp, Homo sapiens
gccgccctcggctccccgccaccggctcggctcggcctggagccccttcctgctcgccggggcccagtccctggagctgcccctggccctggctggcttgtggctagctgtgtcccggtgtccattgtccggcggtcctgtcttgtcctgggaggtgctggtggcccagtggacccagagctgcagctgcagctgcctgatgtgctgcctgtgatacatgatcacttggattcatgtctgagttttgcttttgctcctgtggtgaacttgcaccagagctgtgagtgttagcatcttgcaatgtgagtgtcagtaacatatccatgtctgtgaaactgtgtgaaatgaccagagctacttgcatcatgggaaacattgtccctgtctggaaacatgacaaagtccaaataacatgttcacttgggatcaagtattttgcttggtgctagaatgatgcaatgccctgccatggcgattgattgaaaacttgattttcctggagaccttgtgcatgtcagctgacaagctataccaacaactaatgagatcatggactccagtagcaggtgacaagtgagggtgatgactgaggatgactgacacaagatgaatgtctcttcccacacatcagaggacacgatggctggggtggtcaaatgtggagacagagttagaacatcatgaacagccttgttggtgggaacgaagtggta

SEQ ID NO: 713630 - DNA, 765 bp, Homo sapiens
  misc_feature (21)..(21): n is a, c, g, or t
  misc_feature (112)..(113): n is a, c, g, or t
  misc_feature (118)..(118): n is a, c, g, or t
  misc_feature (128)..(128): n is a, c, g, or t
  misc_feature (130)..(130): n is a, c, g, or t
  misc_feature (136)..(136): n is a, c, g, or t
  misc_feature (140)..(141): n is a, c, g, or t
  misc_feature (173)..(173): n is a, c, g, or t
  misc_feature (182)..(182): n is a, c, g, or t
  misc_feature (191)..(191): n is a, c, g, or t
  misc_feature (202)..(202): n is a, c, g, or t
  misc_feature (238)..(238): n is a, c, g, or t
  misc_feature (316)..(316): n is a, c, g, or t
  misc_feature (352)..(352): n is a, c, g, or t
  misc_feature (359)..(359): n is a, c, g, or t
  misc_feature (430)..(430): n is a, c, g, or t
  misc_feature (505)..(505): n is a, c, g, or t
  misc_feature (523)..(523): n is a, c, g, or t
  misc_feature (528)..(528): n is a, c, g, or t
  misc_feature (551)..(551): n is a, c, g, or t
  misc_feature (592)..(592): n is a, c, g, or t
  misc_feature (620)..(620): n is a, c, g, or t
  misc_feature (652)..(652): n is a, c, g, or t
  misc_feature (700)..(701): n is a, c, g, or t
  misc_feature (730)..(730): n is a, c, g, or t
tgctaagctgtgatgtttggnagattaggtgtattaaacacatttcaacttgcaatactttcaacctatgatgtactcaccggaatgtaacccattgtaaactgaggaacanntgttnctcaccccanangaaggnatgnnggaggaaggtcaagcgcctcttccaggtcagntggggcagnggttggatncaaaccaggcngcctgggtccatggtaaaagatcctccactaagtgnggctggggctgaatcccacgtttcctgcctcaaggagattgcagcaggcccccctcttttcccctctctccagagcgngttaccccctggctcccagacagccacacctggtgnaggagantgcggtgacaatggagagaacccccaggttcagtaagctgcctcgtctggtctcactaacacctagctgtngggagatctccctccggtcagtcacctcagcctttggcgcacagaagggtccagggtcccctgctcagaggctancacttggccgaagagaanggcantttccaagtttggggttgatctntggctaggaaggggctcacttctggccccaccaaagggtgngggtgggggaccaaagtgatagagcccntgatccacccactctctgaaacttctttgctnaataaaacatttcctactacgcttgtgttttgtttggggtagagggtnnatcgacaaacacgacccccgcctcaaaanggaaagcttcgtttggcagacgcacggccaggatt

SEQ ID NO: 713631 - DNA, 738 bp, Homo sapiens
taagatactgaaagtcctggggcagtatcttctgatggtgtgcatgtgaggagaagactgaggttaggactgagaagtgcagaagttggaacagcggtaaggctgtattaaaactccgatgtttcgtattacctactatgctcctgcggcatcaagacgctagagagtagaatgtgactccaagaggagagattcagattaagtctctgaaatgcatcaaaagctagactattttctcaccatctcatcacagtctgagtctggtccattgctaccccaattctctggggacaataaacaccaggctggaaagcggatccaaggaacgtttgaaactagtagacatactcgaatccactatgtcccaagggctaaggaatagtgagtttcattctgtgaagcgaactggtgaagcttaggtctaattagtgcctgggtgatgacctatgcaatcacaccgcttatgaccatcctagaggagggccctgatcaccagctcgatcttagggcatttccaaagctaacctgcgttatatgcctgggatagggttgtacattagacctttctatgcctatccttgccttaacctaactgcctgaggttgggctgcagattgtagagtcaacgactttgctaatctcttcctctgtgttgaactttcattcagaaattaagtcctactaatactgacagggcccccatgctgaatgtcatctgccggatccggaattgctata

SEQ ID NO: 713632 - DNA, 427 bp, Homo sapiens
taccggacctatttgtcggcgcggggagcccgcttcatctcagtgggctacgtggacgacacccagttcgtgaggttcgacagcgacgccgcgagtccgaggacggagccccgggcgccgggatagagcaggaggggccggagtattgggaccgggagacacagatctccaagaccaacacacagacttaccgagaggacctgcggaccctgctccgctactacaaccagagcgaggccgggtctcacaccctccagtggatgtatggctgcgacgtggggccggacgggcgccccctccgcgggtataaccagttcgcctacgacggcaaggattacatcgccctgaacgaggatctgcgctcctggaccgccgcggacacggcggctcagatcacccagcgcaagtgggaggcggccggacaaaa

SEQ ID NO: 713633 - DNA, 166 bp, Homo sapiens
tcattcatgggggggtggtataaaccggggcagctgtgcatatggcagggaagagggatccggtggaggaacagtgcagaaggctttatgttcagaatctctctggcttttcttctagactggagttccttgagcatgggggaaggctggtgtattattcatcccg

SEQ ID NO: 713634 - DNA, 256 bp, Homo sapiens
tccacgtgcgagtatatatttatttagaatgccactaacagcatgacgataaactgtacattcacaaacctgtacaagaagcacgtactctttaacaatgtgtagtatcacaagtaatataagtatagcattataattataaggtacttgagtcaaagacgaacatatagatcctacagcgttgcagcattcagtaacatcattgtctagatcaggcagaggaatgaaacttcaaaagcactatactataactact

SEQ ID NO: 713635 - DNA, 387 bp, Homo sapiens
  misc_feature (379)..(379): n is a, c, g, or t
ggtattgcagcaagcccgaggagccgtgtgaatctcctcctagctggacgtgatcgtaaggagctcaggaccactctttggcaacagaacctcttctcctcagcctatgcctaaaacagccagacggatattgctaacctctattttccccccagtttccgatatttaaatatttctttttggtcactcaaagcagctgtccttacaacacttcctctcgtagacgtgttagtgtttttccaagatgggagtttctttttcataacttacattcctggggccagcaccctctgtcccttgctgaatgttggggaaacaccggcctttatttagggaacacacaacttcattcctagttgattcttgactacaaggattncacagatg

SEQ ID NO: 713636 - DNA, 703 bp, Homo sapiens
ggaagaacagggtccaggcttggttctcagatggtcagggactacctgagaaccaagcctgaacctgaatgtgcgcagaacaggagaagaactgacgaggatgcggccgaaattgatgcaggatcccgccagcaagcagatccgaggagctttgaaatagagatgtgtgcaaatcttgctggagaaactcgagataagcactggagcggagcatcgagaggagtggcagcgtcatcgcgcgccatggcaacataggacgaccgtttaaccgcttcacagacggcctatttgcgccttgcgtaggcgagcgtgtagccttggcgcgaaaggactacctaattgtgcgcagcattcaggcagcaggcggtccgtggcgaggcaaggccagcacaggatgtgagacggatcgttgggaggaaccctcgaggaatatacaagcacggttgcaagaatcggcaagggaggatcccgagttcaagtaagtcagcaactgcgtcaacgcgtggggtacaagaaagttggttcaacagcagggtcaacccatggggtaacaagtgccacgggtgtcacactagagaagcccaactagcaaagggttgggggtcacaatgagattcccttacctagacgacaagaggtgtagaggtaggaaaggcgcagaattcccctgggggcactctgccaaactagggcccgctaaact

SEQ ID NO: 713637 - DNA, 147 bp, Homo sapiens
gaatgtggcaaagcctttaacagttctcaaatcttacctacacataaaaaaattcatactggagagcaaccctacatatgtgaagaatgtgtgaaattttttacccaatcctcaacccttactacacataagagaattcatactgag

SEQ ID NO: 713638 - DNA, 272 bp, Homo sapiens
tttgggttttccgaggccaggagcttgcctttcccctgagtccaaattggcaggtggactacgagtcatacacatggcggaaactggatcctggcagcaaggagaccccaaacggtggtttgaaagtactttttctgggagggggccttccagcatgtgggcaaagccttcaatcagggcaaaattttcaagtgaacattttttgccatcccctaactgcctgcccctgcccttcagggaaatgggggtcattaaaggaaactgaacattta

SEQ ID NO: 713639 - DNA, 80 bp, Homo sapiens
aagatgacccagttgttcatagaatattttgaaggtgaacacacaccccaacccaataaaactgatgttactagcctctc

SEQ ID NO: 713640 - DNA, 401 bp, Homo sapiens
tttatcatgggttgattccgactgaaaacttggtcacatcctccacatttgtaaggtttctctccagtatgaatctatgatgtgaaagtggtgatggtggataaaaagcctggtcacattcataacacttgtaaggatatcctccagtatcaatggccttatcaataagaagggctgaattttggaccaaaggatctggccacactcatttacgaatggtaacggttttacttccagtatagaagtctacagagggcaggataagggatagactccggactggaaggtctggccacacttctttacactggtaagggtttctcaccaggggtgacttctatcatgggcatgcaaggtatggctcgtgattaaagagctggccacatacttcagggtaccga

SEQ ID NO: 713641 - DNA, 197 bp, Homo sapiens
tccggtttgcgagactgcttggccagcagtttgcccaatctccagttggtcggagcacgaggtgctgaaaaagaacactttcttaaagtgaaatatcaaacagcacacaaataaatggttaataactaaatgagcatactgcattagtgacatccttcattgaatgtacttggatttgcgacgactgcttggccaag

SEQ ID NO: 713642 - DNA, 247 bp, Homo sapiens
  misc_feature (111)..(111): n is a, c, g, or t
  misc_feature (153)..(153): n is a, c, g, or t
  misc_feature (182)..(182): n is a, c, g, or t
  misc_feature (192)..(192): n is a, c, g, or t
  misc_feature (195)..(195): n is a, c, g, or t
  misc_feature (218)..(218): n is a, c, g, or t
gcatggaattcggcacgaggagctgtgtcaccactgtgggtccctggttgtttcctcaccctgtccgtgacgtggattggtgctgcacccctcatcctgtctcggattgtnggaggctgggagtgcgagaagcattcccaaccctggcaggtncttgtggcctctcgtggcagggcagtctncggcggtgtnctngtgcacccccagtgggtcctcanagctgcccactgcatcaggaacaaaagcg

SEQ ID NO: 713643 - DNA, 1729 bp, Homo sapiens
ctcgtctgtggtaatgagcgctggtgtctcttgtgtaggataggttgcttctgcgtggtgcctgctatgtcggactctagtccacgtgtgtgttcgcgacggacggtggtgttgcgcgatcagtcagttggtgtggcccgacgccgtgtgtgttgccccgccgttagtgttctcctctggctgtcaagttctctctcgcccgcttctctcgttagagaccttgctcgcctcgtgttgcggagcaaccactagctgtggtggcctggggggcccagtcctgctgcccccgttgtgatgggaagctctttggggaaaccccgcctctgtctaattgggggaagccgcggtttgtttgggaacccgcagtgcgtgtcctggaaatttttctaaggctcccacagatgctttgttgggggagacggaaggaggctgttttgactcctggggccgccccctctggggggggggataggcctctgggagcccgccacgtgcttggtgagtgtgggtggggaatcctccttgccgcggatatgataatggaggtgcggatggagtgggatgacgggaataagagtgtggatgtgtgtagtggggcccactcactccccctggtgatttgtggggactccatcggcgcgttttttatttgtgagggcgccgccctctgccctcggacccaccacgttggacgcctgcttgatgtcgagcgcctgtcccctcgtgggaggcgcgctctgttttctaaagccgcagaggtggcccgctgtgccctgggggagaatatgggggagagaacaccccccccctttgtgtaacacctccctgttttggagcgccgtttgtagggggtaggaacgggagatgtcagacggaattcttggaacggggaagaggccccgaaacatgtggcaccccgcggatatagcttgagagcacaccaccctctctgcaggccagtgcgtgtggtctcagcacgtggtgcgggtttcgccccacgcaggatatggagtggttctcactgctcccaccctcgtgtttgggagtggggggcgcccccttcgatatagtgggagtttcacacccgcccacccactcttgtatttgagcccactggtgtcccccgcgcttaatttggatgcccccgccgagatagggtctcccgcgcgctctcctcggagagtgcttcgccccaaggttgttgtgacaattggggcgccctcgggggcgcccttcgagaagagcgcctctcgggagcgccctcgtgagatcccctcatcatgggcccacctcgtagcctccacgcagatgtattgtagggcgagagccacatctctgtctcgcgcgagagacacgccacggcggctctccacggtatagagagaaggaaggaacctccacgctgagccctcggctggcctgaggcaccgcctgtccgcaaccacgagagcccacaaaataaccgcgagaaggctcacgcccccacggaccacgcccgctgggggccacgcccacgagaaatatatataggagtctcacaatctttatggtcccctccaccacctatgccctctttttctggaccctaacgttctggaatgacctgggctgtcaacacccacgaagccaccctctccccccacgttccccaggaacttgtcactttcactgtttcttattttagacctctttttgtaaataaaactgtttcccacaggaaaaagatgga

SEQ ID NO: 713644 - DNA, 415 bp, Homo sapiens
ttacaaaacagcttgagagcgcttcaggaacgcgggcaagtccaattttcagagtggccaaatgagcagtccccacccagccaaacctcaaaaagccaatcagatggtttcaaaacagcagccagttggatgtgaatgttgcccactgtcagtccccttttgttagttggccccctcgacccccttctgggccacatccagttaacgccacaattcctcaacgccccctcagtccttttggaaagccttttttggcacccctgccccaacaggcttgtgggatttgcacgtggaatcacaaggctggttgcatgcaacggcaaaaggcatgcttttttgccttggggaaggccttttgttccttccaacaggttccgggacagggctggcaacccccccagccccccaaattaaa

SEQ ID NO: 713645 - DNA, 441 bp, Homo sapiens
  misc_feature (63)..(63): n is a, c, g, or t
  misc_feature (328)..(328): n is a, c, g, or t
gcctccatcaggaactgtgcaggactgtgcactctgctgatactcacatggtggaattatatntgccttggccaaccctaaagccatcaagatagcagcaactcctctatcattactgtacccaccacctgtatggatctcgttgcccatatgaaactgagtaaggaacaatgtgcatcacactcacagagaaagatggacaaaattaatgaaggatcattattaagtttttaatgggtcaagagaaagttaccactgaggtcttctctacctgggcaacaattgactcctaacaaccactataagcttggaagatgatccctccccngctgatccttcaggtcagatttttcacagagccatagatatcttatcatcctctgtggcatgaagactaatggcaataaaacatttctcaataaaggaggctataccataaaa

SEQ ID NO: 713646 - DNA, 318 bp, Homo sapiens
tgaggtgctatagaggatccgaatcatcagccagcagtggataaagaaaatgtgatatatatgcactatggaatactaagccataagaaggaatgaaataatggcatttgcagcaacctaaatggagttggagaccattattctaagatgaagtaactcaatgaatggaaaaccaaatattgtatgttctcactcgtaagtgggagctaagctgcgaagatgcaaaggcataagaatgatatagtggactttgaggactcaagggttgaaggatgagactacacattgggtacagtgtgcactgctggctgatgaatt

SEQ ID NO: 713647 - DNA, 309 bp, Homo sapiens
  misc_feature (63)..(63): n is a, c, g, or t
gcctccatcaggaactgtgcaggactgtgcactctgctgatactcacatggtggaattatatntgccttggccaaccctaaagccatcaagatagcaggtttggaataattcactgtcgaagtcttcttgagctgagcagtcatgtgagcttggaagatgatccctctccagctgatccttcagctcaggccatcatctacatctggattcctgacccggagaaactatgagtaatgtgtgctgcttttgagccactaagctacatggtaataggctatgcttcaataaacaataatacacttgaaaaa

SEQ ID NO: 713648 - DNA, 401 bp, Homo sapiens
gataaaggaaacccctggattgtaggagggggccaggttccctccggcacaataagggcttcagttctatttaggaaggccaaatgttttttgtcattggcggcacacgtggtgtgtggggtgggtgtggggtgtgaaggtgtcttaaatcttttaccatttctttcaaatgcaagaggccgggctttctaatttgaaaactggtttgtggatcatatcataaatcatttaagcagtttgaaggcaaacttttgcatagaaataaaaaaaatactgatttggggcaatgaggaatatttgccaattaagttaattttcacgtttttgccaactttgatttttatttcatctgaacttgtttcaaaaatttatattaaaaatttggcatcccagagatatga

SEQ ID NO: 713649 - DNA, 195 bp, Homo sapiens
  misc_feature (9)..(9): n is a, c, g, or t
  misc_feature (27)..(27): n is a, c, g, or t
  misc_feature (49)..(49): n is a, c, g, or t
  misc_feature (52)..(52): n is a, c, g, or t
  misc_feature (64)..(64): n is a, c, g, or t
  misc_feature (81)..(81): n is a, c, g, or t
  misc_feature (84)..(84): n is a, c, g, or t
  misc_feature (93)..(96): n is a, c, g, or t
  misc_feature (102)..(102): n is a, c, g, or t
  misc_feature (113)..(113): n is a, c, g, or t
  misc_feature (115)..(115): n is a, c, g, or t
  misc_feature (117)..(118): n is a, c, g, or t
  misc_feature (123)..(124): n is a, c, g, or t
  misc_feature (126)..(126): n is a, c, g, or t
  misc_feature (134)..(134): n is a, c, g, or t
  misc_feature (141)..(141): n is a, c, g, or t
  misc_feature (144)..(144): n is a, c, g, or t
  misc_feature (168)..(168): n is a, c, g, or t
  misc_feature (177)..(177): n is a, c, g, or t
  misc_feature (180)..(180): n is a, c, g, or t
  misc_feature (182)..(182): n is a, c, g, or t
  misc_feature (191)..(191): n is a, c, g, or t
ggctcactntgaaaagcagccgcctcnccaatctgcggaaatccaactnctnccacttcgtccnggccctctaccacacanacngccaccccnnnnacatcnagaggacagcngntnnggggnncngggagaangaaaaanaanccaacagcgaaaagaccaataacncaatttacnacntnttttaactnctct

SEQ ID NO: 713650 - DNA, 505 bp, Homo sapiens
  misc_feature (63)..(63): n is a, c, g, or t
  misc_feature (392)..(392): n is a, c, g, or t
gcctccatcaggaactgtgcaggactgtgcactctgctgatactcacatggtggaattatatntgccttggccaaccctaaagccatcaagatagcaggtttggaataattcactgtcgaagtcttcttgagctgagcagtcatgtgagcttggaagatgatccctctccagctgatccttcagctcaggccatcatctacatctggattcctgacccggagaaactatgagtaatgtgtgctgcttttgagccactaagctacatgaattaatgaaggatcattattaagtttttaatgggtcaagagaaagttaccactgaggtcttctctacctgggcaacaattgactcctaacaaccactataagcttggaagatgatccctccccngctgatccttcaggtcagatttttcacagagccatagatatcttatcatcctctgtggcatgaagactaatggcaataaaacatttctcaataaaggaggctataccataaaa

SEQ ID NO: 713651 - DNA, 259 bp, Homo sapiens
tcaacaccgtctctagtacacaatagaaaaatgagctgggcgtggtggcgggcacctatatcccagctggctcaggaggctgaagcacaagaatcgcttgaacccaggaggcagaggttgcattgagccgagattgtgccactgcactccagcttgggtgatatagcgagactcagtctcaaaaacaaaacaaaacaatcttcatatgtacccatatcctttctcaatcctgattttttcttaatgttacctttttccc

SEQ ID NO: 713652 - DNA, 1080 bp, Homo sapiens
  misc_feature (38)..(38): n is a, c, g, or t
  misc_feature (683)..(683): n is a, c, g, or t
  misc_feature (801)..(802): n is a, c, g, or t
  misc_feature (812)..(812): n is a, c, g, or t
  misc_feature (824)..(824): n is a, c, g, or t
agcggattaggaaggcccccagctgtggccagcccagngccgggctgcccaccgtgccagcccagtttcaatgacccacctgagggtttccatcgtgggccagggaccggcgcaggcgggcatccggagccaggcagtggccagcccatcccgggcagggtcataggtggggctgcaggcctcgaagccgccatgtgaaggcagcagcgaccccaggcagggcgggccaggttgaccttgcacctgctctcccctcagccccgcggccatgccgaccctggtcgtgggcacgccgcccacctgcctgggggacacacctcagccctgccacaagaacagccagaggcagggccccttctcccatggggccccagggagagcagccgactggaaggctgttgccaagcccaggctctgcgcacctgcagctgaggatgacgtggcagccctgaggtggcccgggccctcccagcagccagacccaccctgggcagctccccacgtggtcgggtctgacgacctcaaggaaccaggcccctgggggaaggcgtgcagcctgcccatgtggtccacaggcccggaggctagggatggggacagctcggtgtcatcgggccgcctctcgtgctcttcggggggccacgacgtgtgtgtgtcttggaaggagaggccaccccaggtgntggggccccagcagaggcccagaaagagtgacgcgcggctggagcagctgagagacaagatccgggcccaggcgtggcagcagggagctgtgcgtcctgggcacctcagcccctccanngcctccagantccacaaagctncacgctgacgctttaggaggaaaggcaacggaaggcaaaaaaatcccgcttccaagcgccttgaaagtgcctcagggtttcaagcatcttggagtgcagctggagcgcagaggttgaagcccaagggcatcccacgggccagggggcgcgagctctcagggtctccagacacagtgtctgtactgagggaaaaccctaaggggttcaaagcagttcttggaaagaagagaaagacccaaggtgcctcccgttgcgg

SEQ ID NO: 713653 - DNA, 756 bp, Homo sapiens
  misc_feature (359)..(359): n is a, c, g, or t
  misc_feature (477)..(478): n is a, c, g, or t
  misc_feature (488)..(488): n is a, c, g, or t
  misc_feature (500)..(500): n is a, c, g, or t
gcccgcatcacggcctcagagacagccgcatgtctgggccagtcacggctcttggcctctgggccccaccgttgctgggaaggggaggctctgcgcacctgcagctgaggatgacgtggcagccctgaggtggcccgggccctcccagcagccagacccaccctgggcagctccccacgtggtcgggtctgacgacctcaaggaaccaggcccctgggggaaggcgtgcagcctgcccatgtggtccacaggcccggaggctagggatggggacagctcggtgtcatcgggccgcctctcgtgctcttcggggggccacgacgtgtgtgtgtcttggaaggagaggccaccccaggtgntggggccccagcagaggcccagaaagagtgacgcgcggctggagcagctgagagacaagatccgggcccaggcgtggcagcagggagctgtgcgtcctgggcacctcagcccctccanngcctccagantccacaaagctncacgctgacgctttaggaggaaaggcaacggaaggcaaaaaaatcccgcttccaagcgccttgaaagtgcctcagggtttcaagcatcttggagtgcagctggagcgcagaggttgaagcccaagggcatcccacgggccagggggcgcgagctctcagggtctccagacacagtgtctgtactgagggaaaaccctaaggggttcaaagcagttcttggaaagaagagaaagacccaaggtgcctcccgttgcgg

SEQ ID NO: 713654 - DNA, 339 bp, Homo sapiens
  misc_feature (213)..(213): n is a, c, g, or t
  misc_feature (244)..(244): n is a, c, g, or t
  misc_feature (246)..(246): n is a, c, g, or t
  misc_feature (259)..(259): n is a, c, g, or t
  misc_feature (272)..(272): n is a, c, g, or t
accactgatagaggaacccgccagaaccactaatgagaatgtgttacactgatttgggagatgcccaaggaaagcaacaatgggacatgtaggatttgaccccagtaagggaaagaaacatttctcctctcttttttttttagacaaggtgtctctctgtcacccaggctagagtgcagtggtaccatcacagctcactgcagcctcgatctnatggggtaaaggaacctcctgcctcagcttnanaaatactcactancatgcactggctnattacttttattttttgcgccagcagatggggtcttgctatgttagcgcacacgagctggttttgaa

SEQ ID NO: 713655 - DNA, 236 bp, Homo sapiens
  misc_feature (193)..(193): n is a, c, g, or t
cgggtactggagacgaagtacgagggctcataagatctagaggaggagcgggccagctgtcttcaacacggacacgctctgctgaccacccagagctgggccagggaggacactgctccacttgaccacccatgagctgggccagggactcaacacatggggacagcaagtcccccatgtgctctgccagggntctggatgtggacggttcatggaaccaatgggtgcttcttggt

SEQ ID NO: 713656 - DNA, 687 bp, Homo sapiens
tgccctcggccatcaggcacagcgggagcggagcaagtcgtccggatcgccagcgccgtgcgggttcctccgggagtgaggcggcgcgggagccggggacgccgcgccggcatatctcagacaccccgcaagcggcaccggcgctgcccagaccgaggccatgaatgcagattctcggggtgatcgcacaaggagatagcttcggagaccgggagaagaaaaagggtaagcttgattgattacgcagggaactgaatgaacataggggggtaagaggcttaagtcaagatctagctggagtagccgtttctaaggtaccagagaagtcgacaaataagttatggagttgttgcaaagaggaattagcagaggcagtttcatggcgactaacgtcgaagatattgcagaaagagcaataaatgaaggacaggacgtcgggagcagctgtatgagagaagaagctgaacaggaagaggtttaaagactgtagttgagctacagtatgttttggacaagttgggagatgatgaacgtgcggactgacctggaaacacggttgattggagtgccaatattgtccgaagaggagtagtcggtgtggatgaatgctataagctagtagaccctgaagggacatgagctggaggttgaatgaccagttgaactggctccattcagctgggggac

SEQ ID NO: 713657 - DNA, 138 bp, Homo sapiens
tgtctagtctatcaacggtgtaaatacaagatatacaggcgggctcggtggcttatagcctgtaatcccagcactattgagaggccaagtcgggtggatctcgaggtcagacgatcgaggccatacctggctaacatg

SEQ ID NO: 713658 - DNA, 103 bp, Homo sapiens
accctcagtttacacaatacacatatgaattagcaatagcactccttggcatttacctaaaggagttgaaaacttatgtccatatagagaacctacaaatggg

SEQ ID NO: 713659 - DNA, 269 bp, Homo sapiens
gggaagctgaggacaaagtgagttcagagcctagcgcgtcacctgtgtgcgtgtgaggagcggaggactcaaaggtgcaacgtccgagagagccattttctctctgatggcgcttggagcacacttaccctgacagagaagaggagtattacacagagccagaagtggcggatctgacgcagctcgacagagactcaatacactgaagtctgaatctcaaagctgactgtgaggagagaacattacagcattagagattcactctgaaa

SEQ ID NO: 713660 - DNA, 447 bp, Homo sapiens
tatttccacagggtcagaagggttgataaaacaaatagccgaaaggtgcaaattattagccaatacttcagagcaccccatgccctgctcaggtctacccattttgagaaagtattgtggaatcagtgagatgcccagaagaggccctgacttgccagcccatgggccagaatcagtatgcctactactgtaagccagagggctactgacgatgagaatatcttaattgtccctggtgagagaccaaaaaagcaccccatcaattctagagttaaccatcttcactagcccagagagttgccttgctcaagtaagtttactggggtctctgacccttgacatgacaaacggctttccacagtggaagacaagtggccacttgaatatttttgttcagtgtcaccactgttgggtgacttctgcagtggctcaggaactccagaatct

SEQ ID NO: 713661 - DNA, 260 bp, Homo sapiens
  misc_feature (25)..(25): n is a, c, g, or t
  misc_feature (44)..(44): n is a, c, g, or t
  misc_feature (99)..(99): n is a, c, g, or t
  misc_feature (103)..(103): n is a, c, g, or t
  misc_feature (113)..(113): n is a, c, g, or t
  misc_feature (178)..(178): n is a, c, g, or t
  misc_feature (217)..(217): n is a, c, g, or t
ggactccaagcttgcttcctagggntctttgccctcatcctctntggcaaatgcagttacagcccggagcccgaccagcggaggacgctgcccccaggntggntgtccctggnccgtgcggaccctgaggaagagctgagtttcacctttgccctgagacagcagaatgtggaaagantctcggagctggtgcaggctgtttcggatcccagctctnctcaatacggaaaatacctgaccctagagaatgtggctgatct

SEQ ID NO: 713662 - DNA, 358 bp, Homo sapiens
cccccaatcaagatttagaacatttccatcaccccaaaattccctgggattggtccctgggtcccaggcaagccctgatttgttttctgtcactgtggatcagatttttcttttctagagtttcataaaaatgtgtttttataaaatgaatagacttttgtgaaggttttttttcctcagcataatgtttttagacttgtttatgtggcatgaatgaggggttcatttttgtttatcactgagtatttttccagggtatgtatataccccaatttgtttatataccccaaatgttgatggacatttaggctttgtccagttttgtttattatgaataaagccattatgaacttttata

SEQ ID NO: 713663 - DNA, 123 bp, Homo sapiens
tctaggacggatccccgaccacgtgaaactagtaaaccaccaaccccgtctctactataatataccataaaagaaactaataaaaaagaaaaactgagctctgttttttattgccctggcctc

SEQ ID NO: 713664 - DNA, 225 bp, Homo sapiens
cgaggcaaagacaaaatacacacaggcaagaggcacggactcaggggagactgggaaggacctcaggccattcaggaccatgcggacgagcaccgccccatgggcccgtcaccccgacaggatatgcctcacaaacgcatcatagttgacacaaccatggctgtcctcatgccctgccaccagcatctcgtttcttctctagtacatctcggtctcttctcttgg

SEQ ID NO: 713665 - DNA, 113 bp, Homo sapiens
atgacagcgacgctcttatggggggtgaagatacacactaaaatccacatgggaacacaactagacttcagacacagcagagggctacttcaacggcagagaagcaacatcag

SEQ ID NO: 713666 - DNA, 747 bp, Homo sapiens
  misc_feature (3)..(3): n is a, c, g, or t
  misc_feature (62)..(62): n is a, c, g, or t
  misc_feature (97)..(97): n is a, c, g, or t
  misc_feature (100)..(100): n is a, c, g, or t
  misc_feature (108)..(108): n is a, c, g, or t
  misc_feature (121)..(121): n is a, c, g, or t
  misc_feature (123)..(123): n is a, c, g, or t
  misc_feature (125)..(125): n is a, c, g, or t
  misc_feature (128)..(128): n is a, c, g, or t
  misc_feature (132)..(132): n is a, c, g, or t
  misc_feature (138)..(138): n is a, c, g, or t
  misc_feature (144)..(144): n is a, c, g, or t
  misc_feature (146)..(146): n is a, c, g, or t
  misc_feature (169)..(169): n is a, c, g, or t
  misc_feature (171)..(171): n is a, c, g, or t
  misc_feature (188)..(189): n is a, c, g, or t
  misc_feature (196)..(196): n is a, c, g, or t
  misc_feature (200)..(200): n is a, c, g, or t
  misc_feature (219)..(219): n is a, c, g, or t
  misc_feature (224)..(224): n is a, c, g, or t
  misc_feature (230)..(230): n is a, c, g, or t
  misc_feature (238)..(238): n is a, c, g, or t
  misc_feature (256)..(256): n is a, c, g, or t
  misc_feature (261)..(261): n is a, c, g, or t
  misc_feature (264)..(265): n is a, c, g, or t
  misc_feature (267)..(267): n is a, c, g, or t
  misc_feature (282)..(282): n is a, c, g, or t
  misc_feature (286)..(286): n is a, c, g, or t
  misc_feature (288)..(288): n is a, c, g, or t
  misc_feature (295)..(295): n is a, c, g, or t
  misc_feature (300)..(300): n is a, c, g, or t
  misc_feature (311)..(311): n is a, c, g, or t
  misc_feature (314)..(314): n is a, c, g, or t
  misc_feature (317)..(317): n is a, c, g, or t
  misc_feature (347)..(347): n is a, c, g, or t
  misc_feature (350)..(351): n is a, c, g, or t
  misc_feature (375)..(375): n is a, c, g, or t
  misc_feature (381)..(381): n is a, c, g, or t
  misc_feature (391)..(391): n is a, c, g, or t
  misc_feature (396)..(396): n is a, c, g, or t
  misc_feature (399)..(399): n is a, c, g, or t
  misc_feature (428)..(428): n is a, c, g, or t
  misc_feature (443)..(443): n is a, c, g, or t
  misc_feature (449)..(449): n is a, c, g, or t
  misc_feature (462)..(462): n is a, c, g, or t
  misc_feature (496)..(496): n is a, c, g, or t
  misc_feature (626)..(626): n is a, c, g, or t
  misc_feature (669)..(669): n is a, c, g, or t
  misc_feature (677)..(677): n is a, c, g, or t
  misc_feature (727)..(727): n is a, c, g, or t
ggncgggtttaattgagttcggggcgcaggaagtgcgcccgccgcccgcggggccggggttnaggggcgggaaagcggggtcaaggtgggtttttangtntttccctngggcgggatttangnanttngttngaagcngccgtntnaagttgggggaagcgggaaggancncgcgccgagggccaggnngcggggncagnccgggtaggcgcggggctngtgtnggttcngggccgtntgttttggggttcacctngtttngtnntngcggcccacttggcntttncnttggttntgctnataggtgtgtnttnttnttgaatacgtctgagttctcggggtttcgnttnntccccatgagcgccccccagcttnccgggntgtttagggntccgntgntgtttatgtttgggttttttttttttatntttgactgtctgttncttgcnatgtccagcgtgnggttgtcgtggcagccgttctccacgaagcgcantctctcgccgtgcgacacgtgcttgagcttgggcagccggcgctgccagcagttgtagagcaggccaagcgcaatgatgatgatgcagatggccccaatgaccaccagcaccacgaagagcgtgccgtantcgctgcgcacctggctggcccgcgcctggcagctgctggttntggaatanttctggatgccaatctcctccaggctcctgcggatgtcacccagcatggnaaaggacatcttgagtgggg

SEQ ID NO: 713667 - DNA, 183 bp, Homo sapiens
ttggtgttactcctgcttggcatgtctgacagttgacactgctggtgctgacgctccccactgtctttggctgggtgacaccagaccacgtttcttggaggaggttaagtttgagtgtcacttcttcaacgggacggagcgggtgcggttgctggaaagacgcgtccataaccaagaggagta

SEQ ID NO: 713668 - DNA, 200 bp, Homo sapiens
gcggctcatggtctccatcacgccctccacaatccattctccaacccccgtgcacaccacacacatcagcctcacccccttcccttgtcactcatcacctcatgcaggccatcaattcatccagcaagcgtcccatcatgacctcacgcaccccaccagcacctcaacacatccgcgtccattcgccatcactccttcca

SEQ ID NO: 713669 - DNA, 278 bp, Homo sapiens
gcttattggtcatcagtttttcctaggaaacctgggccccaagtttttggttggtttcggacccccagtagggggtgaattaattaaaggtgtttttttaattcagccccaaagcatttgatttgcttaggaaatttattaggcatatattacctggatgatgtcaatttttatgtaaccctttttttcctgggtaattgatgagcctcctaatgttgatttttttttttttttccaagccctgttttttgttaataaaaaatacagaatagggttta

SEQ ID NO: 713670 - DNA, 641 bp, Homo sapiens
gagcatgagcgtgagcctggctcctgatggagtctggtatacagcgtgaccactggaccaccgtgtcttgtgtccctgactttccgtgttgcatcagggacaggcatgtgcgatctcatctttccttaatcagcatcagctatcctctagccagaaacatgctggtgactggactagcagttgcccatttcattggggaagctccttgttgaggggacagaatccaacttctggtgagttagactaaattctcagccaactcctccttgattttctgggcaagtgtttcctgacgcatatccaccattcagagatatgaaacatttctagtagacagtattaagttttcccacggtggtccgtgtctcacactcattcttacctagtgaatacacttggggaccctgaatgacacccaaactctatagtcaggctattttctacgaataacgttagcctaacacgctattatctccacgtcagcagcccgaagaaacatcaggctccacagctaaaaatgtcttctttataacaggcaacttgcttcaaacagtgggttggacacacacttagtaccagagtgcatccccagtgttgaaatcaggatccacattgatccatcataacccactataccgcgg

SEQ ID NO: 713671 - DNA, 342 bp, Homo sapiens
  misc_feature (100)..(100): n is a, c, g, or t
  misc_feature (217)..(217): n is a, c, g, or t
  misc_feature (231)..(231): n is a, c, g, or t
aagggaccatagaagatgttggccatttgggaggaaataatgaattgcacgctttcctttgatctcgaggtatggaagcatctgagaaacaagacatgantgaatcagatggtaatgagaacaacaggagaggaagaggaattggagaccagttgagccatctagtcacatgcagggctgggcaacagcagggcagctcttcctaggagggcagttncttgccgtagcacntggagtctcagcccgatggacccaggactccccttgaataatgactaccttataacactccttttactcacctgaaatgaaattcatagattcctacacatgcatgactga

SEQ ID NO: 713672 - DNA, 976 bp, Homo sapiens
attaaattccaaaagatggaaaactgtctaaaagatcacttatataaataatagtgcatctgtacagttgaagacaatgcagctataaactctaggtactaaaatggaaagatgtccaagacatactaaatgaaaacagcaaggtgtgaaacagtttctgtataaccctgtatacatgcataaaagatctctgaaaggacacaccaagaaactgcaaacattagttgttggggtggcaggacgaatactacatggctggagcagtagaatgggagacttttcactgtatactgttatgcttttaattttttttttttttttttttggaaacggagttcgctccttgtgtgcccaaactggagcttgcgggagccaaaatcgcgccatgacctccagcccgggcaacaaagcgggactcggtgctcaaaaaaaaaaaaaaaaaagtgtgagttttataaatatcccctctctttcagaaaaaggccatatatctagaagaaaatctacctatacacatctaaaagaaaggtctagcggggcatgtattataactaaaataaacctctcctggattctaccctctgtaattgggggcttctggaaagctccgaggaaggaattagggatgggatcccttaaggaggtccactggccattccgggaccatctgtggcgtgtttgggcgcactacctggttggcggggggggggtccacccagtggggccccagagggattctccccaatttagagattttccccgagggaattctctcccgcaaaattcgggggagctacgttctgagcagcaggaaaaaacggggatagacggaaattcaaaactgccccggtgtaacctggataagaaccctcaaagggagttggcacagaatcgggataaatcggtagaccgctaacggcaccgagggagagaccacgtgcaggaagagtacccgaaaggcgcgggcacacaaggg

SEQ ID NO: 713673 - DNA, 984 bp, Homo sapiens
  misc_feature (346)..(346): n is a, c, g, or t
  misc_feature (863)..(863): n is a, c, g, or t
  misc_feature (938)..(938): n is a, c, g, or t
  misc_feature (966)..(966): n is a, c, g, or t
  misc_feature (982)..(982): n is a, c, g, or t
ggcaattctgataattatagtccctggaggttatgcagctaattaaaggtcaaacgcagaactttaaagacgcgttttcaggaagagattcaagtattacgcggttgccactggctttttattatggaatgtatgcatatgctggctggttttacctcaactttgttactgaagaagtagaaaaccctgaaaaaccttttctgagcggctactgggaaatttctcattagcagttccgatctttgttgccctctcctgctttggctccatgaacggtggtgtgtttgctgtctccagcaccctttgacaatgataatgctcttctctggagacctcgacagtcttntgaatttcctcagttttgccaggtggctttttattgggctggcagttgctgggctgatttatcttcgatacaaatgcccagatatgcatcgtcctttcaaggtgccactgttcatcccagctttgttttccttcacatgcctcttcatggttgccctttccctctattcggacccatttagtacagggattggcttcgtcatcactctgactggagtccctgcgtattatctctttattatatgggacaagaaacccaggtggtttagaataatgtcagagaaaataaccagaacattacaaataatactggaagttgtaccagaagaagataagttatgaactaatggacttgagatcttggcaatctgcccaaggggagacacaaaatagggatttttacttcattttctgaaagtctagagaattacaactttggtgataaacaaaaggagtcagttatttttattcatatattttagcatattcgaactaatttctaagaaatttagttatanctctatgtagttatagaaagtgaatatgcagttattctatgagtcgcacaattcttgagtctctgatacctaccnattggggttaggagaaaagactagacanttactatgtggtcatntc

SEQ ID NO: 713674 - DNA, 287 bp, Homo sapiens
aggtacagccatggcacttagtctcagctgatgaagcgtacacagagatctctcagatatggagtagactaagtcccttcattggggatcagtccatttaaactttacaccctagtgttctggttaactttgaagcaggccgagatgggcaccacacgggtcttttgcctccccctatctttcctatgcaggctcccccatgccgggaagattctgatgatgttcacggaaaccaggctagaacctcagctacctcctacagctccgggtacccgaggctccgaatt

SEQ ID NO: 713675 - DNA, 1011 bp, Homo sapiens
gaagaagaaaggcttagaatgagggaacatgtaatgaactgaggttgactactaacaaagacagattggtgactctggaggagtcttcgaaagccacagaaaaaacagaattcttggagccagatagctgggagcacattagatgagcaacagttcttcacagaggaagacactaaacagaatctgcacacaatatctcattgctttacaagcaacaatgacacttcaccgaagcaaggcagcatgagcttcagcacaacacaacagacgacctacaacgtccgcatgactcaacctggaggctcagacgcctggccatatcatcaggtcatacagccagatggaacaaaaaacaccccccccaccacccaccaccccctacccgccacaccatacacacatacacacacacactcatataacacacacctacttcacaacacactacatacacacacaataaaaaaatacaaaaactcaataacaaaacaacagaaaacacacacacacacaccatcaccacacaaaacacgaaggaccagaaaaacacaccacaaaataaaaaaaactcactggggagcacaccagaacataaagagacacaaataccaaaaagaacaacaacgacaacaaaaccaccaggacaaatctacaaacagagaccaacagagaacaaggtaagaaaaaggagccgcaaaccgggaacacaaaacaagcacaggacgaagacaagcacacaagcacagacgaagcaaccatagccacaacccacacacaaagaaaaaccacagcgaagcagaaacaaggcacaccaacgaggacgcagggaggaggagcagagagcggagggggccgcgggcccgcgggcggagacgagagagggcgagaacagagagcggcggaccagcgcgagggcaggacggcggaggcgtcgccggccggcgagggagggggagggggcggggagagaggggacagcagagaggggcgggccacggcgggggagggggc

SEQ ID NO: 713676 - DNA, 854 bp, Homo sapiens
  misc_feature (10)..(10): n is a, c, g, or t
  misc_feature (16)..(16): n is a, c, g, or t
  misc_feature (53)..(53): n is a, c, g, or t
  misc_feature (197)..(197): n is a, c, g, or t
  misc_feature (236)..(236): n is a, c, g, or t
  misc_feature (433)..(433): n is a, c, g, or t
  misc_feature (489)..(489): n is a, c, g, or t
  misc_feature (501)..(501): n is a, c, g, or t
caggccgaancgcagnttcttggcttaggtacttctactcacagcggccgatnccgaggccaactccagcaatggcttttgcaaatctgcggaaagtgctcatcagtgacagctggacccttgctgccggaagatcttgccagatggagggctgcaggtggtggaagagcagaaccttagcaaagaggagctgatancggagtgcaggactgtgaaggccttattgttcgctctgncaccaaggtgaccgctgatgtcatcaacgcagctgacgaatactcctaggtggtgggccagggctcgtgcacagcgtggtggacgagtgttggatctcggtaggccgcaacacgaaggcacagcggcatctttgggttcattgaacaccacctcgaatggagaacgagccttcagtgcctgcagtaactcgacttgntggcaactgactcatgatgtccctgggccgcagggccgaggattctcgccgatggnctgcatcgggcntttccgtagtgtacagggacgggctaacatgcggcagcgtggaagaaggtgcatggtggaacctgagctgaatggaaagaccctgggacattcttgggtctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgcttgaatgacaacaccttttgcccagtgcaagaaggggggtgcgtagtggtgaactgtgccg

SEQ ID NO: 713677 - DNA, 146 bp, Homo sapiens
  misc_feature (100)..(100): n is a, c, g, or t
gcgtgagccacgtgtgaggtttcagtataaatattctaatagccactttaacagtcaaaggaaacaggtgaattaagttttaaatctttatataacccanaattatatggccaagttattatcactttcaccatttaatccagtat

SEQ ID NO: 713678 - DNA, 503 bp, Homo sapiens
  misc_feature (10)..(10): n is a, c, g, or t
  misc_feature (16)..(16): n is a, c, g, or t
  misc_feature (53)..(53): n is a, c, g, or t
  misc_feature (197)..(197): n is a, c, g, or t
  misc_feature (236)..(236): n is a, c, g, or t
  misc_feature (274)..(275): n is a, c, g, or t
  misc_feature (311)..(311): n is a, c, g, or t
  misc_feature (329)..(329): n is a, c, g, or t
  misc_feature (332)..(332): n is a, c, g, or t
  misc_feature (335)..(335): n is a, c, g, or t
  misc_feature (345)..(345): n is a, c, g, or t
  misc_feature (354)..(354): n is a, c, g, or t
  misc_feature (357)..(358): n is a, c, g, or t
  misc_feature (360)..(360): n is a, c, g, or t
  misc_feature (366)..(366): n is a, c, g, or t
  misc_feature (375)..(375): n is a, c, g, or t
  misc_feature (381)..(381): n is a, c, g, or t
  misc_feature (396)..(396): n is a, c, g, or t
  misc_feature (423)..(423): n is a, c, g, or t
  misc_feature (427)..(427): n is a, c, g, or t
  misc_feature (437)..(437): n is a, c, g, or t
  misc_feature (464)..(464): n is a, c, g, or t
caggccgaancgcagnttcttggcttaggtacttctactcacagcggccgatnccgaggccaactccagcaatggcttttgcaaatctgcggaaagtgctcatcagtgacagctggacccttgctgccggaagatcttgccagatggagggctgcaggtggtggaagagcagaaccttagcaaagaggagctgatancggagtgcaggactgtgaaggccttattgttcgctctgncaccaaggtgaccgctgatgtcatcaacgcagctgagnnactccaggtggtgggcagggctggcacagtgtgganaatgtggatctggaggangcnacnaggaagggcntcttggttntgnncncccccnatgggaacngcctcngtgccgcagaactcncttgtggaatgatcatgtgcctggccnggcngattccccanggcgacggcttcgatgaaggacggcanatgggagcggaagaagttcatgggaaaagagctgcctgg

SEQ ID NO: 713679 - DNA, 366 bp, Homo sapiens
aaaacaccaacctgctaaaagagatcttttcattagtcttattttcagctttcttagctgtcgttcacttaagcttaaagataggttaatttgtcaatggccaagtttgttttgaggtttttcctcaataactggtttcccaggcctattaggccatctctttacgatgagctcccttttctaaggcgttcaggacctttgtatgtatgctattatgctgttatttcgtagtcccatttactgcagtggtaccatgttttggatgtgtgatgcttatatgggagaacacagcgttgatgtatagccctgtatacaatggagatactatttatgtcgcacaaggcttatgctatgcaccagtactgc

SEQ ID NO: 713680 - DNA, 411 bp, Homo sapiens
  misc_feature (20)..(20): n is a, c, g, or t
  misc_feature (32)..(32): n is a, c, g, or t
ttcatcacctgccaaattgnttggctgtgcangcaagaggacctgaggccagacttcaggatctgtgtccagaaaaacaagacagatatgctgacacacttgtaattctagtgctagagagacagagacaggtggaaccctagagcctactggttaaccaacatagttcagtgaacaagtatctgtcaatgagtgagctgtgtcaaaatcaagttatatgttcctaagaagcgatagccatggttgacctctgatccctgacttctgtatatgcttgggcttccatacacacatgagcgcacacctaaataactaaataaaacaagaacatttaaccttgtcaaagaggatcttctgacaatacctagtgaaccctaaaattcagacaggaaataaagaggagtttttaca

SEQ ID NO: 713681 - DNA, 240 bp, Homo sapiens
ctcgcccctattagacttattctgccaaggggcaagtatggctaagtagaaagacagttaggagataattgcaacaatccgtgcaagggatggcttagatgagtgtgctgatgtgtggagtgtggggaagtgagtgagaagtggtcacatccatggtgtatattttagtgcgggtgtggctatggagtgatatggatcttgcattttcatttcacatacctggacacatttccaatgttt

SEQ ID NO: 713682 - DNA, 242 bp, Homo sapiens
gaattcggcacgaggttggtgtgatagcggcagagggggggctcggagaggtgctcggattctcgtagctgttccgggacttaaccaccaccatgtcgagcaaaagaacaaaggcccaagacccaagaaggcgcctcagcgtgcaacatcccatgtgtttgctatgtttgacccgtcacagattcaagggttcaaagaggctttcaacatgatttgatcagaaccgagattggtttcatcga

SEQ ID NO: 713683 - DNA, 397 bp, Homo sapiens
catgccaggacagaataaataaaggcattattgatggtccaggcatggttggctcaagccgtgtctactccccagtcatgttatgtgcgaggccagaccacgtgtgcggtactcacgacggtcaggagctcgagatcagcgccgtacccactggtgaaagcccgtctgtattacaaatacgaataaattagtcaggtttggcggtgggtgtctgtactcccatgctactcgggaggctgtcgcaggagatttgcttggaagtctgggagatggatacttgccgcgaggcaaagatctcatccattgcagtccaggcctaggtaatgagagcgagactccgtcggctttatgtctgtggcgtgcatggttattgcaatttacttatgcggattagcca

SEQ ID NO: 713684 - DNA, 154 bp, Homo sapiens
cgatcttattcatttcagttctcaaatactccattgttgcaaccttttatcagcaatgtctttatgacctgtattttgtgttgacctcccgtctcatccaaatgccttaaccatctgggaatgcagcccaggtaggtttcagcctcattttacc

SEQ ID NO: 713685 - DNA, 160 bp, Homo sapiens
  misc_feature (97)..(97): n is a, c, g, or t
  misc_feature (147)..(148): n is a, c, g, or t
ctggtgcatgatgtgtcatggggatggtatgtgctccccagcgtggcaagggtgggctggattcagcaggcctcagaaacgacccccctcctgttgnccctccccactttctagagtgtggggcatgctgggcttgcgagggggctnnttgggctgggat

SEQ ID NO: 713686 - DNA, 720 bp, Homo sapiens
gagccaagcgagatgaaggtgcagatgctgagtccggaatccggactaatctatgtccgcgagatccaagttgtcacttacagagcagttccaagaaactatgatcctggctttacatcctttcgaggtcccacgagaatatataagagctttaacatgctaccaatactggaacgagtatttgcagaaatcattccttgtcttcgctggatggtcaccgtgatgtcagtctattgcttggcatctcttccagagaagctgtctactgtcctttctggggcgtgtgatggacaggttcagaatattggaatctaactcgagctggaattgtatccgtgacaatacaagcacagtgaatggctttgtacgaggaagtactgtactcgctttttgtgggacttcttttttccctgttggtgatgagcaaaactgtgaagcagtggaataagatggactgggccagggctatggacgacgaccgaagagccattacttacaatattaggacaagacagtgtatactggggacttggatcatcatctggaaacgaagctgtatttctgccacatgtggacagcaccgtagacgatttgggatgaagctaaagaactaatcctatatgttcaatgacctggggatctgaccagtatcagtagtgtcaaatttaagcccaattgagacatttctcttgtggaagttgtgcatctgacaggcatatc

SEQ ID NO: 713687 - DNA, 952 bp, Homo sapiens
  misc_feature (222)..(222): n is a, c, g, or t
  misc_feature (231)..(231): n is a, c, g, or t
  misc_feature (234)..(234): n is a, c, g, or t
  misc_feature (250)..(250): n is a, c, g, or t
  misc_feature (262)..(262): n is a, c, g, or t
  misc_feature (265)..(265): n is a, c, g, or t
  misc_feature (315)..(316): n is a, c, g, or t
  misc_feature (325)..(325): n is a, c, g, or t
  misc_feature (340)..(341): n is a, c, g, or t
  misc_feature (362)..(362): n is a, c, g, or t
  misc_feature (374)..(374): n is a, c, g, or t
  misc_feature (377)..(377): n is a, c, g, or t
  misc_feature (382)..(382): n is a, c, g, or t
  misc_feature (393)..(393): n is a, c, g, or t
  misc_feature (437)..(437): n is a, c, g, or t
  misc_feature (440)..(440): n is a, c, g, or t
  misc_feature (442)..(442): n is a, c, g, or t
  misc_feature (465)..(465): n is a, c, g, or t
  misc_feature (485)..(485): n is a, c, g, or t
  misc_feature (494)..(494): n is a, c, g, or t
  misc_feature (506)..(506): n is a, c, g, or t
  misc_feature (519)..(519): n is a, c, g, or t
  misc_feature (544)..(544): n is a, c, g, or t
  misc_feature (569)..(570): n is a, c, g, or t
  misc_feature (622)..(622): n is a, c, g, or t
  misc_feature (628)..(628): n is a, c, g, or t
acatccggtgtggtcgacgggtcctccaagagtttggggcgcggaccggagtaccttgcgtgcagttatgtcggcgtcggtagtgtctgtcatttcgcggttcttagaagagtacttgagctccactccgcagcggtctgaagttgctggacgcgtacctgctgttatatactgctgaccggggcgctgcagttcggttactgtctcctcgtggggaccttnccccttcanacntcttttcttctcgcgngcttcatctctntgntgtggggagtttcatcctagcggtttgcctgagaatacagatcaacccannagaacaaangcggatttccaaggnnatctccccagagcgagccttngctgatttctcnttngccancaccatcctgncaccttgttgtcatgaactttgttggctgaatcattctcattgnacntnaattgaggagtaggagactaaangaatgttcactctttgaatntcctggatnagagttctgganatggcagcttatnggacacatggattttcttcagattntgcacttactgctagctctgctttnnatgcaggagagaagcccagagttcactgtgtgtcagaacaactttctaacanaacatntattaatccagtctctgtctttcattaaatgtaaccttttgccttccaaatttaagaactccatgaccgatcctctcggataaatatactcttcattctctccttaatgaccattaacactattctcaccagaactactaggcgacccagagaaggggcggcctaacaaaaccttcaagaggcgctccccaaataaaggcccggcaggattttggctaaaagggccccaaagaggcggatcgtactaaaaaacgagaggggtgttaacaaaatgttggcagagcaacctactagacctggaaaaaaccatcggggggaattggc

SEQ ID NO: 713688 - DNA, 263 bp, Homo sapiens
aacccacaaataggtttcagttcaggccctgtttaaagccccagggtgggttagggggtttaggaaaccaactccccctcaacattttcccttaatcccacaggacaggaattagccgaaacttggctggtttttcctacgagactgtaagccctttagggacaggggcagggttttatttatttttgggtttttagggcaaagccgggcccccggttggggtttaaaaaagggggttttttttaaatgcccccgccccccca

SEQ ID NO: 713689 - DNA, 219 bp, Homo sapiens
gcggccgctgtaaaccccttccaggatccctctgtgacccagctgaccagctgaccaacgccccgcagccctggcggaattcaacccttctcagagacaaatgcagcgacaacagttctgtcaccaactctggtctacagcagcgttcagcatcagtgacaccagcgactcagcgtgtgtcgagcaggctgctcgcgagcagagactgaacggaagtca

SEQ ID NO: 713690 - DNA, 960 bp, Homo sapiens
cgggtgcccaatgaccgggcgtccctttgatttcttgccgggggtacatttctccaggacggatgctcttgcggctttgggcagcaaagagcgaaggggggccagagaagcgggggggccgcgcggggttccggaggtggtttcccccgcgtcgtgactgtccgaattttgtttaagggggaatataagagccgcttataactagatggggggcgcaaacggtgtgttggttagtcctcctcccctgcgtcccccagtactcggaggctcctccttcttctgccttggtgttgtctcgttgggcgccgcccagggagcggcgttgagtcctttttcttggggaccgccttttagtagtagggcgacccgtgcttgtgggcgccggatttcgcccccccccccggcgttcttttaattagaagggaggtccgtcttagctcctgctggatctctcgaggtaaccgccactcaggagcgctctcgtttgtgtagccgcccgcccttctattatgtttggtgtgtgagaggcgagccgagtgggaggatatgtgtctggccgggaggaggaattttgtggagggggtttttggtcgcgcccccccccgccgggggtttttttaacaacacgagtgggggagaattttgtgggtgggtctgtggtgaggacatttttttaatataccaggagagtagttgtgcagcaccccccggtgtgtagtagttgccccctgtccgggggttgttaataaaatacgcaccccgtgggagagaacacgccgtggttgatgagagtactcccccctccgtgtgttgtggtaaaaccacacacgaaggttgttgggaaggattgtgtgcgccccccccccgtttttttttttttttttaaagggagtgagggtttttaaggggggtttcggcgccccttttataaaaaaaaaaaggggaacccccctcccctga

SEQ ID NO: 713691 - DNA, 217 bp, Homo sapiens
  misc_feature (18)..(18): n is a, c, g, or t
  misc_feature (74)..(74): n is a, c, g, or t
  misc_feature (80)..(80): n is a, c, g, or t
  misc_feature (90)..(90): n is a, c, g, or t
  misc_feature (106)..(106): n is a, c, g, or t
  misc_feature (111)..(111): n is a, c, g, or t
  misc_feature (124)..(124): n is a, c, g, or t
  misc_feature (161)..(161): n is a, c, g, or t
  misc_feature (195)..(195): n is a, c, g, or t
  misc_feature (201)..(201): n is a, c, g, or t
tcaccattgtcttgtgcngtgtcatccttgtaggaataggttgaggtgaccccgtaggagctgccccgtgcacncaggcnggagccccgncacccgtgtttgggcntaganaggcgtaacaatnccctgcttcttgcggcccaagccgctgcccatctttncagcccatggcctgaaagcatccgaatgccaatnttatcnctgcccaccccgtccc

SEQ ID NO: 713692 - DNA, 656 bp, Homo sapiens
tcgaagtcagctaatggacttttatggctctatcttttccttgcagtgaagaaccctatttaaagaactgggtcatcattgtcctgttctagcaagatagtcttcagttttcatttgcctgtgccctgtggtagtgggaaacaaatcataatgtattattgaaatgtttaacatcatgcataacagcgtgtattatacagggtagatttctttagctgccacagtaatactcattcctgtgtgtgtgtcttggagtgcattgactccaggaaaagccatttggtttgccttaactagaatgataaatgtacccctctcagtctgcagtatgagtggtttaaagtatatgtgcagtctgcttacaaggaggggttaccatgtatcacacctaatctgcccaatgttgggatattaaaacacaaagtccttaacatgcaggctcaaggtcttataaggagttctagatctttgacgagaatcagacaacatttgtgtgtgttacgaagcccattcatcagaagtgtggggtcatggtattacactccaaatgagccattggaaggcactgcatgaacttatgcacgggtttgcacatgcttcactgtcttgcctgtgatgatgtcaaaagtatgtgctccattttactttacatggtg

SEQ ID NO: 713693 - DNA, 118 bp, Homo sapiens
atcttgtcatgatagatggagcggggcaccaacgcccaagcgtggcacgctcgcgccagcttcctgccggtaccgctgctgctcgctggcgcggccagcacacccagcttgcttcttg

SEQ ID NO: 713694 - DNA, 159 bp, Homo sapiens
acagcggcgagactgagattatgttcagagtacttttgcagctgcagtactagggctcgaacgggagtgcagggaagggtaatttagaagagaataaggtgaccatgacactttctgaacacctcagcatccagcttccttcagcctacgactgggtgg

SEQ ID NO: 713695 - DNA, 975 bp, Homo sapiens
ctccctacagaatctcggcttaagttataagcgattgcacagaccacgagagacgtaagtcagtatcttgagtatcgttctatcgaagaccacactgtatccccagcttggactatcatcacccgagtgaggcaaccgagcgcgagagacgccgtgaagcgcaggctaggatacttccgtattctaggaccgcgtagtaggctgcccgttccccgtactcatcgacgatctaactgtacgagcgtacacgaagcaccgcgtaggctcactaacacattcgtagctgacgtgcaccctcagcgtgcccaatgaatctatcaaatcatcctagagtccaatcaagcttaagtatgagctagcttacgcaatagcttgtataggagagagtacctctttacggtactccacttatgactccctaaagcccatgtctgaagcccccagtcgctgggtcaatagtactatgccgcagtagctcttgagactaggcggatatggtataatacgcctcacactcattctcaagcccctgataaaacacatagcctgacccttccttgtactagtccctattgaggcataatcataacaagctccagtctggctactgagaaagagacctaaagatcgctcattgcatactcttcaaatcagacacatagccctcgtagtaagcagccatttctcatccaagacccctgaagcttcaagcggcgcagtcgattctcattaatcgcccaacggacttacactcctcatttactattctgctaagcaaagtcaagattacgaagccactcacaagtcgccatcataagtcctctcttcaagacttccaaatctatacccaataatagccttttgactgatttctagcaagcttggttaacttcgctttacccccaataataacctactgggagaacctctgggcgaaagaacacggtctcctgagaaatatcatctcctaataag

SEQ ID NO: 713696 - DNA, 141 bp, Homo sapiens
ggagagggggtctcactatgtggcgtaggcggtaaaacaaacaaacaataggtaagagagggatttttctagggggggagaaggttggggggatgtgtctggggctttcttttggccaggcttccttcaaagcataccggc

SEQ ID NO: 713697 - DNA, 464 bp, Homo sapiens
aaggtgaatcattatatacactcatatatacacatatgtttatatagctaatcggtagtgcgatggggcattcacagtcaactgcaaggggtccgtattgtaggaattccggctattgcaacagaacagtaccctacacggtcttgtgagcacgggtcaagataatgatttaacaggtgttaaactgacactgacaaagaccaggttctcaatggtattaccagaagtggactcaggcattagcacttattctccggagtcaggatgtgatgacttatttgagtacaaactcatgtgtgcatacaacatactggcctatagctaggtgtgcgtagagtcctagatgacatggtgggtgatgccacctaataacgaaccatgatcgacaggatgtctgccctcgagcgcatggctcgatcggagatcatagtgaccacgagtgcggctgctatgatcaagctggt

SEQ ID NO: 713698 - DNA, 444 bp, Homo sapiens
  misc_feature (33)..(33): n is a, c, g, or t
  misc_feature (129)..(129): n is a, c, g, or t
  misc_feature (240)..(240): n is a, c, g, or t
  misc_feature (285)..(285): n is a, c, g, or t
  misc_feature (332)..(332): n is a, c, g, or t
  misc_feature (395)..(395): n is a, c, g, or t
  misc_feature (416)..(416): n is a, c, g, or t
  misc_feature (433)..(433): n is a, c, g, or t
tctcctgacctcgtgatccacccacctcggccncccacagtgctgggattacaggcatgagccactgcacctggcctttttttttctttagagacagtcttgctctgtcacccaggctggagtgcagtngcattaattatagcttactgcagcctcgaactcctgggcctcaagcaatcctcctgggtttccttcccaaagctatgaaattgcagacaggagccaccatggcctgggctngtttttggggggccatggcaagtgcaggcttgtcagagggaattnggagaagcagggattagttagggaaaacctctccacttcttgtgttntcatggccagggtagtgttttgttaactttcagaaacccgccctttacctttaaccttacctnaccatgtttatggttcatttnacccattgttcccttgncgtataagggg

SEQ ID NO: 713699 - DNA, 881 bp, Homo sapiens
tcaaacccatcaaaatctacttatttataaatccaaggggtggcagcatcactctgtcctagcattctcttgggtggaaagtggctcgtgggtgcctagccgtgggaagttgagcagcagcccactccccggtttcactttctctagcccatcattaccgtggtgaaacgtgcaggtggggcagctcagtggcaaatagaaattgtgggccgtggggatttcctccttcttttccagctccatgtgtttgtgcccccgtgctaggaaaattagaaagaacgagaaccaccagtgttccccaggacacccagggttctcacttcctctctgggcagtgagtggtgtgtggctaaaacctcccctttgtgcgtggccttgtgtgccaggtgaatcacgtgagaaaacaccacctttgaccaagaaaaaacgtgccccgaggtgtgcgaacccacgccacgtataacccataggtggaggtgcacgtgtccccccccttttccctagagcgaaaagtgcgtgaatcccaagaaaggtgccacccctcctttgtgcacttgagggctcccccgagagaacccccctgttgtgtccccgtggaaagtctgaggggcaacataaaacttaaataagcccacaaaaagttaatttatggttgccaaagtcgcataactctggggtgaacacacggcggttgggggcccactctctctatcaaccgggacctaaagcggggactctgcggtggggagctcaactcgcgcttataaacgcgttcttgaggaacccccaaagatctccccttaaaaagccccacgcctgaataaaactcatttacactaatctccttacaaggcgaaccaccacttaaatggcattgtacc

SEQ ID NO: 713700 - DNA, 287 bp, Homo sapiens
ctaatcagcagaagctagggttctgatcctgttgctgatcttgatgcaaactctcacagcctttctgcaccccgaggttccctcatccatacagaagttgctgatgccttttctggctttgtgattctacttaagtaagctgcctcctgtgcggcattagaaagccactctatcagcagcactgtctccttccatggccccgaatgtgaagcgagcgaggttgctcctccacctcagcacaggtcggtgagcctgccagccgggctaatccatgcgtggattgccat

SEQ ID NO: 713701 - DNA, 233 bp, Homo sapiens
gttttgtataacatcactatctatgctgcggaagaaaatcaagaaagtacacctgtggtcattcaacaagaaaccactggcaccctacgcttagatacagtgccctctcccagtgacctgcagtttgtggcagtgacagacgtgaaggtcaccatcatgagaacaccgcctgagagtgcagagaccggctaccgcgtggaagtgatccccgtcaacctgcctagcgagcacgg

SEQ ID NO: 713702 - DNA, 350 bp, Homo sapiens
cagtaaagaacttagatattttagaggtctgatttgggggttgagaaaaactgctaagactggtggtcacagtcaacatggtggctcacgcctgtaatcccagcactttgggaggccaaggcaggtggatcatgaggtcaggagttcaagatcagcctggccaacatggtgaaaccccatctctactcaaaaaacaaaagttaaccaggcatggtggcatgcgcctgtaatcgcagctacttgggaggctgaggcaggagaatggcttgaacctgggaggcgtaggttgtggtgagctgagattgcaccactgcactccagcctgggcaacagagagagactctgtccca

SEQ ID NO: 713703 - DNA, 623 bp, Homo sapiens
agctgtacgctcgatcgagaagttggaccagcgtcggtaccacgacgccgagagcatctgtacaaatgacgcagtatcagatgaagtacagtaacagggcagtacaaccatccgcagcatcctgaaggtctacaccacatgcctgtgccaaagctgctgacttcctggacctcacagagcaggagttccggatccatgcgttcttgtttcaaacacaagatgaagaacctcgttgtggaaccagcggtatctcagccctggatggtgaatttcagtcagctcagaggttgacttctacattgataaggacatgatccacatcgcggacaccaaggtcgccaggcgtacatggggatctcttcatccgtcagatccacaaatttgaggagcttaatcgaaccctgaagaagatgggacagagaccttgatgatattcacacacattccaggaacctgttcgatgtattataggcaggaagtgtcaagctaccgtgacacctttacctagatcagccatcagcctgtcaactcagataacaagttaaggaccgaagtgttaccagtggatctcagtacaacggatcttggcagccacaaaaaccacacgcagagatcgtaacaca

SEQ ID NO: 713704 - DNA, 1494 bp, Homo sapiens
gatgggtgtcggcgtgaccaggcctgagctccctgtctctcctcagatgacatcgtctttaaaccctgcgtggcaatcacctgacgccacgccgtgcatgccccagggcacagcaccagggcgcacctggcacagtccaactcacttccttcaagcatccatcccaactcattggcatgcattcatccgcacacatgtttccattagtgggccagcagcaccaatgtgcggctcccaagccagcatgccagccagcatccagacatgtcccattcagcagggcaaggctagtaggtagctagcatgaggcacagcacacaccaatagcattgcgcacaggcacatccagcagggccaccatggcaacaacacacccaagctcttaggcagcaacactagcatgcccatccatatccaggaggtgcaatgtgggcacttagctgttccacccacaggcaggcccccatccacatgcagcatccagggcaccatgtatgcatagggcccacatcacaggtgccacaagacctgcagacccagatgcactggatgcccactgagaccaccaaatgatgacagctccacatgagtgccaaggacccaccgacaacacatgagatcttccgaggaccacgtcagacacgaacacatccgatataaaacccaggacataccagggtcattcacacaacattcaacaacacatcccacgggggacacacccattggacaccatcactggaccgatgcatcgtgcgacgcatggcattccaacgcaacttgcgaagcaccaccacaggtgcgggcagcccaagcgaacacacccacggcctggcgttgaacccatgacgtacaaacgcgctcctccccacaatatacaggccctcttgcggactggggtcgcatcccagagcccgcggggttccagcacccacagggccagacccaatcatcaccaaccccctgccaagcagcgatcggccaactcacgccagacaggaccaccacagtggcaatccatcgaccgtcaccagggcacgcgggagctcaccgcaccactgcacacgccagacgagcaataggacagtaccagcaatggagcaatccccaacaagtgatggacaaccgagacaccaaactgacagcaacaagcgcgagcaaacaccaacgatccgtgagccaagtgacagcggggacacacgagcaacaaaccagaccaccagagtagacacgagcagggaccatacgaggacaacaagactaacagcgagacaggaacagatgaaacagcaaccaaaagcacaagccaagtcacaccacaactagacaccaacaacaagcaaccagaacagaagaggaagcccgacaccacaaacaacatgcacaagacacaagagcagaagcaggacaccaacagaccatcatacagaccgcacagcggagcctggcagcgaagagcgacacgaacaaaaaggagaaaaagtaagcaaaaac

SEQ ID NO: 713705 - DNA, 536 bp, Homo sapiens
taacataattgtatcaaaagacaacgaaattagtcacggctttgggtgctattcagctggaccgattccaggggcagcttagtgtggtttttcattggcaaaaatggagacctttaaaatggcaaaacaaatgaccggaggaagaggggtggttggacccacgcagttgtcttggttgtaaacagtgaacattgtgctttgttgtctcatttagatggagggctgcagcatgggaggtaccacgctggcagtcagcagtcacaccagggtggtcagagacactggtgacagcatctgtgcttgcaactgcattcccagggtgtctgttttgttcccaagtgtctcccacaaaattccccaggaggttctccgattaaatgtcctcagagtgaaaagcatggactccaaatcactccgtatccacttccatgagatgtcttgatgctccagttcaatgagtaacaatttctcaagaggctctgattagttcattaaaaaataagcgacccacctcattccccgggggacagcatatc

SEQ ID NO: 713706 - DNA, 794 bp, Homo sapiens
gcacagccaaagataagaaccgctgggaggaccctggtaagcagctctacaacgtggaggccacatcctgatgccctcttgggcctactgcagctaaaagacgtttgactttgtgcctcccgtcgtgcgttggctcgaatgaacagagatactacggtggtggctatgggtctacccaggccaccttcatggtgttccaagcctgtggctcagataccaaataggacgccccatgaccagccaggaactgaaccgttgatgtgtccctccaactgcccagcgcagcagctccaatgatgcaccaccgatatccactgggaatctgccagtcctcctgcgatcagaagaggccaaggtaaaatgagggtttcacagtcgacagctgaaggaaacaggccaaggcaccttgtcgcgtggtgacacatgtaccatgctaaggccagaagattcaactcacctgtcagtaaattcgacctcaaggtcaccttacataccagcagcggcaaacatgaagagaggcctcaggatgggcaagaacgtttatgatccttgacgatctggaccaggtacggggcacaaccacggatgcccactgatgtctatcataggcacatctcccatggcttgaactgggctatgggtacccggaaaccagattgaacctggcaaggcatgctgggctcacggggacgtacgaaaaacatccgatctaccaaccttgtgaccttggagccagtgccctctcccgatctagaactaccctccatcatctggcctggggaatagaggctgcc

SEQ ID NO: 713707 - DNA, 331 bp, Homo sapiens
ttttttttttttctttgggccccccggggtagtggccggggttgcttttttcacctttgggccaagtgggggctttgggccctttcccctcccggggttttttttttttcaggggggggcccctttttggtttccctcccccccatcccgtgaagcgcccccgtcccccacagtgggtgtttttttgttttgggccccggggtcccccttgggggcgggggggggtttttccgagctcctttaaggtttttttttcgggccccttcccccgtttgggttttgtttttggcggggggtggtttgcattcccaataaagctttaaaagttata

SEQ ID NO: 713708 - DNA, 1523 bp, Homo sapiens
actcaactatccagagacccaatcgtcatcctcactatagcgcaaacagaagagagtattatctggacaacatcctctaccatgatgcgctgcatgtacaattattacatatgcgccacatgggcacaatcattgacacacacatacttgctacctttatgaactctatgtgcaactgtagctaataccctctaaaatgctttcatgtcagtaagtggacgatagagcgtagaacattcaagctgtcttgatgaagttcggccgggtgatcatgatacccgcggaaatggcgaggacctaaggctacccttacacgcaacttggtaccagaggaggccccactctgctctattggtatgcatcatgtacctcataacgacttcacttatgtgcaacatggctcactgagagccctaccacgatgcctgtgccagagtatgcctggctatgttctcgaggaattgaggaaatcgtgtaaagtgtgcaatgtgtggcagacatagggcacgcaacgccaagcccgtcgttcctagtaccccttctggtgaaagttttaccgcctgttccagtctcaaagagatagtaacagttctcctctttgctgagcaacgtagggcataagaagaccgcttttgcatattgacgcaagaacgttaaacagagcagaatgttatagcccaaccctaataagggtacgagtcgcgttacacaccatgcgcatgtccttcccccacaggttcaaatggaaagaggacgggtttgcgacagagacctccagacgagactctaacataacccctaaagagcatataattcatctaggaaagcccatgtattagacctttgtataccttctcggtacaagtgaaccacgaacgttgtgggtaccccaaagtttccttattccaaccccccttattaaggacaaagcaaaacgtcatactcgggtaaaggtaattacagcgttaacaccgacggggacacggacgacgcgagtttccttccgagacctgatctattacaaggcgcgtgaggcgggtccacgagtgtacataaaacggaactgtttgacacaccttagaactaaaattttaaacagcaaagacgcccaagagttgattccttacccaaaattcagaatgccaagatcgaaataaaaagaataaaagacagaagaggcgcaacaatttagggaacatagcaaagttaactacaccaaatcgagtatccggtacaaactgtagggaaccaagaccacttggacgtaagacgttgaggggacaatcatataggagagaccatgtgacaccacctattaagagttacataagatgagtaatggttagcaccacaaacacatgtgtgggacacaaactagataacacgataaggagttaagaccattcataaaaaaagcgagcacacgaagtggataaaaataaatatacacaaacatagtgaaacgaggggacattaaacatgttgtgactataacaacttcaacgctgcaaatatgcatcaga

SEQ ID NO: 713709 - DNA, 395 bp, Homo sapiens
  misc_feature (341)..(341): n is a, c, g, or t
gtcggtacgccagagataggatcgcggcgatgacgatcagtcctggctggagcaggctggaataaacgtgggagatcactgtggccagcagctccctgagacacaaacaccgttcttcctgtggtctggcccgttgtcgtgtaagcgggggacaggaagcatgagggagcttgtggaggtcgggccacgtgccatcccagacatcaagaggccccaatgggtttttacttgtttctcgcagtctggaggggcagccatgaaaactccaagcgccccttggcataagaaggagatgccccagactctccacgtccagaaactggtgggatctggctcatggngagcggcagagcggcagtgataggacttcaggtgagcccaaggtgctgggggaa

SEQ ID NO: 713710 - DNA, 901 bp, Homo sapiens
ggaaataaacagccttgttgctcacacaaagcctgtcggtggactctcttcacacagacgcatgtgacatttggtgctatgacttggacctggggacctcccttgggagatcaatcacctgtccccctgctctttgctctgtgagaagatccaactatgacctcgggtcctcagaccagcccaagaaacacctcactaattttaaattggggacccactggaaatccgactgcccagcctcgcccggcagccactcctagagcccctaaagctctggcccgaggctctctgaccgactccttcccagatctgctcggccttagctggctgaagacctaacactgcccgactcaccttggaagccccctggaccatcacagacgccgagcctcgggaaactctcacagccggaggaactgtaatatcggccaggcgcgactggctcacacctgtaaactcccagcacctccgacgcaggccatggccggacagatcacttgcaggtcaggagttcaagaccagcctggccaacatggctgaacacccgtctctacaaaactcaccaacacttagccagctgctatgaagcgcattccagcagttgctccatgaaggacatctcaacagtccttcgaaccttcgctgaaggcccatgtaagcacacaaaattcatcatcagatgacacgagatttctctccctcgttctgtcaaaatattcgactacacccttaggtcacacaccaggagcttctgttccacagggcaaagccacacatcccaagccttcagcctatgctcggccagaatcggcacccctcttcgccgctgtgttcccgcgcctactttggtctaatggtggacccgagtggtaggttccgcccaccacagggcgaccgccga

SEQ ID NO: 713711 - DNA, 310 bp, Homo sapiens
  misc_feature (182)..(182): n is a, c, g, or t
  misc_feature (201)..(201): n is a, c, g, or t
atggtttgcccgggggacgaggaaggggcgccttggtaccgaggaactccggggtctgggggacttcgggggcgtctctgtgaagcggtgtaatcagttcaggcggagggggaccccattctggagtcttctctggctccccaagactttggctcatccccctactcttctggaggtggggngggcctctgggcagatggntgtccccctgttccccctccactcttctcttcctctcttttttggggggagaaacctcggaatttctatgagacctcccccagggaggggttcagttgggcccccatcc

SEQ ID NO: 713712 - DNA, 104 bp, Homo sapiens
ggaagacattatggaggttctccaaacaactaaactcgaactaccatacgatcctgcaatcccattactgggaatattctcaaaggaaataaaatcacgcggat

SEQ ID NO: 713713 - DNA, 476 bp, Homo sapiens
gacatcgccaagtttaatcacagcatcatgactgctcatgtcatgaccacgcagaggggcagtaactcccttcaggttgtgtcacgaagaaacacgtgtctctagggccacacatgagcctcctgtaggaaggatttttcattctactgtgtaagattgagcaaaacccaaaacctcagttccgccaacttccctaaaaggatgacagggccacgtgaaattgaaaccctgaatgtgggccattcttaccaaaagtcactaccgagctgtccaaagggcttgtttgactttctctcctttccctgagcacccgctccctggcaggcgggaggtggtgactgtcaagtcctggaggccctaccagctggagatgcaacctgggataattatatatatcagctattggaggaggagggtgccgaatctctaaggcaacatccctaagctcagcccagggattagtgagattttactta

SEQ ID NO: 713714 - DNA, 1060 bp, Homo sapiens
gtgtattctaaacagtacttgaagaacaacaagatagcctctgacatgattcccaaagggtaaagtttaccaatagaaattaaatggtctaaacggtggagataacgcactgtgggcagatgaagaggaagtaccagtgtctgcaatgtgacccggcggcccagtccaggtcaccaaacattcccgatgcagacaggagagcgggcagacggtggagtgcacggtggcccagtatacaaggacaggcacaagttggttctgctgctgaaccccgacctgccatgttgtacaagatcggacaggagcagcaagacacacctagcttcccctggaggtctgtaacattgtggcaggacaaagatgtattgacaccagattaacggacaatcagagctcaagcatgatcagagcaactgctaggctcggcgcccgatcggcaagaagagattagcaaattgatgcgaagtgcaagtttcaacacagatccatacgtccgtgaatattggaatacatggtacaaacgatgaggatgacagaccgtgactggagacgggtgacattgcacccgacacactccatacctctaaaggggagcacggaattaaagcctaattggcgatcaccatgtaccaggaggcagtactggagaacaatggagggaaacaaaagcaggtccagcaccgaggcaaatcgcaagaaatcacaagatgatagagtgcaccaaatgccgagacatctcaggacccccacaatcagacacgatgcacgggacagtatccacactgagaggtccatacagcagcagagcaacatcagaaaagaatctcagcaaagagacgacatgggcatgccccaaatccagcgggccagacacggggcatcctgcacaacacaaccgcaagtgggcgagaacggcagggagacacaaggaaccgggcaccctggcggacacagcgttaagcacggctcgaaccaacgaaggaggacacaccaaggcagcggcaaagacgaccaggcagcaccagaggcaacgacagccagcatgaacacaacacagagg

SEQ ID NO: 713715 - DNA, 436 bp, Homo sapiens
  misc_feature (51)..(51): n is a, c, g, or t
  misc_feature (96)..(96): n is a, c, g, or t
  misc_feature (386)..(386): n is a, c, g, or t
atggcctgcgttgacatcaacgagtgtgataaggccaaggctgcctccccnctgtgcgtcaacgcgcgttgcctcaacacggatggctccttccgntgcatttgccgcccgggatttgcacccacgcaccaaccgcaccattgtgggcccgcacggccccgggcttaaaccctggcacccgttggccgcccacccgcgcccgccacttggggcccctgccgcgcatcctgcagcccgtttatgggtatgtgcacggggccgcccgcctggacctggaaaagggacctacggacgcttggaaattgcgacgccctgcactgctcccgcctccacaagggcctcccactaatgttgtggtcccgggcctggcccaggggcccctttanatgccctttcccttttataaaattttccattaaaaaccccctatttttta

SEQ ID NO: 713716 - DNA, 135 bp, Homo sapiens
ttacatgtaaccgcctcccaacaaaacgtccaagggctcttggttttgtgacttattcttgtgttgaatgaggtggatgcagcactgtgtgctcgaccacacaaggttgatgggcgtgtagtggaaccgaaagag

SEQ ID NO: 713717 - DNA, 460 bp, Homo sapiens
tcgagctcggtaccgattacgctcctagacggggatcctcagacagatctagtaactgaaaacctagacaggattcaccattttaaataccattaagaatattcatggcaggctgggcgcggtgactcatgcctgtaatcctagcactttgggaggccgaggcgggcgaatcacaaggtcatgagtttgagaccagccgggccaacatggtgaaaccctgtctctactaaaaaaatacaaaaattagccgggcatggtggtgtgggcctgaaatcccagctacttggaaagctgaggcaggagaatcacttgaatctgggaggcggaggttgcagtgagccgaaatcgtgccactgcactccagcctgggcgacagagcaagactttgtctcaaacaaaaaaacaaaacaaaaatttccagggccgggcacagaacctagggcctgtaatcccagaagtt

SEQ ID NO: 713718 - DNA, 120 bp, Homo sapiens
gaagcgcgcccatgatctagagctgaagaatgttatacttcgtccatggagcatcacagtcagctgttagagaagcagaacatagcaaagaaaaaattaaagaactagaacagaaaaagt

SEQ ID NO: 713719 - DNA, 765 bp, Homo sapiens
aggaccctttaatacatttaggatcctctaggagattccaggatgaaaatccatccgcgtgccaacgagacatatcgtccccccgctgtctccccaagatgtttactctatggaacgccttgttagtacgtctggcgccttttaatacgtcatttcaacgcattgcatgcactcacggaaaagggattcaatagtcctaaaagctcacagggctggcgtccggtagtcgtgcacctctacagctccccatgggggactgtcaggttcacgactttcaggcgattaccctggtggctatagccttgatcccctagagatgatctggtcagtagtaagagaaggcgcgcagagtataataggtgtgatgtatatcttaatatagagaggtgaggagtcgtggcttggagatatgaatggctctctccccaccatagtaatggcttcctctcagaattttattccaggctagcttgctgcagctctgagtaattggatcatggctaccaactgggattgggatggaaagcattgaggggagtagaggttccagtctctaggagacattgtgctcaggaatgttgaatacgctgctatacttacctctggttactacatttcttccactcccgctttcccctacctgccttaaccaaggctcatagcagtcgtgtccttagccctcagatggagccaggaagctcagtgaaaggcttccgtaccctgtgcactagtgtctctgcagaatacgcgccggttgtagtgtga

SEQ ID NO: 713720 - DNA, 138 bp, Homo sapiens
tgcgccactgaaatgcagagacggccaggactttatgacccaccgtgtgacagatgggaaagaatctattcttccttttagtatctacgtgttgcttcaatactagcaaggcggactgtgctatcgtgtgtagtagca

SEQ ID NO: 713721 - DNA, 386 bp, Homo sapiens
  misc_feature (85)..(85): n is a, c, g, or t
  misc_feature (113)..(113): n is a, c, g, or t
  misc_feature (157)..(157): n is a, c, g, or t
  misc_feature (161)..(161): n is a, c, g, or t
  misc_feature (224)..(224): n is a, c, g, or t
  misc_feature (246)..(246): n is a, c, g, or t
tcttgtatggctttggtaggcatacttggagaacataacccacattaggaattgatttaagccctgagagtttgagggctttaancctttaaaacttggagaagctggctggncgcggtgctcacgcctgtaatcccagcactttgagagaccgagncggncggatcacgaggtcaggagatcgagaccatcctggctaacacggtgaaaccccatctctactnaaaatacaaaaaattagctggncgtggtggcaggcgcctgtggtcccagctactcgggaggctgaggcaggagaatagtgtgaacccgggaggcggagcttgcagtgagccaagatagtgccactgcacttcagcctgggtgacagagtgagactctgtctc

SEQ ID NO: 713722 - DNA, 130 bp, Homo sapiens
tatacagagggtgatcagctgctgagataaatggggaggaggaagagagtgatgaggagcggagcggaagaccaggccagagtccgaagaggagagctccgagactggatgatgatggactatgcagcga

SEQ ID NO: 713723 - DNA, 105 bp, Homo sapiens
ctcttcgatagtccttttcaaaatggcaaactcccatcactgctttattttctctgtcgtacttaccactatcttttttttttcttcttttttggagacagagtc

SEQ ID NO: 713724 - DNA, 702 bp, Homo sapiens
tgacgcatgcctgtttttggcaaggtcgactataattagtctttccccgtcaccaagtggcaccgcttgctcaatgacatgatgagctggttactgtcggacatctagatcatgtccctgaccaagaaggaattcgtgagcattgctatctttccagcagcctgcataagcgtagaccgtatgcagattatgcgcgtgcaggatcagacccgtgtgcccccgagtaccaggatccaggcattagttgttatcggagtcaacgacgttcacgtgctcatgggtgacaagggatgcagagcgtaggtcgacgacatctgctaggacagcactctggccaagcgtgcatcgaccacgggcgcaaagtttacggagggttcatgatcggcattcccgacactgccccttacatgcagtcatgccttttcagttgtgtggtgctacggatttagactgtatcaattgcagcagctatccctacagcaattatgcctaacagtgctatcaagactgctgatatggagctgtggttcaccttaagacctttagcgacctgtcatcctggctaaattcgcatggcctccttggaaccatggcgaccacttctccacacccctgcttctgtaagagacggatgtacttttaggatatgagtaccgaccatccttccagcctcatcagcgtctctgactggtcatcgtttcc

SEQ ID NO: 713725 - DNA, 252 bp, Homo sapiens
gtacagataaaactctttatggcatctctttcatggacagtgattgatcttttcacaatgtatgtagcctctagacttttgtacatatgtttgctctgtggttgtacagactatttagttgttgagaaacaggggcgcttcctaatttggtctttatcctgcgacaacactttcagcagactagcctctccttatctcacagatcacaagccccctagatagtgtgattctgcagatagcatttatgcaaag

SEQ ID NO: 713726 - DNA, 872 bp, Homo sapiens
  misc_feature (28)..(28): n is a, c, g, or t
  misc_feature (67)..(67): n is a, c, g, or t
  misc_feature (84)..(84): n is a, c, g, or t
  misc_feature (88)..(89): n is a, c, g, or t
  misc_feature (101)..(101): n is a, c, g, or t
  misc_feature (113)..(113): n is a, c, g, or t
  misc_feature (124)..(124): n is a, c, g, or t
  misc_feature (136)..(136): n is a, c, g, or t
  misc_feature (138)..(138): n is a, c, g, or t
  misc_feature (141)..(141): n is a, c, g, or t
  misc_feature (176)..(176): n is a, c, g, or t
  misc_feature (180)..(180): n is a, c, g, or t
  misc_feature (182)..(182): n is a, c, g, or t
  misc_feature (189)..(189): n is a, c, g, or t
  misc_feature (485)..(485): n is a, c, g, or t
  misc_feature (498)..(498): n is a, c, g, or t
  misc_feature (557)..(557): n is a, c, g, or t
  misc_feature (594)..(594): n is a, c, g, or t
  misc_feature (723)..(723): n is a, c, g, or t
  misc_feature (734)..(734): n is a, c, g, or t
  misc_feature (857)..(857): n is a, c, g, or t
gcctgcccagcaggccccccaggagagngctcgggcgcccctggcagcccccatacccccaggaccnggctcgtgagggcgtcngggnnaggaagagaccnctctgtgcggcncaggctgagangcagagggcggngntcnaaaactggaagcgaccggtgacgtgtattgaaggngggngngccaaangcggccgacggaggtgctggcctgtggtgtggtgtggcgctgctggccccgtgtggtcgatgcaagtgcctgggggatgtgctgcgtgcccagccgccctgcggggagagcagcgccgcctgcccatggggccgtggggcgtgctgtgctgcactgcactggctgaagcaacccgccagcctgccgtgccccaccccacccagcacgcactcattcagtgcattgccttaatttaagcctgagggggctgtgttctcacaatataaacgaataaagtgtggtgctggccgtacttntgaatgacttctnaactgtgtggtttggggaagggagggaaacctaaaatcccgtccaaatgagtgaaattnctgagagaagtggcgtgagtgctaccaggttggggtnagggaaatgtgctgggttcaggcgcccctcccagggctgagaaagtgcagccagggacagctttctgtgctctcccagggtggctaggttagtatctgacatgacaaaaaactgagagtgtgctaactnctgtgcaagcnaggttaatcctgagactaaatcttggcgttcagactcccgtagaggtcatctgtgtccaggcccacccgggcgccggctcagcggtagtgccgaagtaggatgagcttctggggagggaactnctcccggcagagggg

SEQ ID NO: 713727 - DNA, 1403 bp, Homo sapiens
gtttgtgctgatatgtatatagtcttttttttggtttgtagtgtaaatgtgtataagagagcgatatgctcgtgtttgttgttaggctatttatgtgtttagtgttcaaatatggagatgttgtctaataaacgttgaaatggtgctgtagagtatattagatagatgaccctgagtaattgtcgcattatatggaatatattatgtctagttttacgttctaaaagattgtttgttatgatcatggagtgtttattaattaaatatggggtgtgcgttgtaagaaggtgttaagatgtgttttgtgttgttgtcgatacgtgatggactatgtgcgtgttcgggtagtcaaatcttgtgtgtgttggacaactcatgtatgtgattgagtgttagggtattacacaactctgggccatatgtggtcccatatttaaaaacgttcgtctgtatgtgcaatgtcttgtttgtttcactatatagccatgtgtgtgtatatttagccattgttgaaggacccaagtagggaatttaagtgttgtatgaagtcctcggatattgtctacactttatttgatcctataccgcctagtaatatggatttgtgtggacttctaatgggtctattgtaagtactgtacacgtatcgttagtatttattggtgtctccaactttgacgggagtcatgcaactagtttgagcccattttatcgtcattgctatatgtctttgttattaatcagccttaattcagttgtagtagcgttgcacccctttcggggttataccctatatgtctagttctgtagttggttgtgcttactcccttatgctcttgatatagtagtaatgtacttgctgctactggttctcaggtcatgtccattaggtattgtcgtctacactcaatagagggatgggaagccgaaaataccattacatttagagattaattattggtacctacactatctttaatcttgctctattacagtgtacttcgtaccccgtgaacctgtcattctaaatagttgcataatagcttaccagtcagtgtatacaattagaatagttgtggaaagacagtcttgtatttcctctgtaggctgtgtatatatatataattatgtacttctggcaattctatctgtatttaaagatgtgacaatcgttgacaccgaattcttacagcaattagtctgtgagaccgaagttacagagactaatccctactcaagtgataaacttgatgtgtgttaagagggtacagaattatcaactgatctatggtcagttgcttcccatgtctggcttgatttccctcagttgtgtaaacacttgacagggtactgtgacaaatgggaaaattatccaggtataagacatgtctttgccgcgcgct

SEQ ID NO: 713728 - DNA, 338 bp, Homo sapiens
gtagagttggatgcagttaaggtttatgtttgcaatagatcgtgtgcaatggcaggtctgtcgggggtcccatggtgtagttagtatattgtgtccatgcaatggtacagacaagctggctgaaacgggaactttagagaacatattagcccaaatatatgatagcaaagtatttgccatttgctgattgtcagggaggcagtaattttagtagtatagaaactggcctgtatatttactcacaacacttctgacactaaatgtatgggtattttcccctataccaactgatatggtatgactgtgttcccacccaaatctcatcttgaattgtaact

SEQ ID NO: 713729 - DNA, 1318 bp, Homo sapiens
tcgccagtcgagccacatcggtgagactaccatggagaaggtgaaggtcggaatccatcgagatttggtcgtattgggcgcctggtcaccagggctgctttctaactctgcgctaaagatggatattgttgcgcatcaagtgaccccatatcagttgtagcctcaaactacatggtatatacagtgttccacaataggtgattccaccgcattggcaaatttgccatggacaccgtcgaggctgatagacgcgtcaacgctctgtcagtcaatggaaagtcccatctaccagtactgtaccagggaggcgagaattccctgcacaaaaatccaagatgggagacgatagctgcgcgctgagtagcgatcgtggcatgctccaacgtgagtcgggtctttgcaacacaaccactgtgcatgaaacgtgcttggcgtgcctcaatttcgcagaggggggaagcctctaagggctacagtgcattcttctggcaccgcactttctgcgtgactggtccacaccatgattgcgtgcatggggtgctggaaactcactgcagagagaggtgatggacagatcatgacctgcacagagtcattcagcagatgtcctccatgcatccaggcaagctggcttagccagcccccttttggtccccaaacgatagtccagattgggattgagacctttgaacccagtgacgcggtgtctagggatcaaaaccgttgcgcgacatttattgagtggaccgagtcaggagggacagaggtcgagtcgaaaccgcaaggagcgatcggaggacggagggctcccccccttctaaaagggcgctctcccatgggagacgcttaatcaacgattgatgccagacccatggcgtgggaggttccttcgcttcgttgaaccgtttgcaagagcaagtcagcacacaaatacgcctaccttcactgttccggaacccgttccggaccgatccttgcggggggccgttggggcggttttgcgccccttcaaaacgaaccccaaccttttattgatcccaaatggaccgtgcccaatttatacccccttgacgttaattgtggaactaacacgcgacaactctttaggcgcttaaaccataggccgaaaccaagtgggcgttggcggtctgggagacccccttcacaattggtgggtcgcccaccagattgtggtctctttccctcacacggcgaaacgttaaagtaggagccccccccatggtgataagccgcacgtcgagggtctcgtccataagcaaaacagtagggcgcacacaatgacagcgcatcgacatga

SEQ ID NO: 713730 - DNA, 573 bp, Homo sapiens
  misc_feature (8)..(8): n is a, c, g, or t
  misc_feature (355)..(355): n is a, c, g, or t
  misc_feature (362)..(362): n is a, c, g, or t
  misc_feature (378)..(378): n is a, c, g, or t
  misc_feature (444)..(444): n is a, c, g, or t
ttcgcttncctcgcaccaattctgacaaccagaatatgctgagtcgagaatttcgataagtcgaactgagaaagcagagacgaagagaaaatctccctgctttccaaagaaacgatggaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttccattctgtctatctatctggctggcaggggagganaagaacntgcatgttggtgaagnaagagtgggggtggaagaagtgggggtgggacgacagtgaaatctagagtaaacccaaagctggcncaagggtgtcctgcaggctgtaatgcagtttaaatcagagtgccattttttttttttgtttcaaaatgattttaaattattggaaatgcacaattttttttaatatgcaaataaaaggtttaaaaactt

SEQ ID NO: 713731 - DNA, 1085 bp, Homo sapiens
  misc_feature (10)..(10): n is a, c, g, or t
  misc_feature (73)..(73): n is a, c, g, or t
  misc_feature (75)..(75): n is a, c, g, or t
  misc_feature (102)..(102): n is a, c, g, or t
  misc_feature (178)..(178): n is a, c, g, or t
  misc_feature (244)..(244): n is a, c, g, or t
  misc_feature (276)..(276): n is a, c, g, or t
  misc_feature (284)..(284): n is a, c, g, or t
  misc_feature (290)..(290): n is a, c, g, or t
  misc_feature (293)..(293): n is a, c, g, or t
  misc_feature (297)..(297): n is a, c, g, or t
  misc_feature (300)..(300): n is a, c, g, or t
  misc_feature (314)..(314): n is a, c, g, or t
  misc_feature (321)..(321): n is a, c, g, or t
  misc_feature (332)..(332): n is a, c, g, or t
  misc_feature (343)..(344): n is a, c, g, or t
  misc_feature (348)..(348): n is a, c, g, or t
  misc_feature (350)..(350): n is a, c, g, or t
  misc_feature (359)..(361): n is a, c, g, or t
  misc_feature (364)..(364): n is a, c, g, or t
  misc_feature (368)..(368): n is a, c, g, or t
  misc_feature (370)..(370): n is a, c, g, or t
  misc_feature (383)..(383): n is a, c, g, or t
  misc_feature (392)..(392): n is a, c, g, or t
  misc_feature (403)..(403): n is a, c, g, or t
  misc_feature (442)..(442): n is a, c, g, or t
  misc_feature (444)..(444): n is a, c, g, or t
  misc_feature (471)..(471): n is a, c, g, or t
  misc_feature (481)..(481): n is a, c, g, or t
  misc_feature (485)..(485): n is a, c, g, or t
  misc_feature (490)..(491): n is a, c, g, or t
  misc_feature (495)..(495): n is a, c, g, or t
  misc_feature (497)..(497): n is a, c, g, or t
  misc_feature (514)..(514): n is a, c, g, or t
  misc_feature (516)..(516): n is a, c, g, or t
  misc_feature (521)..(521): n is a, c, g, or t
  misc_feature (525)..(526): n is a, c, g, or t
  misc_feature (941)..(941): n is a, c, g, or t
  misc_feature (958)..(958): n is a, c, g, or t
  misc_feature (1010)..(1010): n is a, c, g, or t
  misc_feature (1022)..(1023): n is a, c, g, or t
  misc_feature (1063)..(1063): n is a, c, g, or t
agtgccaaanatacactgacattaagcaaattcactgaaaggaagaaactacagaatgcacggattcagaaancnattttaagtgattaacaaataaagtancgaagaactcaaaaacgggctctgtatgctatatcgagtttatcccttcccgaacaaaatttctgttatttgggcnaattcttaaaccatggtttaaaccgtaatggttacaaaccacaaacacatccatccagagactganaccgtttctatccggtcagtggcaaaactgtngagagggnaatagntgnggcngtngggttttatatagngtgaacnctgataaatantcctaccaggnntaananacagcacgnnntgngggngntggctgactcacnaaggttgtnacaaacaaganctactcttcactcgacaccatggctcagaggccaccganangcacgagtgactgacagctcctctgcntacaaacgantganacccnnagtngntgtcgttctcacagcantnaaagntctnnaggactcacactgatccaatactaactttcttccctattttacacatatttttctactgtccagtggaaatcattttctgttttggctaaacaacaaatactagtttataacaggaatggtaaaatctgtgagaattctgctcaatttaatacaagatcactactttctttagaatggtttctgcgtgtttctacgtcaccctctgtatttttagcttccagtttcctggtaaggaataagttctccttcccagtcacactcggggtcatttacacgtttctgggatgcccttgctcgtccatggaggccaggtgcgtgcagtgactcactctgcctcttccctcttctcaggaccagtccccgaaccttctgccttgcagatcctcctgtttccgccacactctcgcgctcggnagcgagctcctggatanacagctgcaaggctggccggtccttgtttgccagtcgctcttttctgggtgngggactgtcgtnnactctgcgctcttccagtctctcatggctccccggggccngtgtctggttcccttttcctct

SEQ ID NO: 713732 - DNA, 425 bp, Homo sapiens
  misc_feature (375)..(375): n is a, c, g, or t
  misc_feature (416)..(416): n is a, c, g, or t
gtttattgtgcgtgtctgctctttgagtctataaagggattaacagctgaatatagactttaaatcactgttgggatttaaatttttactctgaaagactaggtcatttgacagtaatcaagggtattttcattctcaagactgttttgcaggcccagcagaaaacccctctatttaacccatgaggggagtcatcctcagggctgaggcatatgaaatctggggtacttcacacagaaaaataataaaaatgtagggggatttgccttgtgggttgaatccggggaagttctaaattgggcaataaggcagataggggaacaattttgttcaggatactgtgggatttaatgggtattttaaaagggcaccctngtttatttatttttttggatggcaccaattaatttttaccntcttgccag

SEQ ID NO: 713733 - DNA, 1112 bp, Homo sapiens
  misc_feature (274)..(274): n is a, c, g, or t
  misc_feature (298)..(298): n is a, c, g, or t
  misc_feature (307)..(307): n is a, c, g, or t
  misc_feature (404)..(404): n is a, c, g, or t
  misc_feature (491)..(491): n is a, c, g, or t
  misc_feature (579)..(579): n is a, c, g, or t
  misc_feature (633)..(633): n is a, c, g, or t
cgtcgtcctgccatcgctttataatcatattttctagtgatcaccctgtactcagatagcagtgaatactatcgacgtcagtgcagcagtactcatttgtgccactcaggctaatagtctcttgcaattgcactcatagtggatagctctatcgatacaattgcatttatactatctcacatagcatatatgtcagccgagtgcatgctacaattgcactacatcagctatcttgcgctacgccagtgtcagctacactcactagcactctatntaccttcatccttgctgtgtcaancactcgtgncgtctgtacgatatgtcactgttcttcgttgtaatcttacactctccactgtctagccactagatatcaaccaacgaagtgtctggattatagctanaggaacagtctagcggatcagcagcgttacatgacgtatattagtgagctactcacatctagtcatagttctaactctaggctagcnacagctcaagatgctgtacacagtaccgatgcttaataccgaacatgactctcatgtgcgacatctaggacgcatatacatggtctcntgtctgcactatataatgtgaacctcatgacacgcataccacaacccatgcacnacatcagcaggtacaacgcgctacatcgctcagtctgtagactcactatatcatacaatgaacaaccctatcagagatctaatctagtacgacgtatccgacgatgtgactgcacaccgcgtgtgtgagctctatcggaagtacgatcacagttgcattaagtgaacttatcacacataagttcaacgatcaccagactcgtactctcgtacactacacgcacacagtgattactgcacacatgatcatacgcactcgtccgtgtgtaccatcacgactgacagagtagtaatgtgatcttcagagcattgcacagcaatgtgactccattatcgctgctacacagaagtttcatgatcgacaactagaggatagtatcatcgcatgtacagactggggcggcaacttcagtcgactgccgatacattgtgtatccatattggacatcacaccgtgacatgctaccacgtgcgcagtac

SEQ ID NO: 713734 - DNA, 759 bp, Homo sapiens
  misc_feature (19)..(19): n is a, c, g, or t
  misc_feature (23)..(23): n is a, c, g, or t
  misc_feature (109)..(109): n is a, c, g, or t
  misc_feature (519)..(520): n is a, c, g, or t
gaggacccgcagcagagangacncctgcagcaaggagaccaggaaggggtgagacaaggaagaggatgtctgagctggagaaggccatggtggccctcatcgacgttcnccaccaactattctggcaagggattgggagactcatgcacaagctgaagaaatccgacactgcatggagcatcgatcaacaatgagcgtctcccatttcttagaggacaactcaaagagccaggaggctgtgtggacaaaagtcattggaatgcatcgtggacaatgatggagacggcagaatgtgaccttccaggaattcaatgtgcctttgttgccactggtgtactacttgcgctgcctacagagtactctctgaacatgacgtgagattagcaaagcagtcaaaccttatcctggtcaacagacgacaggtcatgcgagaaagcagacagcaagggcttgcagctataggagctgagctttccagcggtgtagctataggaagcttgattgctttgtgatgaaaanntgaaaactctttccaaaggcgttaacggctgcatcatcttctgtatataggctggtgtaagtgatgccccaggactctgttaacagtaaccttaggagtcaggtctcagtgataaagcgtgcaccgtgcagccgcatggcgtgtaaaacccttaaaaccggagggaaaccctgataccagaaatttaccccgggggcacctttaaaattttcataactttaaaaaacaaagcttatcag

SEQ ID NO: 713735 - DNA, 906 bp, Homo sapiens
gccagaacacaggtgtcgtgaacactacccctaatagccaaaaatgggaaaggaagaagactcatatcaacattgtcgtcattggacacgtagattcgggcaagtccaccactactgggccatctgatctataaatgcggtggcgtcgacaaaagaatccattgaataatttgagaaggaggcagctagagatgggaaaaggctccgttcaatgtatgcctggtgtcttggataagactgaataggctgagcgtgaagcgtggaatcaccacttgatatctccttgtggagaatatgagaccagcatagtactatgtgactatcattgatgccccagtgacacagagactttgatcaaacaaacatgattacagggacatctcaggctgactgtgctgtcctgattgttgctgctggtgtgtggtgaattcgaagctggtatctccaagaatgggcagacccgagagtcatgcccttctggcttacacatcctgggtgtgacaacaactaattgtcggtgttaacaacaatggattccactgagtccaccctacagccagaagagatatgaggaaatcgttaaggaagtcaagcacttacattaagaaaaattggaacaatcccgacacagtagcatttgttgccaagtttctgttggacatggtgacaacatggctgggagccagtgctaacatgctgggttcaagggacggaaagtcaccccgtaggagtggcatggcagtggaaccacgcgttgaaagtcggactgatccaacacaactggcaagtgaaagccttggctgctctcgaaggcacaaatggggacggacctcctggcatcgactgttcaccggtggggcctggcccaacaaagtaattaggccaaaggaccgaaggaaaattaag

SEQ ID NO: 713736 - DNA, 661 bp, Homo sapiens
  misc_feature (19)..(19): n is a, c, g, or t
  misc_feature (23)..(23): n is a, c, g, or t
  misc_feature (109)..(109): n is a, c, g, or t
  misc_feature (421)..(422): n is a, c, g, or t
gaggacccgcagcagagangacncctgcagcaaggagaccaggaaggggtgagacaaggaagaggatgtctgagctggagaaggccatggtggccctcatcgacgttcnccatatctggaggaggagacagccaagctgaagaatcgaatcagagctcatcacatgagcttcccatgcttaaggaatcaagagcagaggtgtggacaagtcatgaaacctgacatgatggaacgggaatgtgattcaggaatcatggctgttgcatggttctactgctgcacgagtcttgaactgagtgaataaagcgcaaactcctgtacagaacggcatgcaaaagcagacagcaagggcttgcagctataggagctgagctttccagcggtgtagctataggaagcttgattgctttgtgatgaaaanntgaaaactctttccaaaggcgttaacggctgcatcatcttctgtatataggctggtgtaagtgatgccccaggactctgttaacagtaaccttaggagtcaggtctcagtgataaagcgtgcaccgtgcagccgcatggcgtgtaaaacccttaaaaccggagggaaaccctgataccagaaatttaccccgggggcacctttaaaattttcataactttaaaaaacaaagcttatcag

SEQ ID NO: 713737 - DNA, 206 bp, Homo sapiens
ttcagctgacagtcctcagttctctttgccaggctgagctggggctgggctctttgtgggttgagttttcatcggcagatccaatgctgacgaactcacttgacacatgcggctcattgagtccattatatgtttattaagcaccatactatgtgacttgcactgtctattaagccatgtccttaatttcttcattctagaagagg

SEQ ID NO: 713738 - DNA, 291 bp, Homo sapiens
agcggagcacctctgcgacgcccgctcttctgctgctgtttgtctacttcctcctgcttccccgccgccgtcgccgcaatcatgagggaaatcgtgcacttgctggccgggcagagcggaaaccaaagtcggcagccaaggtcttcgggaggtgatcagcgatgagcacggcatcgaccccacgggcacctaccacggggacgagcagacctgcagcatggtaacgcactcagcgtgtactacaactgaggccaccggcgggcaacggtacgtgccccgcgccgtgctcgt

SEQ ID NO: 713739 - DNA, 84 bp, Homo sapiens
gaccaatatgaaatgatctgctgcagaagtctgagccctaggattcatctttctttccaccgtaggccctgactggcattgtat

SEQ ID NO: 713740 - DNA, 1150 bp, Homo sapiens
tcgaccacgccgtacgtgaacgtactgtctatagcaacgtacacaagcatgaaccccattgtagctgtatatagagagaggtgtgatactctcacctgctcgagtactgccagctcaatgcccacaaggaccaccagtaccagttcttagaggatgcagtgcaggacaccagcgtcaagctcctggcctcactggatgaagcgccttggggtacaaactatgcaacattgcagaagagcaccaaggaggttcgcagctcaatccgccaggtgtctagacgtacagaaagcgtgtagcaagtggatgtcaagatggccatcctgcagatcatgacggagctgaataagacggggccagtgtgcctggctcacctgactgcccacgacaggctgctacttgatgtgggctagccaggcagcgtcctgtgcagcggctagcacctggtaccatgaccatagattcccatgaatgcaccatggagcacacttcctgtcgcctagcccctctctgcgcgccctcctcgcgacgacgctgccccacccacaccccccccgccccctctctccgccttctcccttacgccaccctccgcactctaccttccctaccccttgcccccgcgcgctctcccttcaccgctactgccactcgcgtgcggcactccccgctggccgccccacccctgcacccccaccctgccccgcatccaccagctggcgcacccctccccctcgcacctgcacccccaccgcacgtgccccgccccgcccctctcgccttcccacgacacccgcgccccccgaccgccgcctccccctgcccccactacacctccacccagcgccccctgtcaccccccctggcccccctgtccccacccctccccccaacgggtccccctgctcccagcgacacgagcctcccctcggccacaacaccaatagcaaacaaccaagatcgcataaggcataaccatcaagcaaaagccgccaccaataagaacacatccgcaaactcaagcaaaaacaagaaacaccccataccatcaccacaatacaagcacgaaccccaccccgcagaaccacaggacaccgacacaccgacgcgaaaacaccgacacacagcgaacaaccgagcccagccacgaacc

SEQ ID NO: 713741 - DNA, 314 bp, Homo sapiens
agagacaggacagtgataagccacaggcttgtcacagaccacatacacacacacgcacacacacgcgcacacacacacacacacacacaaagagtgcaatcgagagccttgaggcccaggacgctaaaagatagggatgtaattctcgataatggcgcggtggcgctgggcgatacattcagccgatccacacaatgtcagcgacactcctgctccttgagctacacgaaggcatagaagacaccaaagtggaactggtacaggaaggccaacttgttccagctttaacctacgtagctcagtcgaacggactg

SEQ ID NO: 713742 - DNA, 915 bp, Homo sapiens
gcgccccgaacctcctcctgctactctcgtggggccctggccctgacccagacctgggcgggctcccactccatgagtgtatttcttcacatcctgtgtccctggcccggccgtgtgggagccccgcttcatcgccgtgggcctaacgttggacgaccacggcagttacgttgcgggttcggacaagctgactgcctgctgaaggccagaaggattggagcctgctgggcgcctgtggatagcagcagcgaggggcctggaggtattgggggaccaggggagaccaccggaattgtgaaggggcccaggtcacgagactatgaccgagtttggaaccttggggaacccttgcagcggcattaactaacaaacgcaagacgcgtgagggccggggttatctcacaaccattccaatgaatacattgttattgcgcttgcacgaacgtgtagtcggctccgggacgggggccgcctctcccattacccggcgcgtgagacataccgccggtgacatgtgaaccagccctattaacagtaactgtgcttacaggcggcatttacgcatttcgggccccccttggtagaactgtagtcggaccctttgcggggccttcatttttgaggcaccccgtggcggcgcgaggtgcaacaacagtttggcgacggtcagcatccaagaggacgtcaaacccagaaagaggcggcgccaaactgcgttggcgcgactagcggcgtacgggcccccaaatatgaatagggcgggagacgagcaagagatagtagcggaggcaagcgcccaataaaccgctgggggaatttcggccaccgcgattgcgactgcatagaaagagatcgggcacatccgggccaggaaatatacccctttggagaggcaacctgggcggaaacggtcgg

SEQ ID NO: 713743 - DNA, 325 bp, Homo sapiens
atcggaactctttacgtacagtcagaatgtcaatgggagactactgcttatctgggtcttatgaaccagaaaaatacagctgggtctttacgaatactttctgctagggtttactacggggtttatagattttactatatgaccgtctcatgtgctccttttcaaggctctgccaaagtgagtgaacaggaacactgtacctttatagtggctggagagctccacgaaacttctactagagatgggtccaaaacagctcactgccctggaacaggagatgtgtagatctaaacccacctttcatctggagactcacaggcctacg

SEQ ID NO: 713744 - DNA, 1237 bp, Homo sapiens
  misc_feature (593)..(593): n is a, c, g, or t
  misc_feature (616)..(616): n is a, c, g, or t
  misc_feature (657)..(657): n is a, c, g, or t
  misc_feature (661)..(662): n is a, c, g, or t
  misc_feature (725)..(725): n is a, c, g, or t
  misc_feature (895)..(895): n is a, c, g, or t
  misc_feature (943)..(943): n is a, c, g, or t
  misc_feature (1034)..(1034): n is a, c, g, or t
ttaccatctcacttctagcaatttctattctatcgttcacagcatcatatcctccctactatgccaagaaggaatcctactatcgattgatcatccatgatgcaacactacataaaccctacaactagccagtccctcttagaccatgtatagagcctacttgcacatcacctaagtactcatgtcgactgctaacctcctgcaggcctagcccgactagtgtgtatctccagcacattttgtgccctagacgtgacgattcatgactctaaacaactgagcatccaaatgctaaacactaaatacgtcccaacacttataatgcaccaagccacggtaccatgtactgctccgataggataaaacctcatatattttgatagtttcgagtcagcagagatatctgaatacagtgggtctggggcgggttctgagaatctccatactgaaaagcacttccaaggtgatgccaatgctgctagtccatgctggtccttggattcccacttgattggaaaaccctggcgatccatagatctggacattcattccctgcagtacagcaaacctggctgggtaggattcagcaacantcctgagcaatggaggaatattnggaattccaaactgggtgtaaagttcatattgattttattnattnnatttttacctcccaaggctatagacattcctaagaaacacgcagtcagcttttggtgagagtngaatcaagctatggaattctcatttggatctgcttccagtttctgaacagtgaagcgcgagaattctgaacagtaaagcaggagctctgtattcagcgagactctggggcctggaaagtgggattacagcatccattttgtctaattgctttccttctttcttttatgtngctgctaaagccccatgaccttcactatttaactgcttcatcagagtnaaagaattgccttgatgttcataaggattacttgtttcacactgacctttaaaaagttgtcactcactagatttttcagtgcatggttgangtcactggacagtgttctttaatcagttttggtggcatttgttgcctatttgaggtggagactttcttttaattgctttaatcaattaatgcattgctttgataggattctgcatggggtggaatattattggcctttgttcagataagcttgtgccagggaatcctccatcagtatattcattaaactgctcatgggctctc

SEQ ID NO: 713745 - DNA, 1271 bp, Homo sapiens
  misc_feature (593)..(593): n is a, c, g, or t
  misc_feature (616)..(616): n is a, c, g, or t
  misc_feature (691)..(691): n is a, c, g, or t
  misc_feature (695)..(696): n is a, c, g, or t
  misc_feature (759)..(759): n is a, c, g, or t
  misc_feature (929)..(929): n is a, c, g, or t
  misc_feature (977)..(977): n is a, c, g, or t
  misc_feature (1068)..(1068): n is a, c, g, or t
ttaccatctcacttctagcaatttctattctatcgttcacagcatcatatcctccctactatgccaagaaggaatcctactatcgattgatcatccatgatgcaacactacataaaccctacaactagccagtccctcttagaccatgtatagagcctacttgcacatcacctaagtactcatgtcgactgctaacctcctgcaggcctagcccgactagtgtgtatctccagcacattttgtgccctagacgtgacgattcatgactctaaacaactgagcatccaaatgctaaacactaaatacgtcccaacacttataatgcaccaagccacggtaccatgtactgctccgataggataaaacctcatatattttgatagtttcgagtcagcagagatatctgaatacagtgggtctggggcgggttctgagaatctccatactgaaaagcacttccaaggtgatgccaatgctgctagtccatgctggtccttggattcccacttgattggaaaaccctggcgatccatagatctggacattcattccctgcagtacagcaaacctggctgggtaggattcagcaacantcctgagcaatggaggaatattnggaattccaaactgggtgtaaagttcataaaatcaatggatgatgctatgaactttacacccattgattttattnattnnatttttacctcccaaggctatagacattcctaagaaacacgcagtcagcttttggtgagagtngaatcaagctatggaattctcatttggatctgcttccagtttctgaacagtgaagcgcgagaattctgaacagtaaagcaggagctctgtattcagcgagactctggggcctggaaagtgggattacagcatccattttgtctaattgctttccttctttcttttatgtngctgctaaagccccatgaccttcactatttaactgcttcatcagagtnaaagaattgccttgatgttcataaggattacttgtttcacactgacctttaaaaagttgtcactcactagatttttcagtgcatggttgangtcactggacagtgttctttaatcagttttggtggcatttgttgcctatttgaggtggagactttcttttaattgctttaatcaattaatgcattgctttgataggattctgcatggggtggaatattattggcctttgttcagataagcttgtgccagggaatcctccatcagtatattcattaaactgctcatgggctctc

SEQ ID NO: 713746 - DNA, 293 bp, Homo sapiens
ctttggccccccccccccccccccgggggggggggattccccccggggggtggggggccccatgggggggggggttgcttttttcccccaaaagggggtttcccctgggggcccttagggggggggggaaaaccaaggggggggggggggggaccccctggggggggggggggggggttaaaattttgggtttgggggttggggggggggggggggggcggggttgggcccccccagggggtaaggggggggggcccctttttttttggggcccaaaaaaaggttttccccca

SEQ ID NO: 713747 - DNA, 159 bp, Homo sapiens
ggcccgagtaactctgtctggatagaggtaagccactgtatgcctctggaaaaaataataatgccactgtaacagttaaggtcttggtcaaaatttatttgtgaacatataagcagtatgatagaccacagacattaactgatttctaaatacattttt

SEQ ID NO: 713748 - DNA, 477 bp, Homo sapiens
ctagccaacatgtggccaacatggcgaaacctggtctctactaaaaatacaaaaagccaggtgtgttggtgctcacctgtagtcccagctactcaggaggttgaggcacgagaatcacttgaaaccaggaggctgaggttgcagtgagctgagatcatgccaccgcactcaagcctgggtgacagagctagactgtctcaaaaaacaaacagacaaacaaaaactataggctggacacggtggctcatgcctgtaatcccaacgggcagattgcttgagctcgggagtttgagaccagcctgggcaacatggcaaaacctcttctctactgaagatataaaaaattagccaggcaggattgtgtgtgtctgtggtcccagctaccagggaggctgagataggacgattacttgagcccgggaggcggaggttgcagtgagctgagatcttaccactgcattccagcaagactcagtc

SEQ ID NO: 713749 - DNA, 441 bp, Homo sapiens
  misc_feature (275)..(275): n is a, c, g, or t
aaaaaaaacaaaaaacaaaaaacaagaaaaagaatgcatggagtaagttccattctcatcgccccctggaactaatgagcaaaagacaatacctatgtgaccgacaagtctctttaggggccccccaatatagactgagctgttaataacatttaatgagctcacatggattcgctggcaaaaaaagaagaaaagagttgaggacattgctgccctgtccatgaccaaaaattaccgtaaactgaaagttgctttgtgttccttcacacccatcngctggaaattttaacaagatcttaaattttgtaagtccaattgatagaaacagcaattgtgttcttaaaactgtaagaaaaaaaaatggtgaacaacacagaaatggactcaatctttcccaaaacccaattctgtcacagttagttttcaaaactgtaggttctt

SEQ ID NO: 713750 - DNA, 299 bp, Homo sapiens
  misc_feature (40)..(40): n is a, c, g, or t
  misc_feature (115)..(115): n is a, c, g, or t
  misc_feature (140)..(140): n is a, c, g, or t
  misc_feature (143)..(143): n is a, c, g, or t
  misc_feature (206)..(206): n is a, c, g, or t
  misc_feature (248)..(248): n is a, c, g, or t
  misc_feature (267)..(267): n is a, c, g, or t
  misc_feature (289)..(289): n is a, c, g, or t
tgggatctgtgaatcacattgtaattcctgttgacaaagntttacttgttaacatcagttgatactgacattctccataaagatatagtagtaatgtgtctcattaaacctagtntatcagtgttttagcagatttactntgnaacttttgagacagagtctcactgtcacccaggcttgagtgcagcggtgtgattcatcattcnattcatacttcattcagaggtcctaagtttataacctactgngcctttctgtcccggggantattcgcatgcaccacttacangggccagtaa

SEQ ID NO: 713751 - DNA, 223 bp, Homo sapiens
gggggctttttttttcccccgggccctccccccccccttttttccccttagggggggggggggggggggttttccccttttttttttggccccccccttcccccccccccaggggttttggggggggtaattttttttttttttttaaaagggttttttttttttgggggttgggggcccgggcgggggcccttttttttttttttttttttccggcccttta

SEQ ID NO: 713752 - DNA, 649 bp, Homo sapiens
gcccaagatccagggctgtttagctccgccaactctcccttcctccctgtgcttcagccacgtccctgacgctgagcactgtgcttcctgagtcatcacagacagaagcttgtacagctctggaaccagcttgctcattgcaggagtgtttgaacttcaaccttgagtggtggcctgacagttgccctcccaagcaccagcagcactgcacttggcacctttccgcggcgttggcagcactcagcaggccagggagcctgccaggggcactgcatttccctgcttgggtcttgggacacacaacttgcaggcccagcccaccctcacaggcgtgcgcaggggttgggcgtgcaccatcagataggttttccccccaagggcactgcctccattttgccagtttccgttggtcgcctggtcgttgggcctgcttgcccctttgtgcgtgcacccaccagtcacccccctatctccagattccattaggccaagcacattggacacaccccacccctgggccccttctcacgagctgtagcccccaaacacctcacccatctgtcgcccgtcgtcccccaacgcccctcttggcggcaacttcggctagcacatggatttcggttcacagccccaatatgcattaacccca

SEQ ID NO: 713753 - DNA, 211 bp, Homo sapiens
agcaccatttgtccctcggtgcccactaacaggccataaccgatcagcggaatattccatcgcgttaccgaaagtgggtttcgctttcgaaatgtgtttgcgttcccgacgaaaggcatacatcaccatggtaccatgatgttggcgggctacgatggatcagcaaaaacaggtagccacggcatatggctcatcagacctggagatctcc

SEQ ID NO: 713754 - DNA, 125 bp, Homo sapiens
tattcgggctgctaaagcgattgactttgaagtgtctgatgatgggtcgccgatggatgcatgtctgaatcaggtggagaagcacttcaacgctggacgatgtaaagattatagtagtaattata

SEQ ID NO: 713755 - DNA, 762 bp, Homo sapiens
attctagaggccgaaggtggacgtattgtgtgtggatgtttagaaatccagtaggggagcagggaggctgggtgtggtggctcacaccttgttgagtctcaacacatattgggaggctgaggcgagacggatcacttgaggtcaggagttcaagacgaaacgcctggacaactagtaatgaaaccccatcgtctactaaaaatagaaaaattagccaggcgtggtggcacacaccgtgtaatcccagcgtactcgggaggcctcagacaagagaatcacttcaagcctgagaggtggaggtagtacgtgagctggaggatcgcacacacgtgtcactccagacctgggtgatggaaatgggactacttaccaacagaaaagcgcaacacagaaaacaaatcttacaaaaacattttttgggccagggggggggcaccaccgaaaggagaagtgtctcagaacgcatagcgaaagggagcgaccgggcggcccccgggataggggcacagtgccaaaagtggtggacaacagaagctgggttgtggctgaagagaagaaactctgcgggtatcagtgagaaaacaagtgggcggtgagattattctgagaacgatgtgaatcaaagacgccgccgggaggtgaaagaagcagtggtgttttcgagaggaagaaccgaggagagagagtatatggggtgggcaaaacggggaaatttgttaaccaggggggatatgaggaagatatcgtagtaggaccttagag

SEQ ID NO: 713756 - DNA, 667 bp, Homo sapiens
ttgagactagcctggccaatatggtgaaaccctgtctctactaaaaatacaaaaattagctgggcgtggtggcaggcgcctgtaatgccagctgctcgggaggctgaggcaggagaatcgcttgaacctggaaggcggaggttccagtaagccaagatcgtgccactgcactccagcctgggtgacaagagtgaaaccctgtctcaaaaaaaaaaaaaaaaaaaaaaaaggggaaaaaaaaatcccggggggagaggggaagggtttttttaaaaacgccgctttttaaaaaggcatccccttgggggggcgttccgggccaggcgcctcattgaaacgaaggtagataactttaacacccgtggaatttatagggcgggaggagcctatcctttggaaaggaagcacaacacacaccgtggccacagcacgcgcggggacatccacggaacccaacgggagaggaatctctccgaaaaagcatttttcaaagaatatagttaagaattccccaattattccggcacccacatttttcttctactgggaacacaacccaagtttggtctagggcatctactttgggggaacaggaaaaggttcaggaataaatttccataatgtgacatccatggaaccggtcatggacggcaggccggttgggacc

SEQ ID NO: 713757 - DNA, 308 bp, Homo sapiens
aaggtgtgtggagcccattcattggctgataatacttctgagcggctaccacattgacagacacaaggctcagatgaagaggtgaatggaacacgttcctgacctcaaagagccggcggcttttggacatttaccagaaaattatagtaccataagtaataagggattacaggcgtgagccacggcgcccagccttatggtgttttacataatgtatgggtccacggtagatgggtttatatttttaaagaacaggggcaccggggggagaccttatctcttaacaaacaaaaggagtagagatacgg

SEQ ID NO: 713758 - DNA, 615 bp, Homo sapiens
tgcctgacacggtggtccacatgaccagtttctcggtcttctggaagttgctctccccaggagatcctctgactcactcctctctctaaatcgaattcggtcagatcgttgccagccgctcaacagctccacgcacgaagctcgacctggcatcctcgtgagaggtagctcggggcatgattgtttatgcatcctcctcctgtcatgtgttgtatccatccgtgcctggtggactgtctcctgacactcgtggtgatcccggctgtgtcctcaggggctgcacgccagaggttcgtgtcgatcgccagcagtccgagtgggggtcgccctcagtatcttgcttgtgctgcccattggtccagtggcgtctcccccctgtcgtcctgtgctctccctctgtgactgtgtgggtctcctcctgaccctgtgtggagtcccaacaggtctcagtggcttgcccgcacttgggtctgctcgtctcatcttatgtgctaggtggatcctccgctgtatcctgtgcgtaccccctttgggtgccagcggatgtcggactcgtctcaggcaatgggttgtgagtgcgattcttggtttttcctctccttgctagttttgctc

SEQ ID NO: 713759 - DNA, 805 bp, Homo sapiens
cagagcattggcagctcctgggtcacagtgtcaccccacagggctcccagagatccctatggccagtgagctggtgttcacctgggtagcctggagtgtgtggcagtgtgggccttgtggtaacagctgcccagctgtctggatacctgtgccatgcacccccatggcctgggccacccactctgcatgacctcatccgccaactgggagatgaagtgtgtgtggatgatgacctctgcactgggagaaaaccatgtccctggctgtgtaacaatgaatgtgtaaagatgcatgttgcctggaaatgtgcatcccgtacttgccctgctgcgccactgatgctggcccctgtatgtgtgggtgcccatgtgtgccagaagaacatgccctggcacctatcagtgagctgtccagagtgcccctgtgagacccagcagttggatggagaccgatttggccagggacccttgcaatccagttcaatttcccctcattgcactgaggatagtaaatgtagttcagcacgtcatgtggcccagagtggtatgctcaatggccataacatacctcttgtatcagaaccttgggagcaagtggcgcctaacttttggccaaaagtgccgcaaaagtggggacacacgaatagcgaggtagcattattagcattaggcgtacgatttgcgaacccatatagaacacatcacagagtatagggaataggtccatatcgttggatagcccgtcgggctagataggaaatcactatcgttcgacagaggtctagagcgatccgcactatggtggc

SEQ ID NO: 713760 - DNA, 961 bp, Homo sapiens
  misc_feature (186)..(186): n is a, c, g, or t
  misc_feature (197)..(197): n is a, c, g, or t
gtgggatgggtggggggtaacgggggaaactggggaagtggggaaccgaggggcaaccaggggaagatggggtgctggaggagagcttgtgggagccaaggagcaccttggacatctggagtctggcaggagtgatgacgggtggaggggctagctcgaggcagggctgtggggcctttgaatccnggacacaaaanccctctagcttggaaatgaatatgctgcactttacaaccagctgcactacctgactcaggaatcggctctggaagggtgaagctagaaggaaccagaccgttcatcagcccaacatcaaaagacgaccatcggaagcagacaagacgcacacggcaacgacgaaacacacaaaacacaacaggacaaccggggccggaaacgtccccaagttcgtttaccaattgggaccaacacgcacccaccgatgacaggagacagggaaaccgaggaattatgggaacacccagaaacaccgcaaagtcgaacaccaaaaacacacaaaaaaaaatacaaagattccgccgacacaagaaaacgcaaccggttgcaagagacgaacgattcacaccagatcacccaaaatgacaggaggacggcaaatttgaccgacggcagcgaggacaaacaacgccaaaaccacaaaagaccaaacacaacccccattcccagtaacagtaaatccacttaaaaaaagtacacacaaattaaacacaaaataaaacaattagcaatacccatcacaaatttatcagagcaacaatcaaatacaactctgcaaaaacgcacacaaataaaaattaacaccaaattggaaaatacaccactatattacaccaccaacaacataataacaacataaattcacattcataacaaaaagcccaaaaaggaaaaaaattttaaccaaaaaaataaaaccactatacaaacaccaatttcaaca

SEQ ID NO: 713761 - DNA, 463 bp, Homo sapiens
  misc_feature (92)..(92): n is a, c, g, or t
  misc_feature (94)..(94): n is a, c, g, or t
  misc_feature (104)..(104): n is a, c, g, or t
  misc_feature (108)..(109): n is a, c, g, or t
  misc_feature (117)..(118): n is a, c, g, or t
  misc_feature (128)..(128): n is a, c, g, or t
  misc_feature (130)..(130): n is a, c, g, or t
  misc_feature (132)..(132): n is a, c, g, or t
  misc_feature (135)..(135): n is a, c, g, or t
  misc_feature (153)..(153): n is a, c, g, or t
  misc_feature (156)..(157): n is a, c, g, or t
  misc_feature (164)..(164): n is a, c, g, or t
  misc_feature (171)..(171): n is a, c, g, or t
  misc_feature (176)..(176): n is a, c, g, or t
  misc_feature (194)..(194): n is a, c, g, or t
  misc_feature (196)..(196): n is a, c, g, or t
  misc_feature (199)..(199): n is a, c, g, or t
  misc_feature (202)..(204): n is a, c, g, or t
  misc_feature (206)..(206): n is a, c, g, or t
  misc_feature (246)..(246): n is a, c, g, or t
  misc_feature (265)..(265): n is a, c, g, or t
  misc_feature (281)..(281): n is a, c, g, or t
  misc_feature (298)..(298): n is a, c, g, or t
  misc_feature (313)..(313): n is a, c, g, or t
  misc_feature (320)..(320): n is a, c, g, or t
  misc_feature (346)..(346): n is a, c, g, or t
  misc_feature (363)..(363): n is a, c, g, or t
  misc_feature (394)..(394): n is a, c, g, or t
cagaaggcagacctcaatacaaaatgggcagccccccggttggccaagaagatttaagccaaagaaaggaaagcccaaatgacagattttgntngtttttaagntatnnaggccaannaaattagggncngnatnatccagaatgaagttaanagnntccaaangcagctntcctnaaagctttccccaaaaancnccnggnnntnaggggctgctgctgctggctgctgctgctgctgctgctgntaaagttccagcaaaaaanatcccccccgggagtnaaaagggtccagcccanaaggttcctgcccanaaaaccncaggccagaaaacagggcctgctccnaaagctcagaagggtcnaaaagctccagcccagaaagcccctgctccnaaggcatttggcaagaaagcataagtggccatcataaaaagtaataaaggttttttttggcctgtttga

SEQ ID NO: 713762 - DNA, 2522 bp, Homo sapiens
  misc_feature (1563)..(1565): n is a, c, g, or t
  misc_feature (1569)..(1569): n is a, c, g, or t
  misc_feature (1571)..(1572): n is a, c, g, or t
  misc_feature (1583)..(1583): n is a, c, g, or t
  misc_feature (1591)..(1591): n is a, c, g, or t
  misc_feature (1604)..(1605): n is a, c, g, or t
  misc_feature (1624)..(1624): n is a, c, g, or t
  misc_feature (1635)..(1635): n is a, c, g, or t
gtgggatgggtggggggtaacgggggaaactggggaagtggggaaccgaggggcaaccaggggaagatggggtgctggaggagagcttgtgggagccaaggagcaccttggacatctggagtctggcaggagtgatgacgggtggaggggctagctcgaggcagggctggtggggcctgaggccagtgaggagtgtggagtaggcgcccaggcatcgtgcagacagggcgacatcagctggggacgatgggcctgagctagggctggaaagaagggggagccaggcattcatcccggtcacttttggttacaggacgtggcagctggttggacgaggggagctggtgggcagggtttgatcccagggcctgggcaacggaggtgtagctggcagcagcgggcaggtgaggaccccatctgccgggcaggtgagtcccttccctccccaggcctcgcttccccagccttctgaaagaaggaggtttaggggatcgagggctggcggggagaagcagacaccctcccagcagaggggcaggatgggggcaggagagttagcaaaggtgacatcttctcggggggagccgagactgcgcaaggctgggggggttatgggcccgttccaggcagaaagagcaagagggcagggagggagcacaggggtggccagcgtagggtccagcacgtggggtggtaccccaggcctgggtcagacagggacatggcaggggacacaggacagaggggtccccagctgccacctcacccaccgcaattcatttagtagcaggcacaggggcagctccggcacggctttctcaggcctatgccggagcctcgagggctggagagcgggaagacaggcagtgctcggggagttgcagcaggacgtcaccaggagggcgaagcggccacgggaggggggccccgggacattgcgcagcaaggaggctgcagggtgctcggcctgcgggcgccggtcccacgaggcactgcgggcccagggtctggtgcggagagggcccacatgtggacttggtgactgctgtatgccctcaccgctcagcccctggggctggctttggcagacagtacatgcatccaggggagtcaagggcatggggcgagaccagactaggcgaggcgggcggggcggagtgaatgagctctcaggagggaggatggtgcaggcaggggtgaggagcgcagcgggcggcgagcgggaggcactggcctccagagcccgtggccaaggcgggcctcgcggggcggcgacggagccgggatcggtgcctcagcgttcggggctggagacgaggccaggtctccagctggggtggacgtgcccaccagttgccgaagggccaagacgccaggtccggtggacggtgacaagcaggacatgacatggtccggtgtgacggcgaggaccagaggaggcgcgtccgggccttccctgaacaccttaggctggtggggctgcgggcaaagaaagcgggtctgtttctttaacttcctccacgggagtcggcaccacatatggctgccctctgggctcccagnnncccncnnacatgaaaganaatggtgntacccagctcaanncctggggcctttgaatccnggacacaaaanccctctagcttggaaatgaatatgctgcactttacaaccagctgcactacctgactcaggaatcggctctggaagggtgaagctagaaggaaccagactctatcaggccgatactatcaaagtagaccgatgcgggaactgcagcgcccgtaggaacccctacctcctgcagccggcggattccatctttcaccggccaagccgctgcgtgcggacgggttgaccaagcagccagctacatcatccgagtagctgagcatccgtccagggggtatgacggcctgtccccagcaagtcgcctcttctgcttgtgcatccttcatgtctacttggtaccttgaagcctgttcctggtcataggcgcttatgtgctgagcagaattcaaaaggcctccagaggagtcctgttaagcgccggtacccttcgtggacttgcacttttgccactagagttcagttgccgcatgggaaggcagatgtggacgcagggctttagaccccgagcggccaagtgtgccgtttaagtgtgtagcacgcacccattgaggaacgctgcccttgccgcagtgcccctgagcgggccccacaaattggggacggagggggacaaggggggcccggcggatgggtgtgccccaatgagctgcacaccagtcccatcacaagaatgggagaccccggggcgaccacacagggagagccccgccaacgaacaacatagcgcccgactttgttggtggtgccccccccaggggactcaagagccgggggaacacaatacaaacgcggcgccgagcaccagaaccacacagcgcccactatcgtcggtcgaggcaaaaagacggacacaactgcaacatgctaggcagacggcgctgctagaccgg

SEQ ID NO: 713763 - DNA, 246 bp, Homo sapiens
ccccgaatgagcggattgaatgtgggaaatccttcagaaggaactctaacctggtgatacatgagagaagtgatactggagaggaaccgtacgaacgcactcaatgtggagagcccttcagccaaagctagcagttagatgcacataaaagaactcacactggcgaaaggccctatgaaagtaacgagagtcgaaaagccttcaatcgaagcagcaagctcagcaggcagacgcgaatagagactg

SEQ ID NO: 713764 - DNA, 1756 bp, Homo sapiens
gtgggatgggtggggggtaacgggggaaactggggaagtggggaaccgaggggcaaccaggggaagatggggtgctggaggagagcttgtgggagccaaggagcaccttggacatctggagtctggcaggagtgatgacgggtggaggggctagctcgaggcagggctggtggggcctgaggccagtgaggagtgtggagtaggcgcccaggcatcgtgcagacagggcgacatcagctggggacgatgggcctgagctagggctggaaagaagggggagccaggcattcatcccggtcacttttggttacaggacgtggcagctggttggacgaggggagctggtgggcagggtttgatcccagggcctgggcaacggaggtgtagctggcagcagcgggcaggtgaggaccccatctgccgggcaggtgagtcccttccctccccaggcctcgcttccccagccttctgaaagaaggaggtttaggggatcgagggctggcggggagaagcagacaccctcccagcagaggggcaggatgggggcaggagagttagcaaaggtgacatcttctcggggggagccgagactgcgcaaggctgggggggttatgggcccgttccaggcagaaagagcaagagggcagggagggagcacaggggtggccagcgtagggtccagcacgtggggtggtaccccaggcctgggtcagacagggacatggcaggggacacaggacagaggggtccccagctgccacctcacccaccgcaattcatttagtagcaggcacaggggcagctccggcacggctttctcaggcctatgccggagcctcgagggctggagagcgggaagacaggcagtgctcggggagttgcagcaggacgtcaccaggagggcgaagcggccacgggaggggggccccgggacattgcgcagcaaggaggctgcagggtgctcggcctgcgggcgccggtcccacgaggcactgcgggcccagggtctggtgcggagagggcccacatgtggacttggtgactgctgtatgccctcaccgctcagcccctggggctggctttggcagacagtacatgcatccaggggagtcaagggcatggggcgagaccagactaggcgaggcgggcggggcggagtgaatgagctctcaggagggaggatggtgcaggcaggggtgaggagcgcagcgggcggcgagcgggaggcactggcctccagagcccgtggccaaggcgggcctcgcggggcggcgacggagccgggatcggtgcctcagcgttcggggctggagacgaggccaggtctccagctggggtggacgtgcccaccagttgccgaagggccaagacgccaggtccggtggacggtgacaagcaggacatgacatggtccggtgtgacggcgaggaccagaggaggcgcgtccgggccttccctgaacaccttaggctggtggggctgcgggcaaagaaagcgggtctgtttctttaacttcctccacgggagtcggcaccacatatggctgccctctggggcgggggtgactgtgcgccgggctgtgtgcccggaggctcaaccttgccctcgcctagtcgtgaagctcggacggagatcacggagcacgccttcaggcaatcccatttaacgcgcaaatctcggctcttgtggcccatccccaccagggggttcagccgaggaggcccgttggactcatcattcaactggctgcatgttg

SEQ ID NO: 713765 - DNA, 200 bp, Homo sapiens
tggcccgaggtccaaatgtgagttttttccaagcaccccccctgaaccctaaaaaatggaaaccatttttttttgaaagggtcgggaaaatcattttttaaaaagaatggggatctaaactaaggtttttatatgaaaaacataggggtttttgtggttttaaaaacaactgtgaaataaaattgtttccccccctggta

SEQ ID NO: 713766 - DNA, 2734 bp, Homo sapiens
  misc_feature (665)..(665): n is a, c, g, or t
  misc_feature (702)..(703): n is a, c, g, or t
  misc_feature (719)..(720): n is a, c, g, or t
  misc_feature (1775)..(1777): n is a, c, g, or t
  misc_feature (1781)..(1781): n is a, c, g, or t
  misc_feature (1783)..(1784): n is a, c, g, or t
  misc_feature (1795)..(1795): n is a, c, g, or t
  misc_feature (1803)..(1803): n is a, c, g, or t
  misc_feature (1816)..(1817): n is a, c, g, or t
  misc_feature (1836)..(1836): n is a, c, g, or t
  misc_feature (1847)..(1847): n is a, c, g, or t
gtgggatgggtggggggtaacgggggaaactggggaagtggggaaccgaggggcaaccaggggaagatggggtgctggaggagagcttgtgggagccaaggagcaccttggacatctggagtctggcaggagtgatgacgggtggaggggctagctcgaggcagggctggtggggcctgaggccagtgaggagtgtggagtaggcgcccaggcatcgtgcagacagggcgacatcagctggggacgatgggcctgagctagggctggaaagaagggggagccaggcattcatcccggtcacttttggttacaggacgtggcagctggttggacgaggggagctggtgggcagggtttgatcccagggcctgggcaacggaggtgtagctggcagcagcgggcaggtgaggaccccatctgccgggcaggtgagtcccttccctccccaggcctcgcttccccagccttctgaaagaaggaggtttaggggatcgagggctggcggggagaagcagacaccctcccagcagaggggcaggatgggggcaggagagttagcaaaggtgacatcttctcggggggagccgagactgcgcaaggctgggggggttatgggcccgttccaggcagaaagagcaatgatgtggcatgtggatgtgtgatgncacatgtggtgttgtggccatgctgttagtgtgtccnnatgcactgtggtgtgnnttgtgtacccctagtgcccttggtgttcatagacatgtggtacaaatgtgcatgtggtgaacaaccatgtgccacatgcatgtgtgtgtttcccctatgcgttgcaccagccgtcaacacccaacactgactagagttcaattttaatggtatggcatggtgggcacatggggtggccatggctccctgtggcaactgggcataattcatcccatggtgccctaattttgcctgtgatcgccctctcgatgtgtgctgttgtgatgatgctgtgtgacacgacaatgtggcatgttggctctcggtggcagtttggcattgcatggtgaccattcacccatgggcagtggctgaaagctgtggcccacgtggtgatgtgtgtgtgttgcccctgtgtgcacatttgctgccatgcaatgggatgtgcttgcatgtggtgctctgtgccttgctgtggctgcctgtgtcccactgatgtgcacttgctgtgccccagggtctggtgcggagagggcccacatgtggacttggtgactgctgtatgccctcaccgctcagcccctggggctggctttggcagacagtacatgcatccaggggagtcaagggcatggggcgagaccagactaggcgaggcgggcggggcggagtgaatgagctctcaggagggaggatggtgcaggcaggggtgaggagcgcagcgggcggcgagcgggaggcactggcctccagagcccgtggccaaggcgggcctcgcggggcggcgacggagccgggatcggtgcctcagcgttcggggctggagacgaggccaggtctccagctggggtggacgtgcccaccagttgccgaagggccaagacgccaggtccggtggacggtgacaagcaggacatgacatggtccggtgtgacggcgaggaccagaggaggcgcgtccgggccttccctgaacaccttaggctggtggggctgcgggcaaagaaagcgggtctgtttctttaacttcctccacgggagtcggcaccacatatggctgccctctgggctcccagnnncccncnnacatgaaaganaatggtgntacccagctcaanncctggggcctttgaatccnggacacaaaanccctctagcttggaaatgaatatgctgcactttacaaccagctgcactacctgactcaggaatcggctctggaagggtgaagctagaaggaaccagactctatcaggccgatactatcaaagtagaccgatgcgggaactgcagcgcccgtaggaacccctacctcctgcagccggcggattccatctttcaccggccaagccgctgcgtgcggacgggttgaccaagcagccagctacatcatccgagtagctgagcatccgtccagggggtatgacggcctgtccccagcaagtcgcctcttctgcttgtgcatccttcatgtctacttggtaccttgaagcctgttcctggtcataggcgcttatgtgctgagcagaattcaaaaggcctccagaggagtcctgttaagcgccggtacccttcgtggacttgcacttttgccactagagttcagttgccgcatgggaaggcagatgtggacgcagggctttagaccccgagcggccaagtgtgccgtttaagtgtgtagcacgcacccattgaggaacgctgcccttgccgcagtgcccctgagcgggccccacaaattggggacggagggggacaaggggggcccggcggatgggtgtgccccaatgagctgcacaccagtcccatcacaagaatgggagaccccggggcgaccacacagggagagccccgccaacgaacaacatagcgcccgactttgttggtggtgccccccccaggggactcaagagccgggggaacacaatacaaacgcggcgccgagcaccagaaccacacagcgcccactatcgtcggtcgaggcaaaaagacggacacaactgcaacatgctaggcagacggcgctgctagaccgg

SEQ ID NO: 713767 - DNA, 708 bp, Homo sapiens
gtgggatgggtggggggtaacgggggaaactggggaagtggggaaccgaggggcaaccaggggaagatggggtgctggaggagagcttgtgggagccaaggagcaccttggacatctggagtctggcaggagtgatgacgggtggaggggctagctcgaggcagggctggtggggcctgaggccagtgaggagtgtggagtaggcgcccaggcatcgtgcagacagggcgacatcagctggggacgatgggcctgagctagggctggaaagaagggggagccaggcattcatcccggtcacttttggttacaggacgtggcagctggttggacgaggggagctggtgggcagggtttgatcccagggcctgggcaacggaggtgtagctggcagcagcgggcaggtgaggaccccatctgccgggcaggtgagtcccttccctccccaggcctcgcttccccagccttctgaaagaaggaggtttaggggatcgagggctggcggggagaagcagacaccctcccagcagaggggcaggatgggggcaggagagttagcaaaggtgacatcttctcggggggagccgagactgcgcaaggctgggggggttatgggcccgttccaggcagaaagagcaaaaggcatttggcaagaaagcataagtggccatcataaaaagtaataaaggttttttttggcctgtttga

SEQ ID NO: 713768 - DNA, 102 bp, Homo sapiens
gatctcttgatggtatcccccatggcataacagctatgacctcagccagaatacttaaaggaaactcagtagcaatatacgagtgaggctcattttttattt

SEQ ID NO: 713769 - DNA, 780 bp, Homo sapiens
ggggtggtctccgataagagggggggggcgcgaccaagcaggggcaagaagaaagtgaggggggccgcccgccaccaatagaggcgaggggggcgtacagaaccggccgagaagggggagctgataggagagtggggtgagcacatggaggggtggcgagatgtcgtcctgcagaaggtgtgaggagaggtcctctccgctggtgtagagagcgtggcggaagaaacgagtgaagaagaagagcctggcgagcagcgcgtgtgtggagcgcacccgccgctagagcagggcagaggatgtggagcagctgctgtctgggggtggtgaagcagaggcgtgtattaacggcggctctttatcgtctcctcaaagagagggtctatttggcgagcgcggatagaaagaagatctcgtcacagcctgctgcggcgagatccacgctgctatgtagtgggagaccagtggatctcctgtcgagaggttcttactggccgcgccgggtcgctaggcgagctatatatctcgctgagaaacataggcttctatcgcgcgttagcgagggaagatggtcgtaacgggggagttccatttcggagaggggcaaaaacacacttgtgggagggtgctgagatacatattggagtaacatattctcgggggagtgggaatacaggggacccgatttccaggagtcgtgcgcaacagtgtcttttcccaaaaaaggcaccatgttggtattgaagttggatcttcacgcccactttctggtcgacccccaac

SEQ ID NO: 713770 - DNA, 714 bp, Homo sapiens
gtgggatgggtggggggtaacgggggaaactggggaagtggggaaccgaggggcaaccaggggaagatggggtgctggaggagagcttgtgggagccaaggagcaccttggacatctggagtctggcaggagtgatgacgggtggaggggctagctcgaggcagggctggtggggcctgaggccagtgaggagtgtggagtaggcgcccaggcatcgtgcagacagggcgacatcagctggggacgatgggcctgagctagggctggaaagaagggggagccaggcattcatcccggtcacttttggttacaggacgtggcagctggttggacgaggggagctggtgggcagggtttgatcccagggcctgggcaacggaggtgtagctggcagcagcgggcaggtgaggaccccatctgccgggcaggtgagtcccttccctccccaggcctcgcttccccagccttctgaaagaaggaggtttaggggatcgagggctggcggggagaagcagacaccctcccagcagaggggcaggatgggggcaggagagttagcaaaggtgacatcttctcggggggagccgagactgcgcaaggctgggggggttatgggcccgttccaggcagaaagagcaagaggcaggaggagcacagggtgccagcgtaggcagcactggtgacccagctggtcagaagaacatgcaggactac

SEQ ID NO: 713771 - DNA, 113 bp, Homo sapiens
ctcagtgactctggcttctatctctgtgcctggaggacaggcatggctacaccttcggttcggggaccaggttaaccgttgtagaggacctgaacaaggtgttcccacccgag

SEQ ID NO: 713772 - DNA, 118 bp, Homo sapiens
catacgcatggtaaaaggctcccccgaaacacacgcaggttcagattccacataacaaatagtctttaaggaaccaccatttgttgagttttagtgtagtatcaaagaagactatact

SEQ ID NO: 713773 - DNA, 283 bp, Homo sapiens
  misc_feature (203)..(203): n is a, c, g, or t
  misc_feature (264)..(264): n is a, c, g, or t
tcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcanttttttgagaggttttttttgttttgttttgttgttgttgttgttgttgtttttgagacantcttgctctgtcaaccagg

SEQ ID NO: 713774 - DNA, 129 bp, Homo sapiens
tccagtccacggagtcaggggacacagcactgtatttctgtgccagcagcgacaggctatggctacaccttcggttcggggaccaggttaaccgttgtagaggacctgaacaaggtgttcccacccgag

SEQ ID NO: 713775 - DNA, 708 bp, Homo sapiens
gggagtaaaattagtattagaaagctgtacaataaaaacagtacagtatgatacaagaatggaaagacagagtatcggtggaacagactagaaagcctgaaaagagatttagttattaacatataaaggagtaagagtgtggtttaaaaataaaaactggcattataggtaagtggatgaaaagagttaaacatcaaaagtagttgaaataagattgaatgtattctgatctttggctagagaagctttatatctaaaagcaaaggaaggatttatcaagaaaactacaggcatcaaaaatatatttgcattgtttacccatgtttatagcagcattattcacaatagccagaaggtagaaacagcccaatatccactcagcaaaatgtggtatatacgtaaatggaatattactcagctttaaaaaggaaagtattggctgtgtagagagcattgaaaaaaaattgtgacacatgctacagcatgtgtcagaactttgaagtcagtatgctaagtgaaataatctagtcacacaaaaggaaaaatatcatatgattgcacttgcacgaagtgcctagagtaggttcatggagatagaaagaatggtgattaccaggagctgggaaaagtgggaaatgagttttcttgttaaatgggtttcagttacagaagatgatcaagttctagagatagatggcagtgatgctg

SEQ ID NO: 713776 - DNA, 119 bp, Homo sapiens
ctcagtgactctggcttctatctctgtgcctggaggacaggcggaatcagccccagcattttggtgatgggactcgactctccatcctagaggacctgaacaaggtgttcccacccgag

SEQ ID NO: 713777 - DNA, 135 bp, Homo sapiens
tccagtccacggagtcaggggacacagcactgtatttctgtgccagcagcgacaggctggaatcagccccagcattttggtgatgggactcgactctccatcctagaggacctgaacaaggtgttcccacccgag

SEQ ID NO: 713778 - DNA, 151 bp, Homo sapiens
  misc_feature (74)..(74): n is a, c, g, or t
tccagtccacggagtcaggggacacagcactgtatttctgtgccagcagcgacaggctttcggtcgagacgccnagattcacccctccactttgggaatgggaccaggctcactgtgactagaggacctgaacaaggtgttcccacccgag

SEQ ID NO: 713779 - DNA, 350 bp, Homo sapiens
  misc_feature (305)..(305): n is a, c, g, or t
taggtcattctcccaacgtttcatatgatacagtagatacgttcacgatctagaaaggagtgacattcatgtacagcgtctttgtgcatacgaaaccgctcaagaaaaaaacaagttctacaaacagagcgattatgttgcaactgcaacagttgctgccggggactaaccagccatgcaagttcggactaaccagccatgcaagttcggactaaccagccatgcaagttcggactaaccagccatgcaagttcgggactaaccagccatgcaagttcgggactaaccagccatgcaagttcggnactaaccagccatgcaagttcggactaaccagccatgcaagttcg

SEQ ID NO: 713780 - DNA, 108 bp, Homo sapiens
cacgaggtcacctcctcccccctgcttcatctgcctcttcctcacccccatggaaatcaggccgaaggaacctcaactttgcaatcgtgaagaacggagatacttggg

SEQ ID NO: 713781 - DNA, 114 bp, Homo sapiens
ctcagtgactctggcttctatctctgtgcctggaggacaggccacccctccactttgggaatgggaccaggctcactgtgactagaggacctgaacaaggtgttcccacccgag

SEQ ID NO: 713782 - DNA, 273 bp, Homo sapiens
  misc_feature (228)..(228): n is a, c, g, or t
ctgactctagacgatccccaaccagccatgcaaagttcggtctaaccagccatgcaagttcggactaaccagccatgcaagtttcggactaaccagccatgcaagttcggactaaccagccatgcaagttcggactaaccagccatgcaagttcggactaaccagccatgcaagttcgggactaaccagccatgcaagttcgggactaaccagccatgcaagttcggnactaaccagccatgcaagttcggactaaccagccatgcaagttcg

SEQ ID NO: 713783 - DNA, 132 bp, Homo sapiens
aatcctgtcctcagaaccgggagacacggcactgtatctcgcgccagcacatccgggaatcagccccagcattttggtgatgggactcgactctccatcctagaggacctgaacaaggtgttcccacccgag

SEQ ID NO: 713784 - DNA, 126 bp, Homo sapiens
aatcctgtcctcagaaccgggagacacggcactgtatctcgcgccagcacatccgatggctacaccttcggttcggggaccaggttaaccgttgtagaggacctgaacaaggtgttcccacccgag

SEQ ID NO: 713785 - DNA, 119 bp, Homo sapiens
  misc_feature (42)..(42): n is a, c, g, or t
  misc_feature (47)..(47): n is a, c, g, or t
atgtatctctgtgccagcagcttagtagtctgggacaggggnggtancacccctccactttgggaatgggaccaggctcactgtgactagaggacctgaacaaggtgttcccacccgag

SEQ ID NO: 713786 - DNA, 146 bp, Homo sapiens
cgatgtgagagatactgctggccaggatgaagccacagctaaggctgtgttggagcccattcagagcaccagtctaattgggactttaaccaggacatctgacagtgaggttccagatgtggaatctcgtgaagacttaattaaaa

SEQ ID NO: 713787 - DNA, 156 bp, Homo sapiens
aatcctgtcctcagaaccgggagacacggcactgtatctcgcgccagcacatccgtccgggacagagggtcgggaccctcggatcacccctccactttgggaatgggaccaggctcactgtgactagaggacctgaacaaggtgttcccacccgag

SEQ ID NO: 713788 - DNA, 735 bp, Homo sapiens
cagctactccggaggctgaggcaggagaatcacttgaactcgggaggcggagtttgcagtgagctgaggtagcgccagtgcactccagcctggacgacagagcgagacttcatctcaaaaaaaaaaaaaaaaaaaagggaaaaagaaaaaaattcaaagccccatttccccatttttaatggactttgtcaacccagccattataggtggcataacaatctataggtggatcctgatatagcctcttatggtgggcctaatttcatccaggcctcaggacatgggcttccagcctgtggtctggccaagggggccagatgcaattcaggaatcagtgctagagtccatctgctcattttctcccactcataatgtctattaagaactcaaatgcctacggggccctgtgagatccatgagtatcaggacatggttcctgctctgtcaaagttctacatagttaagtgagtcaataccgttgacaacgaattagtttgtcgaggaaccctgtagtaagtgccacaaatcacggcacaggagttgtcaaacgagtgttggtgatgacacagacacaggagctttcagcccgtgggaacgggaagaggacaccaggcggggctcgcaggagttgcagaggggaccggggccttgaatgcaccacggccgatgggaccaaccccggggggaattgcctccaagcgtgttctcttgcccacggagaaaaacttattccac

SEQ ID NO: 713789 - DNA, 141 bp, Homo sapiens
  misc_feature (55)..(55): n is a, c, g, or t
  misc_feature (61)..(61): n is a, c, g, or t
  misc_feature (132)..(132): n is a, c, g, or t
  misc_feature (138)..(138): n is a, c, g, or t
atggaacctgtggctgaaggaagtaggctgaattcccgcttctctgccagttatngcacanctctctttgaagagaggaaagaaactaaacccacccaagggatgatttcagggggagaggtggaggcagangcctgncaa

SEQ ID NO: 713790 - DNA, 356 bp, Homo sapiens
ttttggtgcctaaaaaaaaaaggctgtttgttggggttttaaataagcttattttgtgtgtctctccccacctattaccccctgttgctttgtggggttgttttggatgggcgtgtgttaaacaggagttaaatttccctgcagaaaaattaatgtcctggattttcatattaggattctttattgtaaatcaagcatggaatttatttaaaaaaggaggtctttctaaatggatatgcatggatttcagattaaactaggattttttggattaaaaaccgattgtgttaactgtaacttaaaaaaagaatgtttaaataaatgaaaccgatttttttttttcattccccaatgga

SEQ ID NO: 713791 - DNA, 258 bp, Homo sapiens
aacgaccgaaacagacgcaagtcatgagggcttcagctgttgacgacaggtgatgcatgatctgtacagccagtgtgggatgtgatgagggccttggcgaccctaacaagcgaggtgctcaggtcctgggaacccaagagtgatggattaatgtgaaggtgctggactttgagcactttcttgccatgctgcagacagtggccaagaacaaggaccagtgcacctatgaggattatgtcgaaggtctacggggcgtag

SEQ ID NO: 713792 - DNA, 102 bp, Homo sapiens
aaggagtataagtggcgtcgtataaggtatctttactataaaagctatggtgtaagctagtcatattaagttgttagctcaggagtgggatagttcttgggc

SEQ ID NO: 713793 - DNA, 275 bp, Homo sapiens
  misc_feature (2)..(2): n is a, c, g, or t
  misc_feature (18)..(18): n is a, c, g, or t
  misc_feature (22)..(23): n is a, c, g, or t
  misc_feature (97)..(98): n is a, c, g, or t
  misc_feature (107)..(107): n is a, c, g, or t
  misc_feature (109)..(109): n is a, c, g, or t
  misc_feature (113)..(115): n is a, c, g, or t
  misc_feature (126)..(127): n is a, c, g, or t
  misc_feature (151)..(151): n is a, c, g, or t
  misc_feature (161)..(161): n is a, c, g, or t
  misc_feature (164)..(164): n is a, c, g, or t
  misc_feature (181)..(181): n is a, c, g, or t
  misc_feature (202)..(202): n is a, c, g, or t
  misc_feature (233)..(233): n is a, c, g, or t
  misc_feature (246)..(246): n is a, c, g, or t
  misc_feature (251)..(251): n is a, c, g, or t
  misc_feature (254)..(254): n is a, c, g, or t
  misc_feature (263)..(263): n is a, c, g, or t
  misc_feature (267)..(267): n is a, c, g, or t
  misc_feature (270)..(270): n is a, c, g, or t
cnatgtacaaagggaggnaacnnggtaggaggtgattggatacataagggatggtttaacacaatgactgttacacatgatagctgagtgagttacnncagaaagantnctgnnnggttttaaaanntgtggaaacctacacttactttgntactatgctnctncctgacaatacatgtangatatgccttgcttccccttnaccttctgccatgattgtaagtttcttgagncctccccctcccnagccntgnagaactgtnagtnaantaaat

SEQ ID NO: 713794 - DNA, 117 bp, Homo sapiens
atagcatctcagctgacacacctaattgccgttttcccttagctcagctgaactgacagtctcttaccttgggtcagttaagtactgttcccaggtgcctttcaggcaattttagca

SEQ ID NO: 713795 - DNA, 466 bp, Homo sapiens
  misc_feature (5)..(5): n is a, c, g, or t
  misc_feature (75)..(75): n is a, c, g, or t
  misc_feature (92)..(92): n is a, c, g, or t
  misc_feature (137)..(138): n is a, c, g, or t
  misc_feature (161)..(161): n is a, c, g, or t
  misc_feature (163)..(163): n is a, c, g, or t
  misc_feature (166)..(167): n is a, c, g, or t
  misc_feature (169)..(169): n is a, c, g, or t
  misc_feature (177)..(177): n is a, c, g, or t
  misc_feature (187)..(187): n is a, c, g, or t
  misc_feature (192)..(192): n is a, c, g, or t
  misc_feature (215)..(215): n is a, c, g, or t
  misc_feature (246)..(246): n is a, c, g, or t
  misc_feature (255)..(255): n is a, c, g, or t
  misc_feature (283)..(283): n is a, c, g, or t
  misc_feature (303)..(303): n is a, c, g, or t
  misc_feature (312)..(312): n is a, c, g, or t
  misc_feature (327)..(327): n is a, c, g, or t
  misc_feature (333)..(333): n is a, c, g, or t
  misc_feature (335)..(335): n is a, c, g, or t
  misc_feature (338)..(338): n is a, c, g, or t
  misc_feature (351)..(351): n is a, c, g, or t
  misc_feature (404)..(404): n is a, c, g, or t
  misc_feature (407)..(407): n is a, c, g, or t
ttttngcgatgtgtgacatatgacattcatttaacagacacacaaagcaagccaacaggtaaacatgcttacacngcctgcggaaatcgtcnggttttaacttgttttttaagaaaacaaccaaaacaaccaaaaannaccatgacccggtacaggaaaancnggnngnctcaggtnaatactggtnttgcnggtcttttttggttttgaaacanattttttttttttccaacttgttcaattttnctctaggtncgggtgggataaatggctaatttatttngttaaccatttttttttttntaggtgcantttacctttaaaatngcggangnacnacagcagcggggnacccaaaaccccaaccagatccccaaaggcaaaatgtgtagagagaaaagggnggngatggaatgacctactttgtgatgtttttacgctttacaaaaagcagatttggtattca

SEQ ID NO: 713796 - DNA, 652 bp, Homo sapiens
  misc_feature (452)..(452): n is a, c, g, or t
  misc_feature (455)..(455): n is a, c, g, or t
  misc_feature (458)..(458): n is a, c, g, or t
  misc_feature (464)..(464): n is a, c, g, or t
  misc_feature (467)..(467): n is a, c, g, or t
  misc_feature (537)..(537): n is a, c, g, or t
  misc_feature (609)..(609): n is a, c, g, or t
  misc_feature (649)..(649): n is a, c, g, or t
ggaaagaggtcaccaagggcagaggtgtccaggccggatccaggggccccactgttgggatgctggctgcagtggggcgccccaagcccaggtcccctctgtcttctctttcaactttgcagctgtacttgttttgctcctctacccgcaggagctgacatggacccaaatcctcaggccgccctggagcgccagcagctccaccttcaggagcggcaccatctgcatctcaagtcacagagaccccccataggtagtatctcatccatggaagtgaatgtggacacactggagcaagtataacttattgaccttggggacccggatgcatcatatgtgttcttgccttgcgaagatcctccaccaaccccccattcatctgggatggacaaccatttggaggagcttgacctgccggtgcctacatcatacaggaccacatctatgacctnctnctnctcctnctncaactgctgcaccaacctgcataacccagatccaagtgatgattgagcatatacaccctttgcacattcngatgaagaggatgaaaggtgttgatgatgggcataacctggaccctgcactaacactggcccccttctacanactgccacacttgctattctcacatgataccacagcccanccc

SEQ ID NO: 713797 - DNA, 125 bp, Homo sapiens
ggggagggggctggcagtccctcgcccaccagcgcctcccctcaccgagtttgcgcctttttagcaacagagcacaaggaccaggctccggcggcgcgcgggggtcacatacgggttccctcaac

SEQ ID NO: 713798 - DNA, 1194 bp, Homo sapiens
ttgccagtcgcccatgggcccgaagggcatttaaagcaggatgtgtgcgcctgcgcttgagggacatgccattttcacctgagaagtggggaatgtgtccccagacaatttctggttcaaatccccccatgggttattccattccccgcagtgacccaattggcggaatggtaaactttggacgacgttatcgggccctggcgaatgtcctggcaagcctttgggcattggggtactcttggcccatggacatggcataacaacccctttacaagtctatctacacgacgggacgaaaccttccgggccccttacacaacttaacctatgtgggctggacggagtggttcacaacgggcctggcatgggacctaacaaattttcctcatgggccacccggaagaaggctcccatacttagctgggccattccaggcggcgggccttagaaaactgggaaacgtctagaagccattcctttcaattaagaggacgctggggtttctaatgcaattcaagcccggccttataaccgccccaataagtggggatccattcgagcacaccaacacttttcacaccggatacaaggggcaaccaaaccgttggggaagaccccccgaaacagaaccacggaaaggttcaaaccccaaaacccaatgccccataaatttgggcgagggccgcacacggaaacatttggtttcccaacggggccttgggcaaacttccccggatctatgtggcgcgacgacaccaatctggcgacaacctgggagcaatttgccgccataatatagaggcttcccatgtggggtcacacacttcggtatattcgcttcccttttcccattggaaccagggaccctctttttccatcattgtggcccttccccagcgacctcgggggaccggggcgtacggccccccaaatgggttcgtttggttgattgcaacagtcgtggtcgcgggccagggattaaaccgtccgtccttcccaaactgggatggcggcatgaaaaggccaaatcccacacctattaccatatgggggcctgggccaaattgccggccaaatcacgacacaatattaccaaccgttgtggtaccctcccgtgtgggataggttccgcccgagtgggacgacgtaatccgagtcactcggttatacgtggtgtcccttcattgtgttttc

SEQ ID NO: 713799 - DNA, 189 bp, Homo sapiens
ggggggggggggggggttgggggggccccctttttttccccccccccccccccccccctgggggggggggggcccccccctttttttttccccggtttgggctttgggggcccccccccccccccccggggggggaccattttttttttgggccccggggctttttttcattaaaccccttttccccca

SEQ ID NO: 713800 - DNA, 300 bp, Homo sapiens
cgtcgaccttcctttgttgctaggtatgtctgatgaccgtaatagttagaagaaaggaattgctttccttggcccccactcaagtgtacatacaccttcttaaaatccattcatatgtccagtatcccatccatccacctgtacatcttattcactatctttttatataccaatttatccatctacatatccatcaatctattcacttacctatccagcctctcatctatctgtctactggtctacgcacccactcacttaccagttcatcctttacccatgtgttcgccacgtcgacgc

SEQ ID NO: 713801 - DNA, 592 bp, Homo sapiens
aacagagaacaggaaagctatggatgtagcactaggaatgaccctcctaggccaggaagcccggagacaatgctgtaattcatcagtcaataactgagtccatccactgaacaaattgagtggagcaactctgagactccaaacttgaaaaattacctaataatacggcacatgatctatgtcggcttttccaaattagatgcaaaccagatgcaaatgtacatgtggccctcccaaatgatatcatataactggacttggccttcaggaaaatctgtgctgcctacacatatgcgtagtacacatacctgcaggcctattgcttacttggctgtggagtctggctgacaattctgtcaaattgtatctggagacaacaggttggtccgatggatctttctggagccactggcacgaggtcacctggagagatgacagtggtcctcagctcctgttgacactttgccatccactaagccctagggaaatctagcagaggctgcctctattcaggcagaacttaacaatcagaaacttttcctcatgttcgtgcgtcactgtatatctttactaaaacagtcaaacaaatcta

SEQ ID NO: 713802 - DNA, 136 bp, Homo sapiens
  misc_feature (55)..(56): n is a, c, g, or t
  misc_feature (63)..(63): n is a, c, g, or t
  misc_feature (98)..(98): n is a, c, g, or t
cgcgacatatccggggatttttatttttgacgcagtgttagtcctacggttaacnntttccgngtatacagtgccgtaccaccccccatttcagggtncgccagcggcaccccataggtgtttgggcccagccccc

SEQ ID NO: 713803 - DNA, 208 bp, Homo sapiens
tctaattttttttctgcttttgtacagcaaagaaagaaaaagagcaggcgttttgaattgcataatgaaaagttcgtgctttctgcaccatagtgttttccatttctcaaatttttcttggttttatatatacatacacacccctacctacctacctatctacatacacagtcatgtgcctcacagtgaggaagcatgtacgtttggt

SEQ ID NO: 713804 - DNA, 164 bp, Homo sapiens
ttatacagcagagaaggagccagctagtacttgtaacggagggcaagaagtggagagtaggaaaatcaatgaaaatgtataccaagctggtagatagaggacacagagctgaaacagcgtggcttaagataatacaacgtgtagtacaagcagcgacatatgca

SEQ ID NO: 713805 - DNA, 814 bp, Homo sapiens
atgggacatgcaggcgcaagtaggtctacaagatgctacttcccctatcatagaagagcttatcgcctttcatagatcacgaccctcataatcatttgtccttatctgctgcctagtcctgtatgcccttttttctatacatctcacaagcaaaactatctaaatactaacgatctcagacgctcaggaaatacgaggaccgtctgaactatcctgcccgctcatcatcctagtcctcatcgcccatcccattccataacgctgatccttatgacattatacagagcgaggtcgagagattcgctcccattacacattcaagactcatataggccatccagatggttaactggacatccatacgagatatcagccgagaataacgcgtcgtgacgtattcttgtcacatgtcctgatcatacttccccgatttattccttatgtaatccaaggacgaactgctgaactccttgcatcgttgacgaactcagaggtgaggtaacatacccgtattgagagcccgccatattcgatcgtaataattacttgacgagacgtctatggtatttcattgaggcctgatacccagcattagggcttatgcagcgatgccattcccggtacgagtctaaactgaaacactttcagcgggtacacgatcggggagtaatactacgtgtctaatgctctgaaatctggtggagcgaaagccacaggggtcatgaccaagtcgaaccataatgaattaatttccccttaaaaatcgtgcacaatcggcccgtattgtacccttatagcagcgtcactttaggca

SEQ ID NO: 713806 - DNA, 949 bp, Homo sapiens
gcgactgaccgtggtcgtgggtgtgagcggtagtgcagcgcggaggagctgggtgtcgctgtgggtctgcgtaagcgagagcccgggacgtgcgcgcttgtgtgcacgatcctgaaggggagctcctgaggggcccgggtctccagtggctgggtgcggcctattccctggagcctcgggctggctggggcccggctgagatactaggtttagggccgtcccagtggctccggggcgcacccggtggcactgctgctttgcacgctgggagggcagctgctggtggcgcggtgtggctcgggacgacagcgtttctcccggaagtcttcctcggggcagccagggtgggaagtggggaagccggacgcggccagctgtgccacgcctggttctctccgacgagtgtcaggctagccctatgcgcccatgcaattgcccttgccgctgtgggtgccctgactggggctttggctcttgcctggcgttgctttgccttgggccgggtgcggggaccaagccggcactgcggtgaataaaccagttgagttgggacagaaaaacgtcaattcattggttatcaagcgccacgtgggcgcccttgaaggaacacggtattggccgacgacaagattctcgaagaatacgcgaactgttacgaaggacccgcgatccggggaaatttacctcgggaagcaaagtaaccatttcgggaacgttcaagttggtggcccccgggaatttaggaaccacgttggacaggcgggactcggtaacgatacgcgaacttcgtgtggaggccccttttcaaaattttttaccaaaagggcaagacattttacaacgggacgtcgtttttatgcgccagtgaaccaacttggcacgggggccattaagcttggggcccctttgacctggttagagtttacagactacgagtttaccccaaaaa

SEQ ID NO: 713807 - DNA, 172 bp, Homo sapiens
ttgactctagaggatgctttctgtggtgcctttccctgggacatctgcctggcactataggaaggaggcttctacccacctgcctgcacacgggtctgtccctgtggtaccatgcctctgtctgtgtgcccctcatgcctcccgtggtgagacacgcaaatgacttgatgat

SEQ ID NO: 713808 - DNA, 366 bp, Homo sapiens
cttttggttttggtggctgggttggtttttttctaccggggtcccccaaactggggtccaaaaagctttgggttaatccaaaaaaatctatgtggaagagaaaagttgttctcatgaaggcccttcagatgagtgctatagactctctaggcaactccaaaaggcttctcaaccaagggtggccagtgaaagctgctatggaatcaatggccaaactgccagggcctgctttaaaagccaggtacccagttaaggaaaaaattttttttaaagggttaaaggttaaaattatccctttaaccctttgtgatgggattttcagggttcctttttttaaaggtaaccaattttttccaatgtgataat

SEQ ID NO: 713809 - DNA, 334 bp, Homo sapiens
  misc_feature (42)..(42): n is a, c, g, or t
  misc_feature (44)..(44): n is a, c, g, or t
  misc_feature (46)..(46): n is a, c, g, or t
  misc_feature (48)..(48): n is a, c, g, or t
  misc_feature (245)..(245): n is a, c, g, or t
  misc_feature (275)..(275): n is a, c, g, or t
  misc_feature (314)..(314): n is a, c, g, or t
  misc_feature (323)..(323): n is a, c, g, or t
tttaagcgtggtgatgggtgagcgctctggcccaggctggcnancntncccgcccaagcatgaacaggacttgaccatctttccaacccctggggaagacatttgcaactgacttggggaggacacagcttcagcacagcctctcctgcgggccagccctggcggaaccctccaccagctaccggaggagggagggaggatgcgctgttggggttgttttttgccataagcgaacttttgtgccngttcctaggaagtgaaaattttttcaagtnccaggaacttatgttatttttgaatttatttttaaaagnttaaaattntttttttttaa

SEQ ID NO: 713810 - DNA, 267 bp, Homo sapiens
gccgaggatgggtcatgccttctatgctcaggtcatgtattgccgctcatttttaggaatctctgttgtgccttccatttcccgctgatcttggactcattggccgttgcgtgatggacaacttaaggccctcattgagtgcaccatgcttctctgggaactgggaagctggaattcgcggatctccatgctgtagaagctatcatgcccattcccaagatgcttgctcttaaagctgtctgagtagtccggaatcttgatcctctt

SEQ ID NO: 713811 - DNA, 1396 bp, Homo sapiens
  misc_feature (1323)..(1324): n is a, c, g, or t
  misc_feature (1349)..(1349): n is a, c, g, or t
  misc_feature (1353)..(1353): n is a, c, g, or t
tagtccgtacagcctaccaggaacatgtgtgttttctttattttttaaaatcattatattgagtgtgttttcagcactatattggtcaagatagccaagcagtttgtataatttctgtcactagtgtcatacagttttctggtcaacatgtgtgatctttgtgtctcctttttgccaagcacattctgattttcttgttggaacacaggtctagtttctaaaggacaaattttttgttccttgtcttttttctgtaagggacaagatttgttgtttttgtaagaaatgagatgcaggaaagaaaaccaaatcccattcctgcaccccagtccaataagcagataccacttaagataggagtctaaactccacagaaaaggataataccaagagcttgtattgttaccttagtcacttgcctagcagtgtgtggctttaaaaactagagatttttcagtcttagtctgcaaactggcatttccgattttccagcataaaaatccacctgtgtctgctgaatgtgtatgtatgtgctcactgtggctttagattctgtccctggggttagccctgtgggccctgacaggaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgactgcccttagccaggcaagcacagtaatgtgtgttttgttcagcattattatgcaaaaattcactagttgagatggtttgttttaggataggaaatgaaattgcctctcagtgacaggagtggcccgagcctgcttcctattttgatttttttttttttaactgatagatggtgcagcatgtctacatggttgtttgttgctaaactttatataatgtgtggtttcaattcagcttgaaaaataatctcactacatgtagcagtacattatatgtacattatatgtaatgttagtatttctgctttgaatccttgatattgcaatggaattcctactttattaaatgtatttgatatgctagttattgtgtgcgatttaaactttttnngctttctcccttttttggggtgtgncgcnttcttttacaacaagcctctagaacagatagttctgagaattc

SEQ ID NO: 713812 - DNA, 275 bp, Homo sapiens
  misc_feature (8)..(8): n is a, c, g, or t
  misc_feature (40)..(40): n is a, c, g, or t
  misc_feature (45)..(45): n is a, c, g, or t
  misc_feature (72)..(72): n is a, c, g, or t
  misc_feature (74)..(74): n is a, c, g, or t
  misc_feature (163)..(163): n is a, c, g, or t
  misc_feature (268)..(268): n is a, c, g, or t
atgcacancgacactctgtatctagctgctctgtgggctngagancttatatctagctcaggattgtaaatncncccatcggcactgtgtatctagctcaaggtttataaacacaccaatcaacaccctgtgtctagctcagggtttgtgagtgcaccaatcnacactctgtatctagctgctctggtgggccttggagaacctgtgtgtcgaaactctgtatctaactaatctgatggggacgtggagaacctttgtatctagctcngggattg

SEQ ID NO: 713813 - DNA, 335 bp, Homo sapiens
gccctttacccccccatgggggggggtaatttacccccccgtttcccgggtaataagccttttttgttccccaaaggggaattttgaactttggtcctgtttgcggggaaaattttttttaaaggggggggggctttccctttaaggactttttggcccccgccccccccaagcccccttttttcccgctaatgggggggctttgtggggggggggcccaaacccggggggttggttcttagggggcccggttttccgaaccccccgccggttttttttttaattcctgggcgggggggccccaaggggaaattaaaggtcctttttttttttta

SEQ ID NO: 713814 - DNA, 1342 bp, Homo sapiens
  misc_feature (1269)..(1270): n is a, c, g, or t
  misc_feature (1295)..(1295): n is a, c, g, or t
  misc_feature (1299)..(1299): n is a, c, g, or t
tagtccgtacagcctaccaggaacatgtgtgttttctttattttttaaaatcattatattgagtgtgttttcagcactatattggtcaagatagccaagcagtttgtataatttctgtcactagtgtcatacagttttctggtcaacatgtgtgatctttgtgtctcctttttgccaagcacattctgattttcttgttggaacacaggtctagtttctaaaggacaaattttttgttccttgtcttttttctgtaagggacaagatttgttgtttttgtaagaaatgagatgcaggaaagaaaaccaaatcccattcctgcaccccagtccaataagcagataccacttaagataggagtctaaactccacagaaaaggataataccaagagcttgtattgttaccttagtcacttgcctagcagtgtgtggctttaaaaactagagatttttcagtcttagtctgcaaactggcatttccgattttccagcatattctgtccctggggttagccctgtgggccctgacaggaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgactgcccttagccaggcaagcacagtaatgtgtgttttgttcagcattattatgcaaaaattcactagttgagatggtttgttttaggataggaaatgaaattgcctctcagtgacaggagtggcccgagcctgcttcctattttgatttttttttttttaactgatagatggtgcagcatgtctacatggttgtttgttgctaaactttatataatgtgtggtttcaattcagcttgaaaaataatctcactacatgtagcagtacattatatgtacattatatgtaatgttagtatttctgctttgaatccttgatattgcaatggaattcctactttattaaatgtatttgatatgctagttattgtgtgcgatttaaactttttnngctttctcccttttttggggtgtgncgcnttcttttacaacaagcctctagaacagatagttctgagaattc

SEQ ID NO: 713815 - DNA, 454 bp, Homo sapiens
tagtccgtacagcctaccaggaacatgtgtgttttctttattttttaaaatcattatattgagtgtgttttcagcactatattggtcaagatagccaagcagtttgtataatttctgtcactagtgtcatacagttttctggtcaacatgtgtgatctttgtgtctcctttttgccaagcacattctgattttcttgttggaacacaggtctagtttctaaaggacaaattttttgttccttgtcttttttctgtaagggacaagatttgttgtttttgtaagaaatgagatgcaggaaagaaaaccaaatcccattcctgcaccccagtccaataagcagataccacttaagataggagtctaaactccacagtatagctctacatacagatacaactattgtaccttaatcactagcctaccagtatgactctgcatcagttaaatcagcaa

SEQ ID NO: 713816 - DNA, 169 bp, Homo sapiens
aagccataccagcagccaccaggcaatgagagcggttacataaccaggactgttctttcctcaacccttttggcaagactacggatgctgactcttcctcagctggcactccctataaccacttgtctacccactcgaacagcatcacatggatagggtacctgagctc

SEQ ID NO: 713817 - DNA, 232 bp, Homo sapiens
cggaggcgttgaatggccagatggagctgaaaaccatggcacgagaaccatgtgaggcatgcaaaatcttcaatagccgattcgatcaagtggaagaaagggtatcagtgattgaagatcaaattaatgaaataaagcgagaagtttagagaaaaaagagtaagaagaaatgaacaaagcctccaagaaatatgggactatatgggccattcaacgcggggtaccgagctcg

SEQ ID NO: 713818 - DNA, 489 bp, Homo sapiens
aatgcagcggaatcggaggcagtagtggcagcagagcagctgacggcaggagcaggagaaggagcagttgcgggaaccggagggctgtgctaagctgtaggggtactactggaacactggtctcaggtggctcattgcaaagaggtccagctcaggtgcagcctctgcaataccttcagagggggcaaaggggtcatttcctgaacatgcatcaggtgctgctgctacaggggttggggtagcttggtgcggaggccccttcggatgctgcaggggccttccccagggagaagctgcaaagggatctccaaagagatccagttcagcagttacaggggtaacagttgtagtaagtggaggcaggaagctgaggccagttgcaatttcaggcagttgtcagtaggagggggtaggtacttggtgcgaatgggtctgaaatcttgtggttcagaagggaaccagaggaaagttcatgcccaagaatcctct

SEQ ID NO: 713819 - DNA, 136 bp, Homo sapiens
aaacttgtaaaggtagagcctggagggctgatgtgtgttgggtgttgggcggaacagtggacgcagctgtgctatggggttctttgcattggatgtattgagcatgcgatgggctgtttaaagtgtgactcctcac

SEQ ID NO: 713820 - DNA, 882 bp, Homo sapiens
gaggacgtgggcccttgccttgacttcacagtgcaggagctctcagctctggttcggactgctgtggaggacaacacactcaccattgagcctgtggcttcacagacactgcccgctgtgaaggtgcccactgttgagtgtaacaacaccaaacacatgtgccctgagtggcctggcacgtacctgccaccatcgaatccgcctgggggactctgacagccactattacatctcaccgtcctcccgggccaggatcaccgcagtatgcaacttcttcacctatattcgctacatccagcaaggtctggttcggcaggatgctgagccgatgttctgggagatcatgaggcttcggaagggcatgtcactagccaagcttggcttcttcccccaggaggcctagggcatggccccaggcctgaagtaagctctgagctagagcaaacagctgccttgggacagacagacaagaaatcctggagccagctctgagccagaagctgaaaggacagataaacaaccaggctgtagagacagttctgagcccgtaccacccatccgtcctgagacagacaaaaggacagcctggcctggacttcatcagatgaccccttcttgcccactgagctctgtagccaacaacgagaatcttcaagaaagcaccaatagaccaaggtgctcggaagcaaggagctccagcctgggcgagaggaccctggagtagccagttaccctcacacaaatcccctgtgctttaccaatgctctcttgctggcacatcttccagaaagcggtggtctagggtggtggattccagccctggagaacacggcccctttgggcctttctcactctgttcccaggtggcctcttaatgcccag

SEQ ID NO: 713821 - DNA, 138 bp, Homo sapiens
tcatgagttacacacggcggcagaactgtctcgccaggtgatgaagtcctcctccaagttcccatcgtcgtcgccacacccagctcaaagatgctgctggtgtgccgagctgctcccagccggttgtgcactgtactt

SEQ ID NO: 713822 - DNA, 154 bp, Homo sapiens
agaaacatgttctcctgttaagaccccaaaaatggacgaaagaacggtagaggggcgagaaagccttggatcacttcttggttcctccagataccacttttggggcagtcagagttgccacaacttaaagccaaggccaactgactggttaagc

SEQ ID NO: 713823 - DNA, 206 bp, Homo sapiens
taattattatcctttgattttaacttcacaatagttgaaatatgtaatatacgtcttataccttctaaaactattttatctaatttttgacttaaagcaaaaccatgtacaatttttaatttatctatataaaaacttcctttaacttctataaatcctactaatcagggtttactcattacatttttaatatcttccaaagtatt

SEQ ID NO: 713824 - DNA, 228 bp, Homo sapiens
ccctggcgtacaagtatatgtgtttggttagaaaactcacatagtattggattaataagctaccaacatataaatcttttattaaaggaagaacaatattgacttactattcctatttgttggtctaacgaatacttctgctacgtgtatcatccatccccaatgactgaaagaaagcatgccatttgtctctatttgtctatcttcctataatgggacggaagatca

SEQ ID NO: 713825 - DNA, 167 bp, Homo sapiens
aagctccaacaagagcgaaactctctctcaagaaaaaaaaaaagaaagaaaatgtaaagtaaggtgtttgtaagtggctattgttgtatttttattgggcaacaactcctgttgaaaataacccctgggtgttgggggacaggaccttttacttaatgtaatgtggt

SEQ ID NO: 713826 - DNA, 904 bp, Homo sapiens
ggccgtggcccaccacttcccaaggcccatccaaggcctccactgccccccaggcccctcaccagccagcacttttcctgggggaagtggccagtggggatgaccggtcgttgctcggtgctgcagatggcacaagacgctgagcgaggtggatctttgcccctgctgggccttgtacgctctagcgctcctcccaggccccctggcagctgctgccccgcccggggtactgccctcggactatgtgccggctcccatcagcttcctctcctaccccgtcattccgggagagcatcctaggaagacctggcacgcaggcaggctccgtgccatgcctagggcggcgcggcgccacgcgggcctgcagcgaggcaggcctgagtgcctggctgcgggccatcggatcggcgcgctatgaggacgggcctggctgcattacttggcctcggggacagagctggcagttcccctcagtgactctcaccgaggagcgactcgcgaggacgcgccatgggggtgcacgtgacccgtgctcactaagcgcctccattcggggaacagaccttgaatgactcagtccaagtggcatagccgggaggcaactcatgaaatgcctgttgacaactcaagaggcccacatctcctgcataacctaagggtcctctaggctatgggtccccagggattatgaaaaccggtacaacttgacaccgagtcacgggtgacaacgctacaatcacttcctgcgtggcgcgtaacataacaatttggcgcgtattggccgtaaagtataactctgggcgagacttcctgagcagtttacgccacagtgtgtaccaccaaattcaagtatttgagaacataggcccccttaacttaatgcgaggaattcccgtggaacccc

SEQ ID NO: 713827 - DNA, 131 bp, Homo sapiens
gcagcagccaaatggaattcagcaatgccacggtttctgctggacacgagtctggagcctcctctgtgcggacagacattgtgtgacaaaaagaggtcattgccagctacaatcagctctcctggaggagg

SEQ ID NO: 713828 - DNA, 889 bp, Homo sapiens
ataaacgcggctggcggatggctctgatgtgccgagatcccggcaaccaggcctcatgtggctcgcgtcatcgtcattcctcctgtatactcagtgggtacacgtgtgagttgaacaggctgaacagctccgaaactaaagggacgtggacgtgcgaatagctgagccacctatgtgaaccgacgaacctgtagaggcagtagtgtccctacggactgggggcgatggtccagaggcaccaagaagagcagtctcgagtggtcaccgacaggaacgaggataggggatcgaccggtctctcggactcgaagtgagaagtcgctcactgagttattcttttcctcgaggaaagcgttggggaccgttacgacgacgcgcaatcctccctggggggccgtgccgagctcaacagggcgttcgtcctccgtatctctactgcctcgacatgtcatgcgtatgggccatttgcgtttcctcgaccctttgcgctactctcgcccgtctgcctttacctcttgtatgcgtctacccgggttctcttgaaaggcccgtcgcctttttgaacctcgtcttgttacgcggaaattttacaggttccgagtcgcaggggtctgttgagtactcggatcttaccaaacacaaatcgtccgccttttcccctcggcggctaaaggccccttgcaggtgctggagcaaagttgatttgcagccctaggaagtcccttccactttctgctatcatgacctttgaggactcttctcgccgctttggcctttttacctaaaggtggaagggtcctggattcccatgaatcaggagaccgtaatcgctacaaaaagggatccgcggacttagaaatgggatacgtctgaagaaactattcttcag

SEQ ID NO: 713829 - DNA, 297 bp, Homo sapiens
ccgggaaagttgggccccctccccccccccccccagggggttttttttttggtttgggcaaacccggggcttggcccttcccccaaagccttttggccagttttttcccccccccattttttccgtttataagggttccaaaatcctgggagggttttacccttctgaagggaaaaatttgcccccccggccccggggcttttggaattgcctttttggtttgtttaaaagccccccccgccttgtttgggccttttttttttttttttaaataaaaaggttggcggccccccccca

SEQ ID NO: 713830 - DNA, 700 bp, Homo sapiens
  misc_feature (333)..(333): n is a, c, g, or t
gctcctctgggtctagctacccagtgaagctgcaacactccaggatggtgctggggaatgtttgcaaggggtccagtgatgtgacctgtctgaggcaatatcttttgtgtatgtggggtttctggtgttttgaaatagttctacaatgaacacttgttagttttgtcatcagaaataaattctttcagtgtagtgcaagtaagttctatgttttcaggcatttcctcagcctctgtctgcaagttaatctaaaaatgtgaaggatgtttgtattggcagattgagatgtgaattgtgcatacaaaggtaggaaaaggtagaaattatgttaanccaaatgtctttgtggaaaagtaataagctgtggcatgagacatgccttcaaagttaattaggtaattattagcctaaagaagcaaaaggtcaaagttgaatagttttagcgataaagcttaaaagattcattaacacaaaatgaacacaggaagttccagaactaactatgaatccctggttcttataactaaaaaggtcatcttctgatcgttttaactaatgttcctccatccaaaataatgaggaagacaattttgctctgctccccaacgcatgtaaataacataatgtcagagtgaagaggttaaaaattaacattttctagttgcatttagtgaaaatgtttaattttcaaaatcagtga

SEQ ID NO: 713831 - DNA, 573 bp, Homo sapiens
cccagccgaggacgtcggatgtcatcgtccttcttgctttgccaccccattcccgtcaatagagtggtttgaacccaaaaaaaaaaaaaaaaaaaaaaaaaaaaaaaaaaaaaaaaaaaaaaaaaaaaaaaaaaaaaaaagggggggcccccaaattttccccgggggggcccactgttttccgcttcgtccgccgccagttttttttgacaaacagggggcgcccctattaggggcagcctgctgttttattaacaccgacgagccgcggcgcgcgcggtgttatacacacgtctcagctggggaacaaccactcgctcgcgcgcaccctctgcgcgccgccgccccctctcttcgggggggggggcccaccaccaaatttgtgtggcgacacacacacctctcctcccacaaagaaattattaaaaccccccacaggggcaaatatctactacatctttcaaagggtcttatataactggtgttaaccccacccaccgcgaccataattcactcccccgtgaaaaaaaatttgtccccatcaccatatattacttatttctcacaacttct

SEQ ID NO: 713832 - DNA, 96 bp, Homo sapiens
catggatttgctggtgcagtacaactaggcttaatagggacatgccactgcactccagcctgggcaacagagtgagactctgctttaattaaaaaa

SEQ ID NO: 713833 - DNA, 638 bp, Homo sapiens
cgaggctgtcctcccttcaaggccgttagcctcttcctactcgtcgtactcccggaacaacagccgcctcgtcatcaagcacgctacccaacctggttgatattactataaaattctatccaatggggaatttctagggtatagtacaataccgtgtcaactaggttcttgtactaaaatactctgcttgacatatttcaggcctaaagttgtggccaatattatcatcgaattcttctgtcgtttggatttcctgctaggatcttcgtcctagttcactaccaacgatgcaagataggcgacggagcggtaagctactatgtcgtctgtgagacctactgctgcagcttgtcgtgccgtcaggagatccaggaagcctgtgctgatgcgtgtatactatcatggacccatctgtcttagtatatctactgaggtataatatgccatgtaaatagacatattttttataatctttacatgatggtttaaattcagaaggaaatagatccaaggaaatatatatattttcttctaaaacgttatgtaaattcgtgtgacaaataatcaggtttcatcttggcagcaaaaagttctcagtgacatattttgtggtgtttctttttgaaaagcaaagctga

SEQ ID NO: 713834 - DNA, 148 bp, Homo sapiens
tggccggggtttggttttttggcccggtggggccccagggaaggcttctttttaggaaaaccaaaccaaacccaaccccccaccctttggtattttttttttttggggcaaatggaaaaccttaaccaccccctttggagaggggccc

SEQ ID NO: 713835 - DNA, 423 bp, Homo sapiens
  misc_feature (311)..(311): n is a, c, g, or t
ctctagaggaccccgagagatgacagaagggagaaagaaataaaagcatcaaattggaagggagaaatccaattggtactggttacatattggatggtcttacaatagggaaaagctaaaagatctaccaaaagaactcttggaaatggtaagttcggtaagggttcagaataccaaataaatacacaaaaatcagtggtatttctgtatacaaacaacacacattaaaaatcaagaaagccatcatatttacaataactgaaaaaacttttaaagtctgtgttatctgaaatgaaataagtgtagctttnggttttcatttacatggaatatcttttttcatctcttagctttccctctgggtgtcttcacagttgaaatgagtttcttgtaggcaacatgtaattgactctagggttttaa

SEQ ID NO: 713836 - DNA, 315 bp, Homo sapiens
tgatggcgctgatgacacccaccacgcccaccggttcgcgggtaaccaggccaagctggtcgtgcggggtcggggcgacttcgtcgtagaccttgtcgatggcttcggcagtccagtggatggcttgggccgcacctgggatgtcgatgctggaggagtcgccgatcggcttgcccatgtccagggtttccagcagcgccagctcttcgacgttcttgcgcagcaggtcggcgaagcgaatcaagcttggccttgcgcttggccggagccagttgcgaccagacgccggagttgaaggtgtcatcagcgccatca

SEQ ID NO: 713837 - DNA, 1229 bp, Homo sapiens
  misc_feature (672)..(672): n is a, c, g, or t
  misc_feature (687)..(687): n is a, c, g, or t
  misc_feature (692)..(692): n is a, c, g, or t
  misc_feature (694)..(694): n is a, c, g, or t
  misc_feature (714)..(714): n is a, c, g, or t
  misc_feature (718)..(718): n is a, c, g, or t
tcgatccccgagctccggataccggtgcctcgccatggctgaaccagctgactgaggaacagattgcagagttcaaggaagccttctccctcttcgacaaggatggagatggcaccattaccaccaaggagctggggactgtgatgagatcgctgggacagaaccccactgaggcggagctgcaggacatgattaatgaggtggatgctgatggcaatgggaccattgacttcccagagttcttgaccatgatggccagaaagatgaaggatacagacagcgaggaggagatacgagaggccttccgtgtctttgacaaggatgggaatggctacattcagcgctcgcagagctgcgtcacgtaatgacgaaccctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctcttctccttcttcccntgagtctctctccantgccncntcatctcttcctatttgccntcgncctcttccatccacgtcttccaaggcctgatgcattcataagttgaagccctcccacagatccctcttgagggtagcactctgcaacgtcactcgcagacaccaggacttggctcgtccttacattgttggtgtgtgattaacctcgtcggtatcgtcattcttaattgcgaggtgcatgtgggatggtctgaccaacgcacttgttccgctgggacgcttgcatgggaagggacaatgaagagaccttccctccagggcagaagaagcagtgcccttttgccgtttgctatgcaatcatggcctgtgattcctcgtgcagatcccaagcaagacctgttggcggcagggtgtgccaattatgaggcagtccagaaggactgaggtgggcgttgaggaattgtgggcgttgactggaatgtgggccaaagagaggagtcgaagggcgccaactcaccaaaagggcgactgacagtgggcaaaactctcctccactggctgctgttctgaac

SEQ ID NO: 713838 - DNA, 271 bp, Homo sapiens
tagaatggtcacctcctcattcaggtccaccttttccccggtcatggcgaatcggtgcgttaaaccactgctcgaaagtgctgcagcacttgaagatggtgtgacagcgggaagttgagcagggcccagagctcgggaagcttgtgctggagcggtgttgccgtcagcagcaggtgacggggtgccacataatgcgttgttgagcacctgcgtaagcttgcattggtggttcttcatgcggtgaccttcgtccataatcatgtaataccaa

SEQ ID NO: 713839 - DNA, 374 bp, Homo sapiens
  misc_feature (141)..(141): n is a, c, g, or t
  misc_feature (206)..(207): n is a, c, g, or t
  misc_feature (332)..(332): n is a, c, g, or t
gacaaggtaaaaggaggcgtgcagcgagcatgaaccggctgggctgctggcccgcaaggagcctgccaaggacagaaaagggccctgggcagaggagttttggacttgggggccacccttcaggttttatttttccaggcnccccagcggcgaagaggacctgggagtcccctggtgtgagggccagagactgtccactgtctgtnngtcttctaagtagatgtcagggttctgggaggaggcctgcagggggctgagggcccaggggaagcccctcggactccctcccacaagtggactctgctatctgcttcctgctgggctggcctacnctccggccgtgggctgtggagagctgggccgtggctcaggcg

SEQ ID NO: 713840 - DNA, 977 bp, Homo sapiens
tcgatccccgagctccggataccggtgcctcgccatggctgaaccagctgactgaggaacagattgcagagttcaaggaagccttctccctcttcgacaaggatggagatggcaccattaccaccaaggagctggggactgtgatgagatcgctgggacagaaccccactgaggcggagctgcaggacatgattaatgaggtggatgctgatggcaatgggaccattgacttcccagagttcttgaccatgatggccagaaagatgaaggatacagacagcgaggaggagatacgagaggccttccgtgtctttgacaaggatgggaatggctacattcagcgctcgcagagctgcgtcacgtaatgacgaaccctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctcttctccttctcctgaatgtccctccacgccctcacggttctttgcgcttccctttcattccaagtctccacgctgtgttcctatgtgagcccattgcctgcctggggagcgtctggctccttcctcagggcggtgggctcctccgggtggggtgggtcccttgtggctttggtggcgggtgggccatctggcctgtgggggggaggaggcgtgcggggggaatcccgccctgtgtgccacccgttttgttatcaccttgtgggggggaggagaccccgtggtccacacgcggggggtttgagagaacaaactgggaggcg

SEQ ID NO: 713841 - DNA, 389 bp, Homo sapiens
  misc_feature (70)..(70): n is a, c, g, or t
  misc_feature (332)..(332): n is a, c, g, or t
  misc_feature (345)..(345): n is a, c, g, or t
gacaactgaaagtgaaaagttaattcaagaatagtgtcaggctgggcacagtgtctcacacctgtaatcnctcctttttgggaggctgaggcaggtggatcacttgaggccaggagtttgagaccagcctgcccaacatggtaaaaccccatctctaccaaaaatacaaaaattagccaggtgtggtggcaggagcttgtaatcacagctactgaggaggctgaggcaggagaaacacttgaacccaggaggcagaggttgcagtgagccgagatcacaccactgcactccagcctgggctacagagcaagactcggtatgaaagaaagaangaaagaaagagangaagagagaaagaaagaaagagagaaagagagaaaaagagaaag

SEQ ID NO: 713842 - DNA, 94 bp, Homo sapiens
cttccccctctcccttccccttctccctttcccctctccccttcccgagtttcccacatttccagcctgggcaacaagagtgaaactctgtctc

SEQ ID NO: 713843 - DNA, 486 bp, Homo sapiens
  misc_feature (52)..(52): n is a, c, g, or t
  misc_feature (365)..(365): n is a, c, g, or t
  misc_feature (458)..(458): n is a, c, g, or t
ggtgtcagtgggcaagcgtgcatgaagaagtgcagcgggaaacgggacatgncacagccagcttcgcagtcatattgagctggctgggaagcccagcaggtggtgccccactcatggtagcagacaccaggtggttcaggtcaccataggtgggcgtggtcagctttagggttctgaagcaaatgtcgtagagagcttcgttatcaaatgcagtaggtctcgtctgtgttttctacgagctggtggactgagagggtggcgttgtagggctccaccactgtgtctgacactttgggcgaaggcaccacactaaacgtgttcatgatcctgtctgggtactcctcccggatcttgctgatgaggangggtacccatcccagacccagtccccccacccagggagtgggtcagctggaaaccctgcaggcagtcacagctctcagcctcctttctcacanaatccagcacaagaaacacacggggtta

SEQ ID NO: 713844 - DNA, 803 bp, Homo sapiens
  misc_feature (474)..(474): n is a, c, g, or t
  misc_feature (497)..(497): n is a, c, g, or t
agaaactataggtctagtacgaggctgggtttaaattcggccgaggcttagtgcctgcgttcgcgtgtctcccgcgccgccgtccactgtcgcgcttcgctctcctgccgcccgaggcccgcgcgctcgtccatgtcccgtggccaccgtccaccgcgggtcgcctcggttgctgggcaccatgtgagactgggcgccgccgatggacgcgcccgctcagctgccgtcggccgtgcgcgcctttctggagcgcgtgccgatcgaccgataccgtggacatcggccttctatgtcaggcgacggtccagctccgagcatccatcctggtgcggcctggggctcgtggcttggcgtcggtgagctgatgttgcccgaaggtgcaatagatttcgccgagccaatggccacagcccattgtggaatgggaagaatctacattaacacgcctgtgcatcagtgctcctgtgtcccatncgtggaatgcatccgttccattncaaagacgcgctttgcagtgttccgccaatgtgtgaccttcgttcataccctaacaatcgtcaccgtagaaccgacagggcgacaccccgattggccgtaatgaggacgctgtcattgtcgcttgacctaggcgtgggtgctagccaacgcatgcgcgagaattcgctggcagtgcttagggctctccaaattagtggctaccttggcgaaaggtgtccggagaattcgtgttacccttcttggaatatcaatggcgctggatcctgccgaagtgtgttccagggcatgttcaaagctaccaccgt

SEQ ID NO: 713845 - DNA, 226 bp, Homo sapiens
aattattaagggggggggggtcctgtgtaaataagtagacattggattgggttggtaaagagttcagttctttagtatctaatttgtcttttaaaatgagtacatatataggcataatatatatgctcagatcaatatacttgttagaaacttcaggcatcaaaacctaggaggagtattttaatagtatttgtataaatcggtgggtatgtttttaattagttcc

SEQ ID NO: 713846 - DNA, 1003 bp, Homo sapiens
caaaattgtcctgatcatggctgcgtggcgatcggtcaccaggtgggggtgggggagccccgcaggagatgctgtggacaggatcctggaggcagagcttgctgtggaacagaagagtgaccaggcgttgagggtctgggggaaaccgggggtagcggagcagccaaatgacctgtgactaacatctgtcaggcagtgacaaacagtattcacgcttgttgagtgggcgaagaggatccacacttttctccttggctttggcatgatcaggtccatattggtgcgggcaggctggaatgaactcctcattgctccttttcacaccgatccattgatgttcgagcatggatactccttgccaacaaggtcttcacgtgcaccgcaactcagcccccattcagccaggagtaggagccatcttttgatcgggtgctgacagagctagtgtcccaacacatgcgtgcacatgaggcatggacaagcacagagcttggcttgctgagggcaatcattctcgtttaatcccagatagccaagggctctccaacctcagtgaggtggaggtcctgcgggcagcaaagttgtatgcattcacttgtagacctactgcaaaacagaagtacctgagcagcagggacggttttgcaagctgttgctagttttcctgcctccggtccataggcttcagtgtctagagcatctgtttttctttcaaagctcacttggtgacagcgcccatcgaaagcttcgtcatggagaatagttgaggtccccatcaatggctgagctcagaaccagaagtgtggttctcaacctggagaggccacattccagaaggatccaggcctgggccggtggggggcctgtccacgaacttaatgggtgcgaagaccggcggaaccagcaacataacctccaggatcgttgattcccgtggaggacccatacctaaagaggtggtctcggggcagccaactaggggtcccgaggggataccatgccc

SEQ ID NO: 713847 - DNA, 607 bp, Homo sapiens
  misc_feature (77)..(77): n is a, c, g, or t
  misc_feature (138)..(138): n is a, c, g, or t
gcatgtttctccacacgtttcacgttgacttacacattacatggatctataggctttctttttatccttttgtgcangtgccttgcattccacgtggttgttgtgttttttcgtgtgtgggcactactttatttcctntacctcgtggtttctttctccttacatgcttattgttcgtgacaatgtgttatttcctaaaatacgttgttttcctcttgttacttttctggctcgagtgacttccgagtaacttaccatgtgtttataagcgtgatgttcaaagcctttcagtctgggagactttctgccacctatctgactgtacctttatcttcaagcttatctctttccaaacaagaggctcatttagcagctttctctgattgccatgttcatcctaacactcagcctcattcagtttacagcatggaaactggtataggacctctttcctatagaaattgaagacattaaataggaagaaaattaaaatatacattgtgatacatgagtatccagtcaaataatatctataaaataccagatagagtataaaagacaatgaaggacaacagagtgatgaaaggacttattaggcattggattg

SEQ ID NO: 713848 - DNA, 237 bp, Homo sapiens
ggtgtttcatcatgttggccaggctggtctcgaactcctgaccttcaagtgatccacccacctcggcctctcaaagtgctgggattacaggcgtgggccactgctcctggccgtctttcctcttatctaattagtgtaaacattctgcttgttcagtttaagtagatagtatagtaattaagaacacagattctggaaccagattgtccaggttcaaagttgtgtttacgcccttgt

SEQ ID NO: 713849 - DNA, 498 bp, Homo sapiens
  misc_feature (140)..(140): n is a, c, g, or t
  misc_feature (145)..(145): n is a, c, g, or t
  misc_feature (182)..(182): n is a, c, g, or t
caagaactcaggggaagtgaaccatttggtgaagaatctactaaaaatacgggctttccgcaaacgaaggatgaatggaaaatgtaaataaaaagaactggccagtgtatatcagatgtttaactataaggaccagaacntaagnagtggagactatttgccatagaccacaatgtaaattntttaagtgaggaaggaaaaatcaggaatcaaaaggggccaggtgcagtggctcacatcctataatcccagagctttgggagttcgaggcaggaggatcacttgaagccagttttgagaccagcctatgcaacacattgagaccctatctctacaaaaaatagattagctgggcacggtggtgcatgcctattgtcctacctactgtggaggctgaagtaggaaatcacttgagcccgagagtttgaggttacagtgagctatgattataccactgcactccagcctgggcaagagagcaagaccttgtctcttaaa

SEQ ID NO: 713850 - DNA, 302 bp, Homo sapiens
catctgcacaacaaaacaagttgcccacgtgttcacacctttgaacaagagtacaaaaggtctgagacagagtcaatcaggcaagacaaagaaatcaagggcatgcagatcaggaagcatgaagtcaaattatccctgtctgcacatgacaggatcaaatatatagaaaaccctaaactccaaaagtggcaccaaagaaatcttaggactgataaattcactgaacttgcaggatataaaatcaacatgcaaaaatcagcagcatttctatacaccaacaatgaattagctgaacaagaaat

SEQ ID NO: 713851 - DNA, 447 bp, Homo sapiens
  misc_feature (2)..(2): n is a, c, g, or t
  misc_feature (16)..(16): n is a, c, g, or t
  misc_feature (29)..(29): n is a, c, g, or t
  misc_feature (53)..(53): n is a, c, g, or t
  misc_feature (74)..(74): n is a, c, g, or t
  misc_feature (80)..(80): n is a, c, g, or t
  misc_feature (140)..(140): n is a, c, g, or t
  misc_feature (201)..(201): n is a, c, g, or t
  misc_feature (215)..(215): n is a, c, g, or t
tncgtggccttttccnggttcctaccccnacttggccccctgtcccttatggnggtattttccttaagggattnctcccngatgtaggttggtaggtagggtttccaccaaggtactggaaattaccatagaccgtatangattcgccatcttaacctggaaacctaaacctacttttaaattgtccgccttatttttaanatgtgtgagatatntgtggtgacacagtgaaatatactgaaatgcataatatctagttgttccatatatgtttttaaaataaatgcttcagcaaatctgttaactatttttgtaaatctcagcattcattcttgctttttggaataggagcaagatttttttttttaaagagacagtttaggaaattttagacgaatcctcagaattatttgttgtggacaccaaccactgtaaaaatacctaaat

SEQ ID NO: 713852 - DNA, 413 bp, Homo sapiens
  misc_feature (383)..(383): n is a, c, g, or t
ttgcatctgcctcataactatgtatttggaccagagtcaagggaagaccagtgaacaccacaggatgcaggcagtacaacaaacaaatgaagttcaaggagcatccatccagacgtgatgccctccgtcctctctgtgcatcagagcccaccctcctcaccccacagactgaccacaaacaagagcctcaacctcatccgtccagtgtttctgcttctcctgctcttcccacctctaaagcactcttccaggggacagagaactccagtgcacatcagctcgctcccaagcctctgcagaagccttccgaggactggcagtgcccaccgctcgctgctggctgggttgaagggcttatatgtgtgttaggcaggcttggggangaagctggaatgttgcacttggagtttcta

SEQ ID NO: 713853 - DNA, 905 bp, Homo sapiens
atggtccgggtggacctggatcaagctgcgggcgtcgggcgcgggcaaagccatcggcgtcctgagcagcggcggcgacgcgcaatggcatggaacgctgctgtccgggctgtgacgcgcatgggcatttaatgtgggtgccaagagtcttcctcatctacgagggctatgagggcctcgtggagggaggtgagaaccatcaagtcaggccaactggctgaggcgtctccaacatcatccagctggtgcggcacctatcattgggcaggcgctcgctgccaggcctttaccaccagggaggggtgctggggcgggcggtctacaacctggtccaggcacggcatcaccaagctgtgcgtcatcggcggggatggcaggcctcactagggtgccaacattcttctcgagcgagtggggctgcctgctggaaggagctgctggcgggacggtagagagtcgtcacgaggactacagcccggaggctacatcgcaccctgaacatcgcgggcctagtgggctccatcgatagacgacttctgggtgcaccgagtagtgaccatcggcacggactcggcctccaccgcatcttggcaggtcatcgatgccattacccaacactgctcatgagccaccagaggaccttcggtgcttggaagtgatgggccggcactgcggggtacctggcgctggtatcttgcactgggctcaggggccgactggttgttaatccccgaggctccacccgaggacggtgcgagaacttccttgtgtgcgaggctggtggagactcggagcggggtccgactgagcgtcatctcttcgctgggggtgcctggccggaggggagccttcgtcttggggaggctgtggtcaggtggctgccccgtttgtggcttgggggggcc

SEQ ID NO: 713854 - DNA, 263 bp, Homo sapiens
catcccagacttgagaggttgagatgggaggattgcctgagttcaggcagtttgagtccagacgtagcacatacggcgcaaagctccgtctctatcatccacatactaaacattagccatgtctggtggcacacgcctgtggtctcagctatttgggatgctgagattggaggatcacttcaaccttgccaggctgaggttgcggtgaactgagatcgcgccactgcactgtatcctgagctcgaattcttcttaattgataa

SEQ ID NO: 713855 - DNA, 1964 bp, Homo sapiens
  misc_feature (1435)..(1435): n is a, c, g, or t
  misc_feature (1904)..(1904): n is a, c, g, or t
gctcatctaccccatgatcctcgtctctccggggcttcccatggccgcacgacagtggaccaggggaatgtcctgacgagtgcgtgcagcacactgacgattcacatcttcaggcgtagccgcatggcactgatacatagcatcaggagctcttgctctatcatagggcggtgacggcgtcactgatgaggaggaagcgggcctccgggtgctgtcatcgaatcctcgcgaggctggtgcatgctacgtgtgcctaacgagccatccaggtacgtctgcacgctttgagctcacacgcctgactgcgggcgcctgagtttgtcgtctccctcttgcgatgtcccctgttgcgtgcgcgtgctatgcctcacgtctcatcacgcagcatcatcgcgtatccggtattgataagcacgcaattgtcgtcgtgaggcataccctcggaacgcttagatgccttacggcgtttagcccctgtcggatctaggcaccaccgctatctcatctaagaggttcacattctcaggcaaacagcaaagggcacgcaaatcgcggcgcgccaatggctttcgcacatggggaaccctctccagaatttgaacctgtccgtatcggccccaacagcgttttccacttcactagggccagcccgatagtcacccagcaagccctcggcatgaccgacgtcacgggacaacccacacgagctacggcctggcgcaccctggaccgcgggaaggtcttggtcggtagggcttaggcgtttggcctgtcacgacatgccatcactgaccacgctacccgtgacatgtcaccactacacccctgacctttttctcgggagagcggcgccttcggtttacactgaacggtcctaagtgcacgggagttccctggcgggcaagcccgtgggagctaccccgttggggcctgtgtgccggacggcacccagcatttggccccgaaccctccacgaagctgggacgcactaacggtccacgggccaagccgtaccctacgctggccggcacagccgccccggcaagcatgagggcccttggggcacggcggaaacgcaacctccgctctgtatgtcccacactcccattggccccaaggggccggaccgcacccttcacatttgcacacctcgcacgcggaaagcaagcgttcgcccattgggaagggccgcggcattgcacgtatagccggtccccgcaagggacgaccctagggcgtgttgcagctgggggaacacggcctggcggcctcaaccacgggtgcgcgcccgcgcaccgcaccgtggcctggtgttcatcacttcagccctactgggctgtcccctgggaagagcctctcgcacgaccacagacagccaacaccggctacccacgccgcttgcaagctggccacccggcacacagtccttcctttncttcccctgtgcgcacggacaccacgtctggacccccgacacgcacgtgaggaattcgcgccgtcacgcctgccgcagcgcgcgacaccatcccacgtctacgcacagcccgacatctcctccgcggtcacacatagtcaccgcctcaccacccaaatcccactgaacctcatctccccccctcactaccccacactgcaccactccccgctcccccacctacaacctacaaccgtgcctcgcccatataccaattccgctcatccaccactaccagcacaattacatcccatcaaccccccctcactccatcactactacacattccctactcgccttataacactcaaccctgaatcatacccactacactacccgagttccacaaccaccgccgtcatcatgctccccccttctcctacaaatctctgcccaatcacatccgctcgccaccccttcactcgcatcntacatacactccactaccgcagacgtactatcacactaatatgtcgactactatactcac

SEQ ID NO: 713856 - DNA, 752 bp, Homo sapiens
agcgcggctcgaatccctgcccgcgagttttgtgtttcgccccctcccctggggtcttgcttgttcgtcccccccgcggggagttccccgccggggggtcccgttacttcactagaaactccccgggtgggtctccccactcccgctatatctctctgtgggggtgcacccccggcagcgggttgacatttctcctgggggcaacaccctttgtggtcccgggagccgcttatgctgccgcccctcggccgtcttcgcccccggtaattgttttgtgcccgcgcaatgcacagcagcagaagtggggtcacaagggtttgtcaacccgaggcgaacccaattggtgggcgccataggcccaccactggtggcccgcatgtgtgttttccgcacaaacagaggcgcgcacccacggcgaccattcgcttcgcctcttctgtgttgtggcgggctttccgccccccttgggttgacactgtacagcgtgggtcatatctcgggggccgttttttccaacctagtccgaagggatcgatctcccacgtgctcttgttgtggagtttcttcaacgcagggatgggcccaaccttttttgagaggtgccaccaccatcgacagcgtctcgaagtaaagttccacttttttccacgctctccaccagtggtcaccaagacccatgtctttcgaggggcgaaatttgcgtcattggcctcccctgaccaatacagggcgtcctcccaaagtcaaaaaca

SEQ ID NO: 713857 - DNA, 223 bp, Homo sapiens
cgggggcggaccgggtgggggcgggccagcgggggcgggactggaacggagccgtgcggcccgcgcgctcgcagtctgtctcccgccgtcccacgcacgcgtccggctcacgcgtcggccgcgggatcggaggttggcagctataggcgatgtgtcagactgatagctcactgtcccatcgacgatcctatagagcgcaggtctgaatgacatccccccccct

SEQ ID NO: 713858 - DNA, 137 bp, Homo sapiens
agtatgagctcaacagagtgaggtgtatcgcgtgctgacgcccttagcaggggcttggggcagcccagcctctcctccacccagaccaagatgccttaggagctgcctgcgcttcttccatctgagaaagcaccctc

SEQ ID NO: 713859 - DNA, 672 bp, Homo sapiens
  misc_feature (541)..(541): n is a, c, g, or t
  misc_feature (574)..(574): n is a, c, g, or t
  misc_feature (592)..(593): n is a, c, g, or t
  misc_feature (602)..(602): n is a, c, g, or t
  misc_feature (648)..(648): n is a, c, g, or t
  misc_feature (653)..(653): n is a, c, g, or t
  misc_feature (656)..(656): n is a, c, g, or t
aaatgaatgatccaaaacctctttagagactggatgttggatgcagaatcctaggaggttctagccacacctgtcccttgtccttcagaggctgacatccatgtttcatccccccactacctcttgcccctaaagccaccccacctcatgcaactctgaagctctttggccaccagaggattctcagggctcctttgtcctggactgtggaactgggggcagctggtccctggggtctctgaagtcagtgtctccctcactgctcactgccatggtgtctctgcctctgcttctctgtgtccctcatcttcctcccacttcattctgactggcaagccctgtcctgcacagcttcttcccccacccctaggccttccccagacactccctctaactaggctggctgttctgttcccttcccgctaacactgtggcctggcccacctcccaggaaataggaaaggtgcagaaatcacctggagttgccactcctgccaggcttcatctcgagccaatgtccccaggtcactaagagaatgancttccactgtattcccatccagggctctttccntttgtgaggctgacctgnngacaagacnatgggacagggataggcagttcctccatccattcataattgccagncaagntcntctggcctcctgcaga

SEQ ID NO: 713860 - DNA, 296 bp, Homo sapiens
  misc_feature (69)..(69): n is a, c, g, or t
ccagttcagtggatcatgcttgtaatccgcagcatgttgggaggctgaggagggtggacccacttgagncccaggagtttgagatcagtctgggcaacagggtgaaaccccgcctccactaaaaatacaaaaaaaagaaaaaaaaaaagaaaaaaatagctggccattgtgacatatacctgtaaccgtagctactctggtggctgaggcttgagtatcgcctgggaggcagaggttgcagtgagccaagatggcactgctgcactctagcctgggtgacagtgagactgtcttta

SEQ ID NO: 713861 - DNA, 370 bp, Homo sapiens
  misc_feature (353)..(353): n is a, c, g, or t
ttccagttattatgaaaatattttaaaatctctgcttctgtgaatttgttgaattgctgattttaatgatttttcttatattaaaaaaaaaaacacaactgtgacccttttgtatagcaaatgctttccccattgtccacaatatatatttgccttgtatctcttaggattcttttgtttgcaagtacctgaaagcaaaatctcaaactggcctaaatgataattgacttctgtaactaaaacgtccagagctaggggctgggatttaggataaggctatattgctttgggctccattaattaatgtccaataggtgtccccaaaggaccccaattttttcccttccattctngtctttagggggggtca

SEQ ID NO: 713862 - DNA, 735 bp, Homo sapiens
  misc_feature (28)..(28): n is a, c, g, or t
  misc_feature (36)..(36): n is a, c, g, or t
  misc_feature (53)..(53): n is a, c, g, or t
  misc_feature (95)..(95): n is a, c, g, or t
  misc_feature (142)..(142): n is a, c, g, or t
tgaatggcttggcaatggttttggtggnccagtccngatttaaggtaaaaccngactggtcataaaagtgggtacgggtctttattaaagcaacnagttccccagttgtataccatgctacccacggctctcccctttctcnaagataaggattgggacttaattagcaatgttttactttccataaatagggcatgtcacctcaaacctactaaatggttttatacttagatttatataactgggcatatgaatatgcttaaacactgggaaaattctatcactgtctcagaaacaagaagactcaaatgtgtttcagtttgtgttcactggcctctttcaggtcatggctaaccaccaggaggcaactgtctattcttgacagtgcagttttaattagaattccctacatcaaggatgttgccttttactattgaaaggcatttactgtggtttatgtatgatatcaaataaagagtatttaacacttctttatagttgatctgcaaattaaaatgcttttagaaacaagcaagttaggccttttaaattctctattttctaagactaagttgtaaatcagaattgtccttaaatacccactcagaaacacacataactggaattcgattaggaatggcactctttgctaacttactagatggaaagatggaaataaaggaaatagtttgtatcagcagacagtcagaagataattaaatcaatcccaaatca

SEQ ID NO: 713863 - DNA, 1489 bp, Homo sapiens
gactagttctagatcgcgagcggcgcccttttttttttgtatttttttatagtggaaaaggggtattcagggtggcccagtgggtggagggcagggggggtgacactctctagagttgcgacaggggctttatcccctcgcggggcatcaagcaagatagcatctccaactcatcagccactttcgaacttaacgagggaactataacgttttgcgagtaaccattggcgagtcatagttgaattttgtgtggtaaagattggagcctcttcacatattgttcaccgcaggtgttgggtctctaaaacctcgcgtgaaacccataataaattcttccttattcgtaccagcctcccaagaggtgcccgagggttctacgaaacaatgtggagacccaagcgtgggccagtggtcaatagaacagtgtaagcacatatcaccaacggtgggccaatttcatcacgcgtggtcggtggcacccagggggggccacgcccaataagaaacaaagagaagagggcctccccgaaagataaactctcacctgtatctcacaaaagcgcgcgtggtaagaccctctgtggggaaatatactctccgcggtgtgtgtgcacaggcttaaccaaaaggactgtgggaattctacaatcgatgtggtgaagggagatgtatccactgctcacggggtgtctccaccaatttggtcgcacctcaatcttaatccaagaagacaaggtggtgagggggggtacaacattccccgtgtaatagaaaccgccgtggagaacattccagcggggggcaaatcacacaaataccctagctggtgacccacaagaggcccgtcaaaggagggaggcgggtcctcaacaaatttccaaagacaaataaagtcaccgatgaaactctatagagaagcaagcgccccactatgagctcgcaaaatacgcagagcggtatttaacccaaaaaggtgacagacaatagggcccgccagagggaacactgactgcacaacgccacctaacacaacaccccgccttttggtgggcgcacacacaagagaagcatctcatgtcgaggcgaaaccaactaatacacactttgggcgggtaggagaaggaagcccgcaacactcatggggagacagaacaaaaaaacgccgcggacccacccaaataaaaaaattttcacacccagcgagcgaattactaacaatagagggaacccacgaggggaggatataccacccaggacaagcccaacatacaccaaggcgggtatacacgaaagaacaaagcgaagacctcgttgagggagacagactagaggagcaccaagagcggggatgcccaccagccgactgaaccaaacacagaacacatcaagacggaggaacgacgcaaagaacaaacgaaacaacagcaatcgtgaagaggacacgacagtagtgataaacaccaagcaggtcaaccaaacgtttgcaaac

SEQ ID NO: 713864 - DNA, 411 bp, Homo sapiens
ttgagctcggtacccattcgtgtcgacaaacccacagagtctaagagctaccaaacctgcattaaaagatttcggtcgggagcgacctcggagcagaacccaacctccgagcagtacatgctaagacttctccagtcaaagcgaactactatactcaattgatccaactaactatgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggacggtttctatctacttcaaattcctccctgtacgaaaggacacgaatgttca

SEQ ID NO: 713865 - DNA, 201 bp, Homo sapiens
ggtcaagaactcattgtttttgcacatgaacaatttgggacccgaggacacggctgtctattattgtgcgagagaagggtggagttgtagaactaccagctgtcctgtggactcctggggccggggaaaccctggtcagcgtctcctcaccatccccgaccatgccccaagagtcttccctgctgagccatctgcagcacc

SEQ ID NO: 713866 - DNA, 536 bp, Homo sapiens
  misc_feature (16)..(16): n is a, c, g, or t
  misc_feature (18)..(18): n is a, c, g, or t
tgacacttgactcctnancctacatctatagcttggcacagagagattcacgcaccctcaagagtgtgggtgagacatatacagcctgttagacctgaaggcagatggctcttcttaaggccaataaggatctcatttccgcaggattgaaggagttcagcgttctgctgaatcagcaggtcttcaatgatcctctcgtctctgaagaagacatggtgactgtggtggaggactggatgaacttctacatcaactattacaggcagcaggtgacaggggagccccaagagcgagacaaggctctgcaggagcttcggcaagagctgaacactctggccaaccctttcctggccaagtacagggacttcctgaagtctcatgagctcccgagtcacccaccgccctcctcctagctcagggacccagcccctcctctctgagaaactctgaccttcatgtccttaggctgtgctcctgccactctaccctgacacctcaataaagaccagtgctggttttgttggaaaaaaaaaaaa

SEQ ID NO: 713867 - DNA, 769 bp, Homo sapiens
  misc_feature (16)..(16): n is a, c, g, or t
  misc_feature (18)..(18): n is a, c, g, or t
tgacacttgactcctnancctacatctatagcttggcacagagagattcacgcaccctcaagagtgtgggtgagacatatacagcctgttagacctgaaggcagatggctcttcttaaggccaataaggatctcatttccgcaggattgaaggagttcagcgttctgctgaatcagcaggtcttcaatgatcctctcgtctctgaagaagacatggtgactgtggtggaggactggatgaacttctacatcaactattacaggcagcaggtgacaggggagccccaagagcgagacaaggctctgcaggagcttcggcaagagctgaacactctggccaaccctttcctggccaagtacagggacttcctgaagtctcatgagctcccgagtcacccaccgccctcctcctagctcagggacccagcccctcctctctgagaaactctgaccttcatgtccttaggctgtgctcctgccactctaccctgacacctcaataaagaccagtgctggttttgttggaaaaaaaaaaaatttccctatataatacattattctttcattctatatctatatactttattcttacaattaaaaaaaaacttttgggccccttgggcccaatcgacttataaattcgacaaagtttatccatgcgtccgaaattcgaactcaattggcccaatttcccttatatgggagcgtattacaatttaattggccgcggtttcggttgacctggtcccttgggttacccattttcgttt

SEQ ID NO: 713868 - DNA, 1025 bp, Homo sapiens
  misc_feature (16)..(16): n is a, c, g, or t
  misc_feature (18)..(18): n is a, c, g, or t
tgacacttgactcctnancctacatctatagcttggcacagagagattcacgcaccctcaagagtgtgggtgagacatatacagcctgttagacctgaaggcagatggctcttcttaaggccaataaggatctcatttccgcaggattgaaggagttcagcgttctgctgaatcagcaggtcttcaatgatcctctcgtctctgaagaagacatggtgactgtggtggaggactggatgaacttctacatcaactattacaggcagcaggtgacaggggagccccaagagcgagacaaggctctgcaggagcttcggcaagagctgaacactctggccaaccctttcctggccaagtacagggacttcctgaagtctcatgagctcccgagtcacccaccgccctcctcctagctcagggacccagcccctcctctctgagaaactctgaccttcatgtccttaggctgtgctcctgccactctaccctgacacctcaataaagaccagtgctggttttgttggaaaaaaaaaaaagaaaaaaaaaaaaaaaaaaaaactaaaaaaaaaaaaaaaaaaaaaagaaaaaaaagagggggcggcgccgctcaaaagataacacacaacagggagccaaaaatataagcagacacagacagatgtagagataaaaaggggcgacccacaaagaaaagagagcaagaacaacgaaaagagaaagcggagcacaataataaaacacgacgcgagcgtcgggcgaaaaccacacgagcaccccgaggagacctaagggacagaggaacccaccaataatgccggggaggggtgaacaccaacaaacgggggaaacacaccacctcgcgcgacacggaataaggaagcgccccaggaacaaaacactgatcgcaagttcatagcggggatgcaacgaagcgtgcggcaaaacacagagaagaaaaagagcgagggacgcaacgcgacgaaaatacgcgccacagaactagagcaggaggcgaacaaacacag

SEQ ID NO: 713869 - DNA, 229 bp, Homo sapiens
cttttttttttgggggggggggggggggggcctcttgaggcttttttttttttccaaagttagtttgtgatccccgattccctcccattgaagtgtttctttgtccgaattttttttcctttgtgtgccctgctagattccctgggtggagctgttccttttttttttgtaaattttccccacctttacataaaatatttcataataaaatatttttgcatccccctta

SEQ ID NO: 713870 - DNA, 751 bp, Homo sapiens
  misc_feature (16)..(16): n is a, c, g, or t
  misc_feature (18)..(18): n is a, c, g, or t
tgacacttgactcctnancctacatctatagcttggcacagagagattcacgcaccctcaagagtgtgggtgagacatatacagcctgttagacctgaaggcagatggctcttcttaaggccaataaggatctcatttccgcaggattgaaggagttcagcgttctgctgaatcagcaggtcttcaatgatcctctcgtctctgaagaagacatggtgactgtggtggaggactggatgaacttctacatcaactattacaggcagcaggtgacaggggagccccaagagcgagacaaggctctgcaggagcttcggcaagagctgaacactctggccaaccctttcctggccaagtacagggacttcctgaagtctcatgagctcccgagtcacccaccgccctcctcctagctcagggacccagcccctcctctctgagaaactctgaccttcatgtccttaggctgtgctcctgccactctaccctgacacctcaataaagaccagtgctggttttgttggaaaaaaaaaaaaattttataaccttttaattatatatattatctattttattctataatacttaatataaacctcacttgtccaattactccctaaaaaaaaaaaaaacattttggcccgcttgggccatgcaatttttaacttggcaaacttttttctagggcgccgatttgggcctattttggctttccccctatgggaggttgttttttacatgggcccggttt

SEQ ID NO: 713871 - DNA, 538 bp, Homo sapiens
  misc_feature (16)..(16): n is a, c, g, or t
  misc_feature (18)..(18): n is a, c, g, or t
  misc_feature (506)..(506): n is a, c, g, or t
tgacacttgactcctnancctacatctatagcttggcacagagagattcacgcaccctcaagagtgtgggtgagacatatacagcctgttagacctgaaggcagatggctcttcttaaggccaataaggatctcatttccgcaggattgaaggagttcagcgttctgctgaatcagcaggtcttcaatgatcctctcgtctctgaagaagacatggtgactgtggtggaggactggatgaacttctacatcaactattacaggcagcaggtgacaggggagccccaagagcgagacaaggctctgcaggagcttcggcaagagctgaacactctggccaaccctttcctggccaagtacagggacttcctgaagtctcatgagctcccgagtcacccaccgccctcctcctagctcagggacccagcccctcctctctgagaaactctgaccttcatgtccttagggttgttgcttccttgccattttttacccttggacaccttnatttaaaggaccagttgtttggttttttgttt

SEQ ID NO: 713872 - DNA, 828 bp, Homo sapiens
  misc_feature (308)..(308): n is a, c, g, or t
ctgttttcctagcgcaaggagcacgcagtgaccctgtagcagcatggcgccagccgaatgcatggtctgaagccacttccacaagactgcagcggcgcgtggcacgtggtcaaccagctggcccgtaaatccgcagacgtaaggcccggcaagcaggcgcgcgatcgcccgcgctccggtggtccatccggccatcgtgcgctgcccacggttcggtaccacacgaaggtgcgcgcgggccgcggttcagcctggaggagctcagtgtggccggcattcacaagaaggtggcccggaccatcggcatntctgtggatccgaggaggcggaacaagtccacggagtccctgcaggccaacgtgcagcggtgaaggagtaccgttccaaactcatcctcttcccaagtaagccctcgtgccccaagagagggagaccagttctggctgacagaacgtgaaacgtgcgcacccagctgaaccgtaccgggttcatggcccggtccggaagcgtctataagaagggagaaagctcgagtcatcacttgaggcaggacgaagaatattcaaagcccttcgcgtaatctcccgttatgcgccgtgccaaggcccgggctctgcggcaatacgggcaaaaaggagccaagtgatgccgcaagaaccaggattgttcgacacgacaatatagaggcctccttggggacttgggaagtccacaaaggctacaggcggctgcattctgtatccagcggccaaggtcccccccaggtccaactgggcgcgcccctagttccggaccgtttcggcccagctatagttagcccttcacaag

SEQ ID NO: 713873 - DNA, 110 bp, Homo sapiens
gagagtgacctccattgagaaggctgaatgtgacttgcctgattaaaaggaccgagaggccaatgagtgaccatgtcctgtggagatgtagatggtgcatcctgtggtga

SEQ ID NO: 713874 - DNA, 513 bp, Homo sapiens
  misc_feature (85)..(85): n is a, c, g, or t
gaagtaatggtggagttgatggaaacaacgagagacacgggatacaatgcagaggaaagagaatgtgagagttggtgctgtggcntattctagtattcccgaatcccattgctgaccacattctcccttgccaactgcctctccgcaaccccccaggtcttcaatgatcctctcgtctctgaagaagacatggtgactgtggtggaggactggatgaacttctacatcaactattacaggcagcaggtgacaggggagccccaagagcgagacaaggctctgcaggagcttcggcaagagctgaacactctggccaaccctttcctggccaagtacagggacttcctgaagtctcatgagctcccgagtcacccaccgccctcctcctagctcagggacccagcccctcctctctgagaaactctgaccttcatgtccttaggctgtgctcctgccactctaccctgacacctcaataaagaccagtgctggttttgttggaaaaaaaaaaaa

SEQ ID NO: 713875 - DNA, 357 bp, Homo sapiens
gggggaccctttttccccccccccttttggttttcccggttcccttggagggagaccctttttccccccggtggcccggcccccttggggaaaatttccggaggtgggccggaatattggggtcctaaaaatcctcccccccccgggtggggggggaccccaggggaaattttttcccccttttttttttaatttgaggaaaacaccccccctttctctggaaggggctagggaaattccaaagggggggaccccggggggcctttcccttttcccggcccccccacttttaaagccagcccctttttttttcccctttgaaattccccaagggccttaaaataaattttttttgga

SEQ ID NO: 713876 - DNA, 392 bp, Homo sapiens
tgctgaatcagtcttcattacctcccaatctgatgaaacgatataatatagtaacatttcccagaatggtggagtacattattttatcgtatatttttgtccgagctatgagctgacggtggtattgcttctctgcattttatcagtgtgtacatctagtgcttttcatgtgtcatttgtgagccactaatgcaaagttaccatttgaattcagtcaggctacagggtggtgtcagtctaggtctttcaggtggcggagaaattggttagggctcccattgccaaatgcaagcagatagcataacctgactgttatgttccctcaggcagcatgctttgggacaactctttggcctgggggacatctgtgtcacagtccagaattgccgcga

SEQ ID NO: 713877 - DNA, 1224 bp, Homo sapiens
  misc_feature (365)..(365): n is a, c, g, or t
gatctcgccctccggcctctccttttttttctccccccccgcttacggggccccctcccgccgcttgacttccaccgggccctccggccccgcctccgggaacccaccttggcgattaaaagcaaccccgggttttagaaaagcaccagtggggaccctctttctttgaaccctattggccaaactcccccgggaagcacacaactttattggggtgccctttttggaaaatgaggagaatgggaaaaggttttaatttttttaaaatgggtgggtaaattaatgggaagaaatcgtcccccacggtataaagaaaccttgtaagggggtctcagaatttgacccctctcgcccctccttaggtnaattccgaatcccagatctccccgaaagagaatatccctgggtttaaatttcacgcgaacagggagtttatacccccccaatgtctcaacctctccctgagaaaacgacccacgcgaccacgttttaaataagaaaacgcgctttttaaacacaccacgccccattgggagagtttataacaccccgttttcctcccacgagattattctctccccctctcccaacctctctcaacagaaaagaggaataaaataaatccctcactggaacacccccaagacttccccgccctcttctggagcccactttttggatatttctctccctcttactcgtatagcccccagccaatatttaagccgcgtctttcttcacacctccccactcccattgtgggagaccccatatgtctctactccacaagagaaagagaagagatttccccagataaatctctggtagacagccttctctggtcccacagagaatttactccccaggagaagaactccacatggacctgttaattagagggggaaccggtcttaaaccatatttcttaaaagatggtgttcttgccagatgcttataacagttatatggtgccaccttgggaatagcccaattggagccaccataccattggaacaccatatgttgctgtccaccccaagggactttccagaaaaattgcccagagaaatgggagagccgtgaaacatcccgtttgtgaaaactgagaaatccggctcgccacttccccatcttttcctccgtttgtccacgccaattgggatgaacgcccacccaaagatctttgcttaataagaagaaaaaagaggccacaggagaaaacga

SEQ ID NO: 713878 - DNA, 452 bp, Homo sapiens
  misc_feature (26)..(26): n is a, c, g, or t
tggttttttcacaatcttctcaacanaaaacttcatctatcctgccaccctgcgcatcttgcaggtagccctcttgttttgtcacacacatccttcagcagctgggaaacgaacacgaatccttcccaaccatgatgccaataaacaattcatcttaaaaatgttagcctctaactggacgaaaaattctctcgccatcttaataacaaaataaactacaaattcctgacccaaggacactgtgttataagaggcgtgggctcccctggtgcgtgaccaaatcagctgcactggcacttacaccccatctgcatgcagcacagaagggtgtgaccatgccctcaacaccactctagtccccactgaacggcaactgagactgagagtacctggagattctgaagtgcctttgctgtggttaacaaaataataaagattatagtattcaactc

SEQ ID NO: 713879 - DNA, 104 bp, Homo sapiens
acacgataaccagagccaagataaggctaagcggcacgtcgctcacccgtatagtcgtactccacgcgacccagcacccactcgcgtagagcctgaacttcaca

SEQ ID NO: 713880 - DNA, 211 bp, Homo sapiens
ccaccccttggcttttgggaattgcccttttgggcctttggggtttggaccctgctttgggtcattggtgaaacttggaaggggcagccccccctggttttttggttttggggttgccaccccccgggtatcccttttaatttttgggggggggtcagtcccgcctttactgtttttccaaagcccggggggggtcccccttttttttccc

SEQ ID NO: 713881 - DNA, 388 bp, Homo sapiens
catagtcgattcttgagctatccccctttgttgatggcagtggtcgttgcattaaccatgaggctctgctatcgagatggcacgtggataacaccttaggctagcacaaatacttcgagatcctggttctgctgcatagactgacggggagcatgtacctatgttgctcaagcatgctgaggccgccactcttgctgctgctgtcttagagggaggctctatgaagctctcaggtgtggctagctgaccagctgccggagaaaagctggctaccattgcacctttcccaagtggttgtgtctgtatttggtcatgctgtggggtcacctgagtttctggagaagatcaacgcttgggagggatgtgccagctgtgttcgtcacgttca

SEQ ID NO: 713882 - DNA, 496 bp, Homo sapiens
ataataaggactgacacccctttttttttggctgccaaaaaattctaagaggaagactttaaacttacctttacttatcacatgttgataatagggataaactgggaataaccttaatgttcaactataaaaagaagattatttcatttatttgtttgcagtctctcttttttatagaatgtaagatttattttggtttgccttcacatgtgtaacatgcaacacaggacctggcctagagttttcatttaagaacatttgtggaatgggtgaagggatgaatgatactggcatttaaaaatactttacttgaaggcagcatgctcgttaagagtcatcaccactccctaatctcaagtacccagggacacagacactgcggaaggccgcagggtcctctgcctaggaaaaccagagacctttgttcacttgtttacctgctgaccttccctccactattgtcctatgaccctgccataatcgccggtcacgagat

SEQ ID NO: 713883 - DNA, 1060 bp, Homo sapiens
cagtggatgatgcacaggaaattcttcactccagatttccaatgccaagatacattgacactgaacatggaggcagccaggcccgtttcctcctttcaaaagtcaacccttcacagactcataataatatgtatgcctgggggcaggagctctggagcacctattcttacagatgatgttagtttacaagtgtttatggatcacttgaagaaacttgctgtgtccagtgctgcttgcaagtgctaataatgttacaagacacttaagaagatgacataatattcaaatttcattttttcctttttccatttatctgtggcaaaccaacagcatattgctctatatttacagtcattacgtatggttcgagacaacatatggcaacatgttcacatctgtcagattaagctggcacatcctcagtgcagagcaatcaagaaccaatttatcatcggcttaccacagatgttatacgctggttctacgaacatttgaacgtctttataactttacattcatgtttacactacacacaaatacgagtctgcctcgtaccacaagatgtacacctcattcgctatacttgcagacagaccccaaactggccactgaacttactggctcacctattaaacactggtccgttaatattagacagaaagcaaagaaacattagtacgaatcaagtgtgacacattcaagctctacgtcgcatcattactggaacaccagccactcatgaatacacactgcacaggacataccaggaaagacacatacaccacacacctggccaacaaaactggaccacaaaagcgcaccagaaggacagaaatggcacgcggcaactcggcacacacgcgcgacgacacggccagggccacaacccaggcccgagacaaggcagtctcaacaagcacactctcaaccgacaaataaagagcccaacaaggacgacgcgagaacaacaccagacacaggactacacaacacagaaagactccaccaagcgacaacaacacgaggagcctgcaggtaccctatcttgaccatcgtacag

SEQ ID NO: 713884 - DNA, 1024 bp, Homo sapiens
  misc_feature (316)..(316): n is a, c, g, or t
  misc_feature (649)..(649): n is a, c, g, or t
  misc_feature (679)..(679): n is a, c, g, or t
  misc_feature (684)..(684): n is a, c, g, or t
cagccttcctgagcacctttccttctttcagccaactgctcactcgctcacctccctcctctgcaccatgaccacctgcagccgccagttcacctcctccagctccatgaagggctcctgcggcatcgggggcggcatcgggggcggctccagccgcatctcctccgtcctggccggagggtcctgccgtgcccccagcacctacgggggcggcctgtctgtctcatcctcccgcttctcctctgggggagcctacgggctggggggcggctatggcggtggcttcagcagcagcagcagctttggtagtggcttngggggaggatatggtggtggccttggtgctggcttcggtggtggcttgggtgctggctttggtggtggctttgctggtggtgatgggcttctggtgggcagtgagaaggtgaccatgcagaacctcaatgaccgcctggcctcctacctggacaaggtgcgtgctctggaggaggccaacgccgacctggaaggtgaagatccgtgactggtaccagaggcagcggcctgctgagatcaaagactacagtccctacttcaagaccattgaggacctgaggaaccaagatcattgcggcaccatatgagaatgcgcagcccaatttggcagatngacaatgccaggctggcagcgatgacttcnggacnaagtataagagctagaccttggcctggaggcaaactgtggaggcagaacgtcaatggcctagagccgggagaacgaaaaaagctgaacgctggcaaggacatgaccgtgaagatgcagattcagaaagagccctagaagggaggaacgtggacctacccatgaggaaaaaacacacagcaaagacaggagaagtcaagggcacagaagacgggtcaacaccggagcgaacaaatgagacacggggaagatgggagagctgaaacaggacgagggaccccgaacccgcaaatcctgaacagaaagacgtgaccagaacgaccgaaaagcagaaaaaaaaca

SEQ ID NO: 713885 - DNA, 1098 bp, Homo sapiens
  misc_feature (316)..(316): n is a, c, g, or t
  misc_feature (802)..(802): n is a, c, g, or t
  misc_feature (805)..(806): n is a, c, g, or t
  misc_feature (829)..(829): n is a, c, g, or t
cagccttcctgagcacctttccttctttcagccaactgctcactcgctcacctccctcctctgcaccatgaccacctgcagccgccagttcacctcctccagctccatgaagggctcctgcggcatcgggggcggcatcgggggcggctccagccgcatctcctccgtcctggccggagggtcctgccgtgcccccagcacctacgggggcggcctgtctgtctcatcctcccgcttctcctctgggggagcctacgggctggggggcggctatggcggtggcttcagcagcagcagcagctttggtagtggcttngggggaggatatggtggtggccttggtgctggcttcggtggtggcttgggtgctggctttggtggtggctttgctggtggtgatgggcttctggtgggcagtgagaaggtgaccatgcagaacctcaatgaccgcctggcctcctacctggacaaggtgcgtgctctggaggaggccaacgccgacctggaaggtgaagatccgtgactggtaccagaggcagcggcctgctgagatcaaagactacagtccctacttcaagaccattgaggacctgaggaacaagattctcacagccacagtggacaatgccaatgtccttctgcagattgacaatgcccgtctggccgcggatgacttccgcaccaagtatgagacagagttgaacctgcgcattgagtgtggaagccgacatcaatggcctgcgcagggtgctggacgaactggaccctggccagaggtgacctggagatgcagattgagagnctnnaggaggagctggcctactgaagnagaacacgaggagggccatgcaatgccctgaaaggccaggtgggtgtcgattgtccactgttgcagattggacgcgtgactcttggcggtggaccattaacgcggcattcttgaaccgagaattcgtggaccactaattgagcatgaatgcagcagatagaccggcaaggatgccgaggcagtgtttcttcagcaaagcacggtggatcttgaccgggaaggatgacacacaaaggtaccttgtgtgcagtcggcaagacggacatata

SEQ ID NO: 713886 - DNA, 360 bp, Homo sapiens
attcatcttaaggcacacatatttaaaagtaaagtgaatgaaaccatttgtgattcagatacatagacagaacttccatgtagaaaacaaaaaagaccttgctgggaaacagatgatgcgaaacatggtcaaacatttcacagacgcacaaaaagctcacaatgtaaacagggattaagctgcgtctgatttagccccgtaacatcaaggtttcattttgcgtcagcctgagatctcgctcaaattcaaactgcctgtgatccactcggtcgaggaaggctttccgattcaggtaccccctctttccctcgattatggatggccagttcttcaccaatcccctcttcctccttgaagctc

SEQ ID NO: 713887 - DNA, 1127 bp, Homo sapiens
  misc_feature (30)..(30): n is a, c, g, or t
  misc_feature (49)..(49): n is a, c, g, or t
  misc_feature (345)..(345): n is a, c, g, or t
  misc_feature (831)..(831): n is a, c, g, or t
  misc_feature (834)..(835): n is a, c, g, or t
  misc_feature (858)..(858): n is a, c, g, or t
ccgggacaggatatcacatgaggaaagtcntatcaccccgtaccaaagncacctagaacattggcttcagactcgctcacctccctcctctgcaccatgaccacctgcagccgccagttcacctcctccagctccatgaagggctcctgcggcatcgggggcggcatcgggggcggctccagccgcatctcctccgtcctggccggagggtcctgccgtgcccccagcacctacgggggcggcctgtctgtctcatcctcccgcttctcctctgggggagcctacgggctggggggcggctatggcggtggcttcagcagcagcagcagctttggtagtggcttngggggaggatatggtggtggccttggtgctggcttcggtggtggcttgggtgctggctttggtggtggctttgctggtggtgatgggcttctggtgggcagtgagaaggtgaccatgcagaacctcaatgaccgcctggcctcctacctggacaaggtgcgtgctctggaggaggccaacgccgacctggaaggtgaagatccgtgactggtaccagaggcagcggcctgctgagatcaaagactacagtccctacttcaagaccattgaggacctgaggaacaagattctcacagccacagtggacaatgccaatgtccttctgcagattgacaatgcccgtctggccgcggatgacttccgcaccaagtatgagacagagttgaacctgcgcattgagtgtggaagccgacatcaatggcctgcgcagggtgctggacgaactggaccctggccagaggtgacctggagatgcagattgagagnctnnaggaggagctggcctactgaagnagaacacgaggagggccatgcaatgccctgaaaggccaggtgggtgtcgattgtccactgttgcagattggacgcgtgactcttggcggtggaccattaacgcggcattcttgaaccgagaattcgtggaccactaattgagcatgaatgcagcagatagaccggcaaggatgccgaggcagtgtttcttcagcaaagcacggtggatcttgaccgggaaggatgacacacaaaggtaccttgtgtgcagtcggcaagacggacatata

SEQ ID NO: 713888 - DNA, 356 bp, Homo sapiens
atgcgggcaagctccatctgctgctgtagtatctcaaacagcatggaaagcatgtatcttctgctccgagtgggctgtcaggagctggtcccgcaggatgaacagctaggtgaatcatgaccagaagctggagctcctactactgctaggctctctatgggtccctttagacatctattggcttccatagagtaaccttcctagaaacctctccttccagtcactaggacaagagcttctctatagctggcatcacattctttcaaatttcggttgaagtcacagcttctcctggattcccagaggcaagcctccgacaatcctggtactacagggtactaggaggcccattaacc

SEQ ID NO: 713889 - DNA, 1302 bp, Homo sapiens
cagccttcctgagcacctttccttctttcagccaactgctcactcgctcacctccctcctctgcaccatgaccacctgcagccgccagttcacctcctccagctccatgaagggctcctgcggcatcgggggcggcatcgggggcggctccagccgcatctcctccgtcctggccggagggtcctgccgtgcccccagcacctacgggggcggcctgtctgtctcatcctcccgcttctcctctgggggagcctacgggctggggggcggctatggcggtggcttcagcagcagcagcagcttttgtgtaagttggcttcggtggtgacggatattggtggtgtggcctatgtggtgcttgtgcttactggtagtgttgtgctatggagttgcttggctattgcgtggtgggttttagctgagtaggagtgattggggcttcatggttggagcaaggtcgaagacaggagtagatcgcattgccaggagaccgtcaattgactctgcgcttggcactcgctaccttgtgacgaatggtgcgttgctcttggagcgaagtgtcaacggccgaggcttggaacggtgcacggatccgtcgaccttggtacccatacgtgcagctcgggtcccaagttgcagatcgagaagcacttacgcatgtgccccttactatgcaacagaacacacttctggagggacccgtgacgttgaacctcaggaatcaattatgcggtgccaccaatttgaggaaattgcagcagagcccaattatagcacagacttttgaccgcaattggccagggctggcgccaaggccgggatgacctttcaggagaccaagggtcagtgacagcatttgcatctgtggcccgttgagggtgcacgaattgtttgcactggaccatgacggtccgattgggcccttgcagcccggggtagccttcggaatgaaagctagggacccgttgggcaccagcgtacttgatccgtgtaacacattgccccagtccgacaagtggccctgcagcacgggaagggacagcgtcgggcccgtcaccgcctgaagagggaccaggaaacccaacggaaggggcaagagctaatgggccgaggagcccacgagagacacggctaagagcacccggggagcaggaggcgagggtggaggcagcgcagcaagcgggcgcagctgcgaggcacccagtgagcagagtggaaacccaggcgccccagcgatccctgacacgagcaaaagcgcggaggagcccggagaggaacgcaggagtggcgagacgacagccc

SEQ ID NO: 713890 - DNA, 301 bp, Homo sapiens
cccttcccctccatgggctttgggccacagtatgaacctttgaggcctgtaaattgttttgtactttcttataagttgtaattgtgaaggtattgtgggtttatttgggtcccctccccagccttctttttcgctcccctgccgtccagttattagttgttttccggcgcggaggttttaaaacccctttgggggttttccctttccccctttggttgggggcggtttttgtcctcctggaaaagaataaaaaaaattaaattttaataaaaaaaataatttttaaagaaaaaaagaaaat

SEQ ID NO: 713891 - DNA, 553 bp, Homo sapiens
  misc_feature (318)..(318): n is a, c, g, or t
  misc_feature (356)..(356): n is a, c, g, or t
  misc_feature (359)..(359): n is a, c, g, or t
  misc_feature (368)..(369): n is a, c, g, or t
  misc_feature (371)..(371): n is a, c, g, or t
  misc_feature (376)..(376): n is a, c, g, or t
  misc_feature (385)..(385): n is a, c, g, or t
  misc_feature (389)..(389): n is a, c, g, or t
  misc_feature (392)..(392): n is a, c, g, or t
  misc_feature (396)..(396): n is a, c, g, or t
  misc_feature (400)..(400): n is a, c, g, or t
  misc_feature (416)..(416): n is a, c, g, or t
  misc_feature (424)..(424): n is a, c, g, or t
  misc_feature (434)..(434): n is a, c, g, or t
  misc_feature (438)..(438): n is a, c, g, or t
  misc_feature (455)..(455): n is a, c, g, or t
  misc_feature (461)..(461): n is a, c, g, or t
  misc_feature (478)..(478): n is a, c, g, or t
  misc_feature (483)..(483): n is a, c, g, or t
  misc_feature (500)..(500): n is a, c, g, or t
cagccttcctgagcacctttccttctttcagccaactgctcactcgctcacctccctcctctgcaccatgaccacctgcagccgccagttcacctcctccagctccatgaagggctcctgcggcatcgggggcggcatcgggggcggctccagccgcatctcctccgtcctggccggagggtcctgccgtgcccccagcacctacgggggcggcctgtctgtctcatcctcccgcttctcctctgggggagcctacgggctggggggcggctatggcggtggcttcagcagcagcagcagcaactttgcgctagctgnctttgcgcgcgcgcgcgatatgcgctgcgctgcgcatntgnctgcatgcnntntgcgnctgcctgcncttntgnctgnctgncattgtgcatgcctgnctgcatgncgcattatgnctgncgcaagctgcagcaagnctgcanaaatgccagcaagcctncagangcagctgccctgcgccntgcctaagcatgcgcacaaaaggctgccgctgcctcctgcgcagcgcagcgcc

SEQ ID NO: 713892 - DNA, 535 bp, Homo sapiens
tcttactcaatgactagtagtagaaaaaaacagccagattgaactccttaaaaatttaaaatgttgggccttcagattgcagagacctcctgcgttaaaaaaatgaaaaaattagtggccctgtagtgaaatgctcacaatagcaatgattgtggtagcccctcaagtcctggggttcactaattaccctttaatgaggtcagtctgccccggctttttccctaccttgggaggaaaagcacacaagacagttggagttcaagtggatcttgctgtatttgcaacttagcataactgctttgaaagcccccagggtgcttaattggggcctgggcatttttgtttggggagagactacacacagctcctcattgtgcttgtagaagccactgtgcatcttggaagcattacatgcttttgttgatggtgcatagttttataaactccaaatgagcttattgctttttaaccattgggagagctaaataatggaagaacctagaagtctttgggttgggtagccgccaaacagaaa

SEQ ID NO: 713893 - DNA, 1125 bp, Homo sapiens
  misc_feature (316)..(316): n is a, c, g, or t
  misc_feature (829)..(829): n is a, c, g, or t
  misc_feature (832)..(833): n is a, c, g, or t
  misc_feature (856)..(856): n is a, c, g, or t
cagccttcctgagcacctttccttctttcagccaactgctcactcgctcacctccctcctctgcaccatgaccacctgcagccgccagttcacctcctccagctccatgaagggctcctgcggcatcgggggcggcatcgggggcggctccagccgcatctcctccgtcctggccggagggtcctgccgtgcccccagcacctacgggggcggcctgtctgtctcatcctcccgcttctcctctgggggagcctacgggctggggggcggctatggcggtggcttcagcagcagcagcagctttggtagtggcttngggggaggatatggtggtggccttggtgctggcttcggtggtggcttgggtgctggctttggtggtggctttgctggtggtgatgggcttctggtgggcagtgagaaggtgaccatgcagaacctcaatgaccgcctggcctcctacctggacaaggtgcgtgctctggaggaggccaacgccgacctggaaggtgaagatccgtgactggtaccagaggcagcgggccttggcttggaggaattccaaacacagggaaaaccgtttaacaagggttccctacttcaagaccattgaggacctgaggaacaagattctcacagccacagtggacaatgccaatgtccttctgcagattgacaatgcccgtctggccgcggatgacttccgcaccaagtatgagacagagttgaacctgcgcattgagtgtggaagccgacatcaatggcctgcgcagggtgctggacgaactggaccctggccagaggtgacctggagatgcagattgagagnctnnaggaggagctggcctactgaagnagaacacgaggagggccatgcaatgccctgaaaggccaggtgggtgtcgattgtccactgttgcagattggacgcgtgactcttggcggtggaccattaacgcggcattcttgaaccgagaattcgtggaccactaattgagcatgaatgcagcagatagaccggcaaggatgccgaggcagtgtttcttcagcaaagcacggtggatcttgaccgggaaggatgacacacaaaggtaccttgtgtgcagtcggcaagacggacatata

SEQ ID NO: 713894 - DNA, 286 bp, Homo sapiens
cctgaatctgtgcccataatctctgtcagtctgctggtttgcaggcgtcattgctgctaagatccggtctttggtccctttgatttaacctgtgacaacagttgcctgcagaaaatgtaattgaatcctgaagggggcattataaatggtgtacagactccatgaactatcttcttgatcctctgcatttcatcatggtcatcctggctccaatcctgaggcttttggcttctcgtatgattcagtctccttgtgcatgggccaattatgattgcgattgccaaat

SEQ ID NO: 713895 - DNA, 505 bp, Homo sapiens
  misc_feature (316)..(316): n is a, c, g, or t
  misc_feature (469)..(469): n is a, c, g, or t
cagccttcctgagcacctttccttctttcagccaactgctcactcgctcacctccctcctctgcaccatgaccacctgcagccgccagttcacctcctccagctccatgaagggctcctgcggcatcgggggcggcatcgggggcggctccagccgcatctcctccgtcctggccggagggtcctgccgtgcccccagcacctacgggggcggcctgtctgtctcatcctcccgcttctcctctgggggagcctacgggctggggggcggctatggcggtggcttcagcagcagcagcagctttggtagtggcttngggggaggatatggtggtggccttggtgctggcttcggtggtggcttgggtgctggctttggtggtggctttgctggtggtgatgggcttctggtgggtgtgtcgggggtctacctgattgggggtcactgcccggagttcagttgggtagcnggtggctggtccagcacaaaaccaacagaccagcat

SEQ ID NO: 713896 - DNA, 1060 bp, Homo sapiens
tggctggggaggcctcagaatcatggtgggaggcaaaagacacttcttacattgtggcaagaacaaaatgaggaagaagcaaaagcagaaacccctgataaactgatcagatctcatgagacttatacactgtcacgagaatagcacgggaaagactggcccccatgattcaattacctccccctgggtctgtcccacaacacgtgggcaattctgggagatacaattcaagttgagatcctgtgggcgggacacaaccaaaccatatcagcatcctttcaagaatattagataattggagctgcagtactcaggaacttgacctgtaagctagacctactgctagtttcttaattttaatatcacatcacctgaaacagtaaaacaacaggcttagccaacgtggatgcttaacagtaacagtgacagtggagctgaataccaaatgtatagccctggtggttcctatctactatcaggcaaacatggtcagtatactgtaaagtacccctggcctacatgattactttgctctgggcaagtggaatatgattaggctcatctcaaagcccacagcataagaaatgtcagcatagccacagacgtctgagaatcctgagttaagcctaacacagagtctcacgattcaagtattctctggacattgcggcaaatgatccactattgggcatcaaggtgaatgaataattaacagaatttcaagcaattgataacaagatacttggcaaaagtcgttaagacttaattagaaacacaggcattagtacacagcatgagaaacagacctgagaattcgaattgtctacctataataaaaaagctgtaataaccaataatacacacaccacacacaatacacagcaaataaaaaacaaataagaaaacataataacgataacacatcaaacctgaaaaactaacctcatacaccaacacacctcaacctatccacaacctactacaaacactaagaaacttaaaccacaaaacaaattagtcaaaaacaatacaccaccaatctaataccacacactctaat

SEQ ID NO: 713897 - DNA, 1117 bp, Homo sapiens
  misc_feature (821)..(821): n is a, c, g, or t
  misc_feature (824)..(825): n is a, c, g, or t
  misc_feature (848)..(848): n is a, c, g, or t
cagccttcctgagcacctttccttctttcagccaactgctcactcgctcacctccctcctctgcaccatgaccacctgcagccgccagttcacctcctccagctccatgaagggctcctgcggcatcgggggcggcatcgggggcggctccagccgcatctcctccgtcctggccggagggtcctgccgtgcccccagcacctacgggggcggcctgtctgtctcatcctcccgcttctcctctgggggagcctacgggctggggggcggctatggcggtggcttcagcagcagcagcagcagcattaatggtagtgtacttgtgttgcggcgagcgatatgagtggtggccttgcgtgcctggcttgggtggtaaggctttgcgtggtggcatttgctggtggagatgggcgtactggtgggcagtgagaaggtgaccatgcagaacctcaatgaccgcctggcctcctacctggacaaggtgcgtgctctggaggaggccaacgccgacctggaaggtgaagatccgtgactggtaccagaggcagcggcgtgcttggatgatcaacgactacagtccccttacttacatagaccattgacggacctgcagagaacaagattctcacagccacagtggacaatgccaatgtccttctgcagattgacaatgcccgtctggccgcggatgacttccgcaccaagtatgagacagagttgaacctgcgcattgagtgtggaagccgacatcaatggcctgcgcagggtgctggacgaactggaccctggccagaggtgacctggagatgcagattgagagnctnnaggaggagctggcctactgaagnagaacacgaggagggccatgcaatgccctgaaaggccaggtgggtgtcgattgtccactgttgcagattggacgcgtgactcttggcggtggaccattaacgcggcattcttgaaccgagaattcgtggaccactaattgagcatgaatgcagcagatagaccggcaaggatgccgaggcagtgtttcttcagcaaagcacggtggatcttgaccgggaaggatgacacacaaaggtaccttgtgtgcagtcggcaagacggacatata

SEQ ID NO: 713898 - DNA, 111 bp, Homo sapiens
tctcctaagctaatgcaaaaaagttatttattttaactttcttagatcatttagccttctcgttatccagcccccaattgcctgacgagaggttcaaccatgatcccgcac

SEQ ID NO: 713899 - DNA, 194 bp, Homo sapiens
ataaatctggaaatcgagtcgtcagttatagaatgtgtggagttggaggagtgtggctggtgggccatcctgtttggagaaagtttcagctgtgagtgtagggccagtagggcaatcctagaagaatgacgatgctccggttgccgaccattgtctgacccaggttgcaaacgaggcctttcgtgcagaaacgg

SEQ ID NO: 713900 - DNA, 232 bp, Homo sapiens
gggggatttaaattttttttgctgaaaacccttatggtccacccaccccagccggcatggccagaatttgtttttttttcaaaaaaattaggggttttcttatttttttggcttaggaggttgaaaaaaacaaggggtttttcctccttttggccctttcccttttgaggaaggtttttttttaagggcaagggctcccctaataaaggaatgtttttccttcccaaaatta

SEQ ID NO: 713901 - DNA, 331 bp, Homo sapiens
aaaccctaagttacgcatcgggtcgtaaaccctattgtcgataggaactctagaataggattgcgctgttatccctagggtaacttgttccgttgatcagaatttgggatcaataaggtgatgttatggttatttggactggttggtctagattaaaatcactcggggggtttatggtactccgaggtcaccccaaccgagatggctagtccatgttaagttgatgttttatccctttgtggttgaatagtttaactttgggaatagttaattaaagctccatagggtcttctcgtcttattttgtgatacccgcctccgtaataagggtt

SEQ ID NO: 713902 - DNA, 771 bp, Homo sapiens
cagcaaaataagaactcctaactgaacagaaatttttctacctagcaatgttattcttgtaaaatagttacctattaaaactgtgaagagtaaagaaaactaaagccaatttattatagtcacacaagtgattatactaaaaattattataaaggttataattttataatgtatttacctgtcctgatatatagctataacccaatatatgaaaatctcaaaaattaagacatcatcatacagaaggcaggattccttaaactgagatccctgatccatctttaatatttcaatttgcacacataaaacaattatataaacaactttgtaggactatgcccttttgtgtacattcaggcatacccattttaatcaatttgaaaggttaatttaaacctctagaggtgaatgagaaacatgggggaaaagtatgaaataggtgaaaatcttaactatttctttgaactctaaagactgaaactgtagccattatgtaaatagtttcatatgtacctgtttatttggcagattaagtcaaaatatgaatgtatatattgcataactatgttagaattgtatatattttaaagaaattgtcttggatattttcctttatacataatagataagtctttttcaatgtgggttgactcgtttgattaatgtgtttgctctttcccaaaacgtaatactgcctgtgtcccagtgccgattcctggttttggaacaaaatctgggtcacaccgatccatccattcaccaatctttggc

SEQ ID NO: 713903 - DNA, 499 bp, Homo sapiens
  misc_feature (303)..(303): n is a, c, g, or t
  misc_feature (499)..(499): n is a, c, g, or t
tcagctcgtaccgtaggttgtgttggctggcctcctggatttggatcaggcacatctgggaaatacttggagtagagtggaaacacagtggaaggtgtgtgcaggcagacagccgcacctggcctggcactcccctgcttgtgacctgggtgcacaccgccctgcgccccgctttgctggcgggtcagatggtatggaagtcaccgccttgcaccgttatcattgtgtgcctggtagtgccctgtcccttggtccttgtgctaataataacaactacagtaacaatgatggggtcaggtggantcagacacggcactgcagctttcagctgactagctgtgtgacttgggcaagccccttaatctctctgatctcgggctccctcctctgtaaaatggaattaagaataacctcattgaggagcttcctgaggaggtaaggaaagtgcctggcacagtgccaggctgctaagagatcaataaatgttccattccccagn

SEQ ID NO: 713904 - DNA, 1238 bp, Homo sapiens
ggaccatgctgcgtgtgctgtttccatgcatacgagcagcactaacatgacctatactacggtgatgaagcggcctgatcatcagtgcattacgaatcaagaaagcgtgcctgataacctctgtggtagtagcctccactgcacaaactcatgctgtgatccatgtgatacgctgatggcttgtagaacattgtgctagagataacgcgtcgtgactatacacatccgcagccctgtgtgacctagtacgcctgcttcgtgactctcgtgacttgacagggtacgacttgagacttcggtctattcatctgagtcgtcgtaactgtgtgcgagacgtacaactaagcaaattcaagagacgtccttcacttgcgtgttgcgcttgtcacagtggtcgtttagccaagacgtccgtgggagcgcccctgttcgcatattgatagctcataaaagttacatctgatgaggtcatgtcgttggatagaccaggagatgagcactagaaatcacatacctgtgatacatgtgttgctcgagtgcgtgtccaggccttaacgcaagcgtaggctataggtggcaccgttggaagggagtctaagtctatgtctatgacaacttgtgcatcctggacacacccccagtgactttgcttggattgtggcactggggtgcccatgtctttggggaagtccctccctgagtctacgtatcggatgggcctacatgtatgccaataccgtgtcccaggtgcccagctcgcactcgatggaacacgggggggggtaattccaagctgtttcttgcctcaaacccgtccgtccttctgcgccccttgaaagccgacgtgagcgcgccagaggggactagtgcccttgttatccccagtgttccttggtacgcaggcacgtaagcttggttcaaaggggctatgaacaagtggcttgagaagcgccctgtccttgcgaagattcccagggcaatcagctgggcaggcatgggcttggctcttccattgggttgcccatgtgtcgcctggccaggggtcccaccaagggctctattgcctggtgggaaccacaaaccccaaggtgtcacaaacagggacttggggtttgctttgaagcccaaaacacccagggaagaaagggtgggataaagtggggttacacaagtggggcttcccttggcaggctaagggtggaaggaagcaaccccccgggttccctaatttgtgacca

SEQ ID NO: 713905 - DNA, 123 bp, Homo sapiens
  misc_feature (38)..(38): n is a, c, g, or t
  misc_feature (78)..(78): n is a, c, g, or t
atctagaggactcctgtgctcctcttcaggaattcacnatacttttctccttaatcactccccaccttggctcatgcnccactcatcctttaggtttgacctgtgtgttgggtaggactggat

SEQ ID NO: 713906 - DNA, 159 bp, Homo sapiens
ttcccttaggaataaggggggtggtctaggaggtacagaaagggacctgtcttctccccaatccaaaagcgtcgttgggcgtccttcttctgttatccccccacttaaccccacaagtataaaatacctctactcccttttttgggcacttctccgagg

SEQ ID NO: 713907 - DNA, 310 bp, Homo sapiens
  misc_feature (121)..(121): n is a, c, g, or t
  misc_feature (235)..(236): n is a, c, g, or t
  misc_feature (272)..(272): n is a, c, g, or t
  misc_feature (281)..(281): n is a, c, g, or t
atcatctactcgtggaccggattctgtggtgaagctggagaattggacagatgcatcacgggtggatggtgttgttttagaaaaagtgcaggaggatgagttccgctatctgaatgtaccnagactcagtgtctcacgacgcagggcttgtacccgctgcatggtagacagccgtggtctcctagtcagggcgcacgcctttggcgtagaagcagcaaccatgtctctccacatnncctattgagacatgacttccacaacctcaggtcctnatgtttaantgcttctgtgcatttcagacacaccatca

SEQ ID NO: 713908 - DNA, 2041 bp, Homo sapiens
ggcacgaggggcggttgagacagcggcagtactgggaggctaggtgagggtcgcgaggctgcccgagcttctgagcgagcgcggtgcttttgggaacgcgggacgggcgatctgcggcgccaggagctgggccgaggcgcggcggcgcggctgccggctgccctgtgaatgggaagttacacgaagtccacccagcgtttctgaggcaatctgaaggcaaatcctgtttagacccaggcgaaggttcccggtgacccgggctctcaccagccaattgtcccttgccgtcctcctgagggtgcctggagcttaagcactgtgtgctcttggcctccacactggggatgccactgactcccactgtccagggcttccagtggattctccgaggccctgatgtagaaacttccccattgggtgcaccaagagcagcctcacatggtgtgggctgacatcaagagctgccagatccaacaggtcctgggggagtaggagccagtgcaaggagagaagtccattgagaaaggcaaatggatgacatcagacccaggggctgaggtccccaactgcagctgggtagcttctggagtggacaaggagcaacagggaagttcgtggcctggtgttctgggatccactgtctcatctcattcttgtgggcaccagaacgtatccaaagacaagactcagtgtctctggcaacagtgagccagagatagaatgtgtttcagaggaggaggaaggggttgttgtaccccatggaaacagtatattgttttacagtagcgtgtctttctctaataactacttagcgtgttcctgttaatggaaaatattggtggtgtaagtttccccactgttctcatcttcatgtaaatttgttcatttccttccttccttccttccttccttccctacttccctccaactctctttctctctctttttattctttccctccttcccacccgccctccatccctcccttccttcctccttccctcccttctttcctttcttcctttcttcttcttctttctctctcatgctctctctttttctttccttttcattctctctacttttttgaagagatcacactgtactgaaacctacattattttccaaaatctctggatctgcttctgtcttgcaggcagagagctcatccagtagcccttagctcttcccagccccctcctttgatttgtgggtgccactgcggcagctgctgagtctcagtggtttctagtcttcaccaagttctgcccacccagatggtttttacctgtcctcaccagaaacctgcactgtctagattgctgaggctgcttctccttaaccgatctgctatctgtattccaggggcaccccagggttagaggtaaatggcacaggccttgaaatctccaactgctctgactccaggttggtgcacttcaatgccaagtactaaccacacaattacaggatgccaccaaaaccttgatatggggcttctgcatcctaactaaaaaaacagttaatagacattattttttagaacagttctaggtttacagaaaacttgagtggataatacagagagttctcctaggctcccctgtcctccagcacacaattttccctactagtatgttgtattagtgtggtccattcattacaattgatgaaccactgttgatacgtcattatcaactaaagtccatagtttacattagagttcattctttgagtttcacagattatgggttttggcaattacataatgtcctaaatccccaatacagcgtcatgcgaaagagtttcactgctgaaaattccctgtgcttcaccatttcacgcatcctcctctcctccacccctgacaaccactcaccattttactacttctatctttttgactttccaagaatgtcctagagttggagtggtacagtatgtgggtttccagactggcttctttctagcattatgtactttaagttccttcatgtcttttcatggcttgataacttgttttttaaaatcagtgaatcag

SEQ ID NO: 713909 - DNA, 336 bp, Homo sapiens
gtaaagcacaccctctccccttttgaagcgatcacatcactgctccaaaggacgttttctacaggatgttcgacccgtatggtcactggatagcttgcataaccggctccctcgcaccatgtaagtaaggacattggaagggagatcgaagtgctcgtgattaagacgctttgccgctccagacatatccaagatggtggtggcatacccctcctcgccccccccttatctccgtcataaaggctgcgatgaagctgaactgtccgaattccacgccgcttaaataccgaccgcgtgtgatcgtagatacgcctgatttcacctagcgcgatttcg

SEQ ID NO: 713910 - DNA, 916 bp, Homo sapiens
gctggagctaagttccaggggtctaatgaaggtgagccggtctcctgctcgaatccctgtcacctctgatgacataatatctgtgcgatgtatgcggttgactgggtgtacaccttgccatggaacgggaacgctccactagaggaactggtgcttgagagtgtgatctttggcacgctcggtgcacatatagcgcccgatgatcgtgactgatgagatggatgatagttaggacactgcatccatgagcgggctgtgaggggttgcgcatcaacctagagggacacgaatgagtgtccatgggacgaccacggcatggatatcgatacgaacgattggcgcgtggatctacatgtgcaagtcgtcatccaggcaaactttctgagtgactggacacgcaactagcccagtggagcatccgggagaaccttggtctgcatcagaggcggactgccccttggcgccacattcatacgaacccaccctacaaagaaccgtccaccccttggggaccaggtcttcggacgacaatttcaactcccttgaagcacctccttcactaactacttactcacctttttcacactttagggctccaaaaggtaggccttgtggtacaaaggccctacgacagcccaagagactttgcggacacatcgcacgcacttttgcgaaagtagcacgttcgggatagcaccataagtcggccgtgatttctgccggacgcttgaaaaattggcgaaaacctactgttaccatagtggacacccacaccttgtacggtatggccttcgctccactagtgcgtaaacttctaggggcgcaagcggctagggagtagatgcaacatggggcggcatagcgcctcgatcggaacgccattacattcgcgaacagcatctaatctcaacaccaa

SEQ ID NO: 713911 - DNA, 357 bp, Homo sapiens
gagaagtcagcagaataggctgagggggaggcccttcagacagatcgactggtgcctcgtccagagtcgctggcccgaagagacagggggagctgcgttatcagagcctccttttccgggtacacttcagacaccttattcatcttggtgaaaatctggttgatctctatgaacgtcttggacttggtctccgggacaatcaagaagatgtagatggtggtgaggtgagattgcgccactgcactccatcctgggcaacagaatgagactccatctcaaacaaaacaaaacaaaacaaaacaaaacaaaacaaaacaaaacaaaacactatcaggggtcctgtcgggctagtcgggg

SEQ ID NO: 713912 - DNA, 799 bp, Homo sapiens
  misc_feature (391)..(391): n is a, c, g, or t
ggaccgttcccgccctaccgaaaggggaattctaccacccagcacctgggtctaagaagacccccttccaaccccctttgaggacttgacctataatcactggctggttctggcttgtgggctatggcacctgaagcctcacagccctttgggattgcgattatcctggaattgcttataaaacccagctggggcaccccgctggggtgagaaatggctaacttccggagtcccccgaaggaacctgatggagatgtgccaattggaggagcattagccagatggccagcccaccccgccaatatccgttaaattgttagaggtaatagcccttcccagtgatttccataaatgatctgcgcatccagattgttaaagaggggaattggtnataatatccacccaggacgtgtagaacatttccagccagccaatctccagaaagcgttcaccaatagagtgttccctgagagatatttgtgcttcagggactttaaactcgcccctaagttttgaatataccttcttcacatcggcccactggccacttttttttctagagtgattgcacaataagtggggatttttctggagagattggtcacgctatgagagtaataaaggtgttgcttaatgcactgttgtgaagattccaacactgctatattttttataaatccatgtgaaacatagacttatttttaaattgtacccatcaccagaaataatggccataattatccaaactttttaaatagatggtcatattttttaaataaagttttccacataactgcca

SEQ ID NO: 713913 - DNA, 976 bp, Homo sapiens
  misc_feature (361)..(361): n is a, c, g, or t
gagtcggaaatatggtgtccaggcagggcgtagacatggcttgtagatcccgccgaagggtgtcgacgcccatgaatatgctaaattgcgacgacagaaggatcaccggagagagagaccagaaaagtagtaggcctgaaccatatgcagactgtcatgcagactactcttggcggcatctggatctacgaggctgaacgttggattccacagctgtgggatggacgatgagtcattgactcacaccgacaatacccctcatatctgcataattggtgcgtgtctattcaactgtctcctgctcctgttggaaggctgtagtgcgtgataggactctcgggtccacttgctggtatcaccnttcatgcgtaggcaagcaatcaagatgtaaacctgggcttgtctctgctgtgctgcgaacgtttcaaacgctgctagcaggtgaacaagcagtctgcatgtgtccccagagccaagaagattggagagagtccgcagcaaggttcatcgacttatgcaacgcctggttgatcggcctcttctatgaacgaggagtgaagagggcgtggcgtacgagattggtagtgccaccactggtagccatctgcgggtgaaccatgcacttgcctttctgaggaaggcccatggggcgtcctggggctgggccctctggtttggtccccccattagagtggtgaggagccagaggggtccgatggggcatgcaggctacttgtggcgagctgctgttggcgactactccggaatggggcggcttgcagtcaacgccggcccagttccggccctgccccgttggagccatttttagcccggttgcccgcgctcagaacggtccccggtgcgaaactccgtggtgacgcgtttcaactcgggcccactcgtgggtggcgccctcgtctctctctgtctctttcgctcgtgtctccctctcgcctcacccccgggaacaaaaaaa

SEQ ID NO: 713914 - DNA, 368 bp, Homo sapiens
gaccctgccccctccttggggcccctcttaaagccataccctcccccatttgggggccctgggctcccatcctcatttttctccttgactggaattgttgctacccagttggggtgggtaaggcctcccctaattggggcctggggcaggggggtcaagaaaagggttttggccccttccctccccaataaggaggggacccttgggcccctctccccctttttttttattttttggaccaaaaacagggggggtcgggtggagggaaaaccccccctccccccaggaccctaggagggggggggggcaggtagggggaaatggccttgctcctcctcgctggacccccagtaaagagttttttccca

SEQ ID NO: 713915 - DNA, 863 bp, Homo sapiens
agcggagtcgtaactcggaagccggagcccagacgggcccgcggcgggggggtgggggctgcgcgggggcgggagtggcggaggtggccgccctggcggcgggtttgtttatcccggggaacgaagtttaggagcgggagatagggacaggagggcgggtcggcggaggaaggatgcggttcggcggacgccggcgccacagggacttgccgccatcaccccttgctgccaccaccgcagcctcgggctccagggcggacacggcaccgctcagcgggagaggagtctccaccaggactgaccgctgccgcccagcagcatcccccttttcgcaggacacgcacgagcatgaggagaaaaacctgacaaagtcctgacagatgtaccttatgctagtaatgaatgtcggcattggcgtgatccgcatggagctcctaccgcttattcactctaatcgctgtaacatatcccttttcgataatgtgtctccggttggtcaccctaatttggtgggatgagcatgtacggcttggttctctgtacgtcattcgtcatcttgtgttccctgcaaacctggtgcgacaccaagacgacataccgctgacccccacgtcgcatcgtcacggccagggcgacaggtgagcgatgccacgactgcccggcgccaccactcgcacgacgcacaatggccaccgacgggggcccgcgaacgggccacgaccaggccccacggtcgccaccggccacccgacagcagcccgacacggccaactcataagctgcccggaccatcgaaggctcacagctacacagcgcgagcgcgctacgcaacaatcgcggtccatgcgctgcggacgctgccg

SEQ ID NO: 713916 - DNA, 315 bp, Homo sapiens
  misc_feature (63)..(63): n is a, c, g, or t
ggtgacacaataaggaagggtccccacgtggggtagagccccaagttgagacataatgaacanattatgtatgaacaattgttagagacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 713917 - DNA, 254 bp, Homo sapiens
cccactttggggcccatgggtttttttggggtgagggaaaaggtggaaaatgctatccatccccggagttttttccccgggggagggtgaaacccccgattcctttttaacccccctttttaaaaagccccctcctgtttgcttaaaaggggcagccaaaaaaattttttttgtgttccctgtttcccgccttttttccccctgggggctgtccagttttgggttccaaaaaaaacctttgaatttccaagtta

SEQ ID NO: 713918 - DNA, 2879 bp, Homo sapiens
gggcgttcttggtgctgccgggcgtggtgagtcgggctcccgtggccgcgtgctgggaggagactggagcccggttaggaagaatggagttggcgactcgctaccagatccctaaagaagtggctgacatctttaacgcccccagtgatgatgaagagtttgttggcttccgagatgatgttcccatggaaaccctctcgtcagaggagagctgcgatagttttgactcactagagtcagggaaacagcaggatgtgcgctttcattccaaatacttcacagaagagctaagaagaatttttatagaggacactgactcagagactgaggattttgcaggatttacgcagagtgatctgaatggaaagactaacccagaagtaatggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggtgatacaaagggaagattctacctctgagtctgaggatgactctcgggatgagagccaggagagttcagatgctttgctgaaaaggaccatgaacatcaaggagaacaaagccatgcttgcccagttattggcggaattgaactcgatgccagatttcttcccagtacgaaccccaacctcagcttctaggaagaagacagtgaggcgggccttctcggagggacagatcacgcggcgtatgaacccaacccggagtgcgcggcctcctgagaagtttgctctagagaacttcactgtctcagccgctaaatttgcggaagagttttacagcttccgaagaaggaagacaattggggggaaatgccgggagtacagacgacgtcaccgtatatcttcttttcggccagtggaggatatcaccgaagaggacttagaaaatgttgccataactgttcgagataaaatctatgataaagttctgggtaacacgtgccatcagtgtcgacaaaagaccatcgacaccaagacagtgtgtcggaaccagggttgctgtggtgtgcgaggacagttctgtggaccatgcctgcggaaccgctatggggaggatgtcagatcggcattgctggacccggattgggtgtgtcccccctgtcgtgggatctgcaattgcagctactgtcggaagcgtgacggccgctgtgccacaggaatcctcattcatctggccaagttttatggttatgacaatgttaaggaatatctggagagcttacaaaaggagctggtagaagacaattaagaggaaaacaaacagaaccagccacctcaccatagagtactccaacaagacatgcataccattggtgcctaagatttttttacagttgtgtttttatacagaaattctttgtagaaattactattttttgttaaagattgtttatatgcttacaaagatttctcaggaagacagcagagcagaggaatctatatagatgtatgcacagacctgtctgtatgctgaactttgttaaaaatatctgccagttattaaaaagcacagtttaaatggggtggggttaaagttcaggtaagtaagttagagagaaaacattgtatgatcagctcctgcacttgatctatctttggcttcccaaacagtaactcactccaggccaagtgtgccttagcacgagtgaccacagtttaatagaccacacacatcgtttaacctgctcttggtcattggaaatttacactgaacaaagtgcaattaactgtagaacagttttatttttattaaaacttgactgaacaaaaggggaccatcaacattgtagacactggaggccttacagagtgctagcctcttccttcaggactcacctggggcctgctgcttttatattttgaaagagtttaagggctaataatttaatttgttgtttgttaaaaattaaaatctccgttctttccggctgcattgcttttgcatgttcacatatgatgtacttttatgatgtacttttttttttttgagatggagtcttgttctgttgcccaggagggagtgcagtggtgcaacctcggctcactgcaacctttgcctcctaggttcaagtgattctcctacctcctgagtaactgggattacagtcgtgtgccaccacgctcagccctgagttagtttctagtatttttttctgactttcactctaaggatagcgttgaaaaaagaatgcacgtgtgagttactaaaaagtcagaataatgtgcatgggaacagtgcagcaacatgctagaaaatcctcactgcactccagcagaggctagaggaatgccagtgttaccttacgcttctagaagcagagccactccagccagaacccattttgcagtcttctcttcgctcttcagcctgaaggtccagatgtagctggggcctctcagtttggttctatacacagggcactcgtaggtctgtttggtttcttgtctgtccacgggggtggcttttgcaaagatgaccggcatagggcatgccagctccttgagacgggcttcaacaatggttcctgcttgggtgtcccagcgggcgcctatggcaaaaacacagcggttgcaattgtgtggcagcttgctactaatgataatgatcaagttgtttgatgcaataaacattcaacattctggttttgtcataaaaaaaaaaacaaaacaaaaaaaacac

SEQ ID NO: 713919 - DNA, 2741 bp, Homo sapiens
gggcgttcttggtgctgccgggcgtggtgagtcgggctcccgtggccgcgtgctgggaggagactggagcccggttaggaagaatggagttggcgactcgctaccagatccctaaagaagtggctgacatctttaacgcccccagtgatgatgaagagtttgttggcttccgagatgatgttcccatggaaaccctctcgtcagaggagagctgcgatagttttgactcactagagtcagggaaacaggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggtgatacaaagggaagattctacctctgagtctgaggatgactctcgggatgagagccaggagagttcagatgctttgctgaaaaggaccatgaacatcaaggagaacaaagccatgcttgcccagttattggcggaattgaactcgatgccagatttcttcccagtacgaaccccaacctcagcttctaggaagaagacagtgaggcgggccttctcggagggacagatcacgcggcgtatgaacccaacccggagtgcgcggcctcctgagaagtttgctctagagaacttcactgtctcagccgctaaatttgcggaagagttttacagcttccgaagaaggaagacaattggggggaaatgccgggagtacagacgacgtcaccgtatatcttcttttcggccagtggaggatatcaccgaagaggacttagaaaatgttgccataactgttcgagataaaatctatgataaagttctgggtaacacgtgccatcagtgtcgacaaaagaccatcgacaccaagacagtgtgtcggaaccagggttgctgtggtgtgcgaggacagttctgtggaccatgcctgcggaaccgctatggggaggatgtcagatcggcattgctggacccggattgggtgtgtcccccctgtcgtgggatctgcaattgcagctactgtcggaagcgtgacggccgctgtgccacaggaatcctcattcatctggccaagttttatggttatgacaatgttaaggaatatctggagagcttacaaaaggagctggtagaagacaattaagaggaaaacaaacagaaccagccacctcaccatagagtactccaacaagacatgcataccattggtgcctaagatttttttacagttgtgtttttatacagaaattctttgtagaaattactattttttgttaaagattgtttatatgcttacaaagatttctcaggaagacagcagagcagaggaatctatatagatgtatgcacagacctgtctgtatgctgaactttgttaaaaatatctgccagttattaaaaagcacagtttaaatggggtggggttaaagttcaggtaagtaagttagagagaaaacattgtatgatcagctcctgcacttgatctatctttggcttcccaaacagtaactcactccaggccaagtgtgccttagcacgagtgaccacagtttaatagaccacacacatcgtttaacctgctcttggtcattggaaatttacactgaacaaagtgcaattaactgtagaacagttttatttttattaaaacttgactgaacaaaaggggaccatcaacattgtagacactggaggccttacagagtgctagcctcttccttcaggactcacctggggcctgctgcttttatattttgaaagagtttaagggctaataatttaatttgttgtttgttaaaaattaaaatctccgttctttccggctgcattgcttttgcatgttcacatatgatgtacttttatgatgtacttttttttttttgagatggagtcttgttctgttgcccaggagggagtgcagtggtgcaacctcggctcactgcaacctttgcctcctaggttcaagtgattctcctacctcctgagtaactgggattacagtcgtgtgccaccacgctcagccctgagttagtttctagtatttttttctgactttcactctaaggatagcgttgaaaaaagaatgcacgtgtgagttactaaaaagtcagaataatgtgcatgggaacagtgcagcaacatgctagaaaatcctcactgcactccagcagaggctagaggaatgccagtgttaccttacgcttctagaagcagagccactccagccagaacccattttgcagtcttctcttcgctcttcagcctgaaggtccagatgtagctggggcctctcagtttggttctatacacagggcactcgtaggtctgtttggtttcttgtctgtccacgggggtggcttttgcaaagatgaccggcatagggcatgccagctccttgagacgggcttcaacaatggttcctgcttgggtgtcccagcgggcgcctatggcaaaaacacagcggttgcaattgtgtggcagcttgctactaatgataatgatcaagttgtttgatgcaataaacattcaacattctggttttgtcataaaaaaaaaaacaaaacaaaaaaaacac

SEQ ID NO: 713920 - DNA, 229 bp, Homo sapiens
tacctaatgtagtcatctgcttaaaaccaaaagataacactgaactcagaaaaaaacaaccacatacatcaatctgaactacagactctatgtgagcaaaccaccaattatccgaccatcatctcctaccactcttaccctttcttaccatactttagccacactagcttgctttctgttccttgactatactctcagttgattatctgcccatgcgggtaacagcttg

SEQ ID NO: 713921 - DNA, 1742 bp, Homo sapiens
  misc_feature (1)..(1): n is a, c, g, or t
  misc_feature (3)..(3): n is a, c, g, or t
  misc_feature (13)..(13): n is a, c, g, or t
  misc_feature (35)..(35): n is a, c, g, or t
ncnggaaacacgngccatttattctcagaagacancgcaccaagacagggggcggattatttttaataagaggcgccaccccctgtggaccatgcctgcggaaccgctatggggaggatgtcagatcggcattgctggacccggattgggtgtgtcccccctgtcgtgggatctgcaattgcagctactgtcggaagcgtgacggccgctgtgccacaggaatcctcattcatctggccaagttttatggttatgacaatgttaaggaatatctggagagcttacaaaaggagctggtagaagacaattaagaggaaaacaaacagaaccagccacctcaccatagagtactccaacaagacatgcataccattggtgcctaagatttttttacagttgtgtttttatacagaaattctttgtagaaattactattttttgttaaagattgtttatatgcttacaaagatttctcaggaagacagcagagcagaggaatctatatagatgtatgcacagacctgtctgtatgctgaactttgttaaaaatatctgccagttattaaaaagcacagtttaaatggggtggggttaaagttcaggtaagtaagttagagagaaaacattgtatgatcagctcctgcacttgatctatctttggcttcccaaacagtaactcactccaggccaagtgtgccttagcacgagtgaccacagtttaatagaccacacacatcgtttaacctgctcttggtcattggaaatttacactgaacaaagtgcaattaactgtagaacagttttatttttattaaaacttgactgaacaaaaggggaccatcaacattgtagacactggaggccttacagagtgctagcctcttccttcaggactcacctggggcctgctgcttttatattttgaaagagtttaagggctaataatttaatttgttgtttgttaaaaattaaaatctccgttctttccggctgcattgcttttgcatgttcacatatgatgtacttttatgatgtacttttttttttttgagatggagtcttgttctgttgcccaggagggagtgcagtggtgcaacctcggctcactgcaacctttgcctcctaggttcaagtgattctcctacctcctgagtaactgggattacagtcgtgtgccaccacgctcagccctgagttagtttctagtatttttttctgactttcactctaaggatagcgttgaaaaaagaatgcacgtgtgagttactaaaaagtcagaataatgtgcatgggaacagtgcagcaacatgctagaaaatcctcactgcactccagcagaggctagaggaatgccagtgttaccttacgcttctagaagcagagccactccagccagaacccattttgcagtcttctcttcgctcttcagcctgaaggtccagatgtagctggggcctctcagtttggttctatacacagggcactcgtaggtctgtttggtttcttgtctgtccacgggggtggcttttgcaaagatgaccggcatagggcatgccagctccttgagacgggcttcaacaatggttcctgcttgggtgtcccagcgggcgcctatggcaaaaacacagcggttgcaattgtgtggcagcttgctactaatgataatgatcaagttgtttgatgcaataaacattcaacattctggttttgtcataaaaaaaaaaacaaaacaaaaaaaacac

SEQ ID NO: 713922 - DNA, 508 bp, Homo sapiens
  misc_feature (18)..(18): n is a, c, g, or t
acttacttttccacaggncagcccatagaaaaaaaatctatagctataaaatataaccagaaagccctttattttcaacctttctagctgaatattaatttcaaatagcagatgtcctaatatattcaagaacactgtccagtagcaatacaaaaacactaaattcttatttcatcatttcataacactgactcagtaacagaacaagtaagaaatcaaactttaatttctactgtgtttaggccagaaaaaaaaatcctttcctccaggattctgtacctcaagtcatcttagatgtttctactgtcataaaaatgttcttcagccacaaatgacattagaattccttattgtgatttccatgtcacccagtggtaaaatagaaactgagctactgggatagataagttaacctaaaaaacagcagccatcaacattattaattttgcataaggaaacacgaatgtgcgttatactgggaagtttaacatctgctacaagaaaatcc

SEQ ID NO: 713923 - DNA, 138 bp, Homo sapiens
gtttagtctttgatatactgctcgctggcgggaggcagattgtggggttctgctgtcagcaccaccaagtcgtcgatgatgccctgcaggtaggtgatctctcccagcatggtcagctctccattcaccacaggctgc

SEQ ID NO: 713924 - DNA, 194 bp, Homo sapiens
ccctgctgaggggagggctgtgcttgcgcagcaacacgaagagcagcctggtcccccggctggccctgttggaaaggccgagtcctgcgcttgccatgagaacgatctgctgttgctgctgctgctgccgaacacttcatctgtattcaaatgactgctgccatgtgattgccttgaacgagaacgctggctgc

SEQ ID NO: 713925 - DNA, 1746 bp, Homo sapiens
  misc_feature (1450)..(1450): n is a, c, g, or t
  misc_feature (1454)..(1454): n is a, c, g, or t
  misc_feature (1463)..(1463): n is a, c, g, or t
  misc_feature (1478)..(1478): n is a, c, g, or t
  misc_feature (1515)..(1515): n is a, c, g, or t
  misc_feature (1523)..(1523): n is a, c, g, or t
  misc_feature (1652)..(1652): n is a, c, g, or t
  misc_feature (1688)..(1688): n is a, c, g, or t
  misc_feature (1694)..(1695): n is a, c, g, or t
  misc_feature (1711)..(1711): n is a, c, g, or t
gggcgttcttggtgctgccgggcgtggtgagtcgggctcccgtggccgcgtgctgggaggagactggagcccggttaggaagaatggagttggcgactcgctaccagatccctaaagaagtggctgacatctttaacgcccccagtgatgatgaagagtttgttggcttccgagatgatgttcccatggaaaccctctcgtcagaggagagctgcgatagttttgactcactagagtcagggaaacagcaggatgtgcgctttcattccaaatacttcacagaagagctaagaagaatttttatagaggacactgactcagagactgaggattttgcaggatttacgcagagtgatctgaatggaaagactaacccagaagtaatggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggtgatacaaagggaagattctacctctgagtctgaggatgactctcgggatgagagccaggagagttcagatgctttgctgaaaaggaccatgaacatcaaggagaacaaagccatgcttgcccagttattggcggaattgaactcgatgccagatttcttcccagtacgaaccccaacctcagcttctaggaagaagacagtgaggcgggccttctcggagggacagatcacgcggcgtatgaacccaacccggagtgcgcggcctcctgagaagtttgctctagagaacttcactgtctcagccgctaaatttgcggaagagttttacagcttccgaagaaggaagacaattggggggaaatgccgggagtacagacgacgtcaccgtatatcttcttttcggccagtggaggatatcaccgaagaggacttagaaaatgttgccataactgttcgagataaaatctatgataaagttctgggtaacacgtgccatcagtgtcgacaaaagaccatcgacaccaagacagtgtgtcggaaccagggttgctgtggtgtgcgaggacagttctgtggaccatgcctgcggaaccgctatggggaggatgtcagatcggcattgctggacccggattgggtgtgtcccccctgtcgtgggatctgcaattgcagctactgtcggaagcgtgacggccgctgtgccacaggaatcctcattcatctggccaagttttatggttatgacaatgttaaggaatatctggagagctaagtaagtctctagcagcttacaaaacagcntganatcttgagnctgagcacaggagancctctgggcaagtagttgttgccttcccgtgtgactnacttactnatataaaccacgagtaccatccattctgtatctgtttgcattggaaaagctcaggcctgatattttccctattagggaatcttctcctttgctagatttttcaactcaactccacgttgcctttaaccnaatttctccttgaggtgtatgacagaaatggaaggnacaacnnacaagcaggctgaggnaagacacagattatgaagagcacagctgcagtcgg

SEQ ID NO: 713926 - DNA, 207 bp, Homo sapiens
  misc_feature (59)..(59): n is a, c, g, or t
ttatttcttattcctcgggcgatgttacttctaatgtcacagggggtgtacatttttcnaaatgaggcataggtattttagaaagatgctactcctgatgtcacagagggtgatatgggggtgaccaccgtgtacatcactgaggccactgcaccctgtctcagggaagatgacacatctgaactgaggtagcttccaacgcctgtt

SEQ ID NO: 713927 - DNA, 357 bp, Homo sapiens
ttttttttaaaatgtcaagagagtgaaggtctgaatctctctgaatagcatttgtcacttggccagtaaatacagcatgcaaagtatatgtgctttaaaatataagcgtatttcgtcagactctacaagtccttcttgaccccttggtgcacagatccatatataacctcccttttcagtatggctgtgtgtgattaacctacaacacatatgcatgcatagatgtgaatcctgcactactttttttttctttttcccccccaaaaattctctgggaaaaagttttaagaacgtaactaaccttaatttggctgctatttggcgcatggacccgaatagctggcgggtaaccgagct

SEQ ID NO: 713928 - DNA, 372 bp, Homo sapiens
tggggcataaacacaaactttatggaggccctcagactagttctctttctccggcacagtctgggttccccggaaacgtccagtccggggggcagcaatgaaacccactttgggcggccagcgggggcatctcgtggcggatgtgggtggagggctgccgagtgtgcgtgggtggtgtgccacctccaaagggagtgctccacgaggatccagtggccacacccgcgatactcggtggccagcagttcctcttggcctatatattgggtggtacgcccggccagccttcaagaagtgggttggtcaagttcggccacctccagccaccacaccaaccacagctctgtgggcgtgaggagaataaccttctgg

SEQ ID NO: 713929 - DNA, 633 bp, Homo sapiens
  misc_feature (500)..(500): n is a, c, g, or t
aacagaaaccctgtctcagatgagtaattttaaaatttcctgtggaatcaagttcttcagtgacgtgtattacactcaagaacaatcttaagcctaagatcctcagttcagtacaggagacctctcatgtggcattttagttttctggactttccagtcagccacttgtgttcctaaaatcttcctgccatttcctctttgagatgccgccctatttcttcctctacactttacggttttatgttacgcagccagtatacctacatgcctctatccctgaataccccgagtactactgatcacatctacttaactggcacaatgaacacagtaggtacttttagcttatgttggcctttgggagtgggtgtccaagatcagcacttcctcgcgctgactgcgtaattcccaagttcaatttcattagcattctaatatacaacttccaacttccggccttgaagtactgctcacttctggtgaatacagcatcagtgcantttggtttgccttaaaaccacaatcctgggaggctgagacagaatggcgtgaacccgggaggcggagcgtgcagtgagccaagattgcgccactgcactccagcctagacgacagagcaagactgtctcaaaa

SEQ ID NO: 713930 - DNA, 501 bp, Homo sapiens
ctgtatcgtgggagacataaaaaataaatacataaataaatagtatacaaactgcatacgatgccttctgcacaggaagcacacgggatgctagatgaaagaaaacaacagagagacatctgcctctaaaaaaaagaaaggcacagggcaaccagcgaaggtagcagtaagcactcagtaatcagccatgtcgccgtgtgatgtgataagcatggagtgagtgggtgatgtatggcagacactccacgtctttcaatgcccttcctctgcctcctgagcactgcagtagagtctctctcatggactcttgttgatggtctgcttggtctgctctcttaccctccaatacatctgctatcccacaactacatgttatcttttccgaacatggatctgatcaaggcactctccagccttcacagcctctttgagtccatggcctgcctgatttgctggccatccagtagaccgctccaccccgggatacaggggtaccgagct

SEQ ID NO: 713931 - DNA, 281 bp, Homo sapiens
  misc_feature (44)..(44): n is a, c, g, or t
ctaaatgctgttacctataatgctgtgtgactttgagcagaatnatgagtacaaagcccctaaataccctaggaagagttttattagcactatatccttcgacctcagtcctgttttaacttatcatgccgaactccctgactcaagactattcttccctatactggtccattatgatctgcacagaattgaactcttagctttttggttgtgttcttcaccctactaccgtccgctagattgcgatttccgttctcctcatctacggctctcgctattac

SEQ ID NO: 713932 - DNA, 136 bp, Homo sapiens
gcccgggtcatctcttctgccacgcggttgcctaccctgcgtgagtcgggtgggcgagctgtgcctcgtggagttcagagacctcaacgcctcggtgagcgccttccagagacgctttgtggttgatgttcggcgc

SEQ ID NO: 713933 - DNA, 505 bp, Homo sapiens
  misc_feature (387)..(387): n is a, c, g, or t
  misc_feature (409)..(409): n is a, c, g, or t
  misc_feature (439)..(439): n is a, c, g, or t
  misc_feature (456)..(456): n is a, c, g, or t
  misc_feature (468)..(468): n is a, c, g, or t
  misc_feature (487)..(487): n is a, c, g, or t
aaaacagcattcttgtaaaggcagcaaaccaaaacaagactgcagtgccttaacagagtagtctgaattcctcaaagcttgcctgtctgtacacattagtactttcaaggaaaaccttcaaatacgactcatctagttgcgcaccctggagtatatttcgcggaatcttagaactggaagccctaacgtgcatgtgtttccctctcatgcccttaaaattctaatgaattcatcagcggtccaaagtgatgctaaataagtaaattaatgctaaatctggattagtgatacaaatacagctaagtcttaatcctatgttctattattttataagacagacctacaaatactcaagtttagagaaactacattgacaaaaatatccangttcgtgtatatagaatattcnggagacgcaatcccaaccagtgaaatgtgnatatcacgtgacatacnctaggccaattngggatagtttttttaaagnggttagtgtggtgacatt

SEQ ID NO: 713934 - DNA, 902 bp, Homo sapiens
ggattctcctgcctcagctactcgggaggctgaggtagaagaatcacttgaacccaggaggcagaggctccagtgagccgagattacgccagtgcactccagcctaggagacagagcgagactccatctcatcaaaaaaaaaaaaaaaaatttttttccagggtcccaggaatttcccccaagtttttgggaattttcgacaaagagggccagaatagcaattctatccagaaattcatggctatactgggaagctagaaaagaccccttcttttacttagtggagaaacagttgatagaacttatgcttctagataaaagaaggagtgctcttcaagtcagagagtgctcagtgtgctccagggagctgaccccagtgtgtgttgggtacgtaagggcttataagtaacgcaaggaagagagagtcattgggagaatacggtcaagggaccaacgccgagattctgacatgtattacctgggagaaagggctcatagtaggctggcccgtgcagggagtatttacattttcaatttggcccagagcaggtgattggtcccctcaaggggggcgttctagaccttccctaatttccatttttttcaaaagactttttaagagtaattgggggtccgcaaggaaaatttggatcagcagagttacagagaagaagcctggggtatccccaaattgcccttcaccatttttcccctttttaattaatacttggccctttattgtgggtcacattccgtgtttccattgtgttgaccccgattatcggataccttattattacctaagaggtccattagcctaccattgaggggtcccccctcgttgtgtggtgtacattgcgggggggggtttggagaactggtccttataccgtgtttccgca

SEQ ID NO: 713935 - DNA, 353 bp, Homo sapiens
gataaggtgaatgtgaggaggaacggatcggagcggtaaaagtgaatgggcgtccagatggaggttctgaaccccgagaagctactgacagggcgaagcttcaaatggggatcgggaagcagatgagttctgaattcggagcgggggtgcggttgggttgggattcgcatttgggaagttgcatggaggttttgagtcaggaggaatcatctaacagtacagatcgaggtcaaggaatctgaggatttcgaacgatgggagggatcggacaggggttttgaatcagggaggatcgggaggggcattgaattggggtttggggggtggaaggggattcagaatccaggctgaag

SEQ ID NO: 713936 - DNA, 435 bp, Homo sapiens
cttttggggtctttgctgggcattataatactagtatcttacaaaaacagacatctgttggaactacattatcaagtatttatagatgaaatgatagatcttggatttgctttaaaatagtccagggaaaagataaaataagaacagcagaatgttgctgatagctgttaaaactaaaaaagaaaaaaatagaccgaaaacccatgtggcagcccataaaaatccaacaaaagaaaaaaactaaaaaaataacaacaaccctctcccaaaaaaactgggtacatggaagttcactgtattagtctctctaacttctggctatgtttgagatttctaaattaggaagtaaaattaaaaagcaaaaagtacctgggctagattacttagatgtctgagtcaataatcattaaggaaaaatgaaaagcatatgatcaa

SEQ ID NO: 713937 - DNA, 802 bp, Homo sapiens
ggagggtcgctacggacctcctcgttgatttgctctggaaacgtggcagctcacagagtctatacatctcacgctttgacatcctgtgtgtggtgacggtgacatcgtggaccctagtccaggactacgatgactcgggccgcttcgttggtgggctgccacgtcagaaaccagcccagcaacaatgaggaggaggggctggagccaatggcagcgctagtgaggcccgcgcattgcccaacacggtatggcggtggagcctcctgtggccccattggaggctcctgttgacagaattacagtcattctacgtccaatggtaggagggctcttcagcacgaagtgtcaacacagcaatggtagcaggatcgcgagggtgggtccaagcatgttccggtgaaccgtgaggaacacgtaagtctatgtgcgaggaggcagaatccgcattacgggtgcggcacagtcgaggtccatgatccgcaatggtggaggaccatcgtcgcgcatccagtctgcgggactagtgtgatctgaagatgacgtcaagccctggcgcatccgcgttgatgctggtaggagcttcgatacgatcatctctcctagaagttcagggtcagtgcgcagcgatgcgcaagacgttttgcccgcgtacctttcgttcccggcggtgacgaagcaagtgaggctgttgcatctttcattacctgaagtcaggcagtggaagacgcaggtgactagtatcagcggcaaccgattgggcggcccagcaaggaccacctattgaggtcctgagaaggacttg

SEQ ID NO: 713938 - DNA, 121 bp, Homo sapiens
  misc_feature (46)..(46): n is a, c, g, or t
  misc_feature (88)..(88): n is a, c, g, or t
aggaaaagatgggaatatgtttctttcctttgagaattcacaaaanggggtcaaaaacaaagcaatgctgaaagcgaacatccatttngcctgcaattcaaggcgaaaatccaaaggcatc

SEQ ID NO: 713939 - DNA, 301 bp, Homo sapiens
  misc_feature (43)..(43): n is a, c, g, or t
  misc_feature (51)..(51): n is a, c, g, or t
  misc_feature (146)..(146): n is a, c, g, or t
  misc_feature (160)..(160): n is a, c, g, or t
  misc_feature (162)..(166): n is a, c, g, or t
  misc_feature (170)..(170): n is a, c, g, or t
  misc_feature (174)..(174): n is a, c, g, or t
  misc_feature (182)..(182): n is a, c, g, or t
  misc_feature (185)..(186): n is a, c, g, or t
  misc_feature (192)..(192): n is a, c, g, or t
  misc_feature (194)..(194): n is a, c, g, or t
  misc_feature (198)..(198): n is a, c, g, or t
  misc_feature (200)..(200): n is a, c, g, or t
cccgccccaccaccccggcccctttgaagagtttttcacagancagggttntgggggaaacctgtcttgacattcaaaacctttttcttcccgatctgaacccctgttgactaatcttgcctgggtttgtgtaggtctgcaggaangaaggctgaaaaancnnnnnaagntttngacttaantgnnactttntnattnanttttttttttttttaagtccggatacagtggaatctttatggactaggaaaaacttgattttgatgctaaaattccccaattcatatatgacatcttttta

SEQ ID NO: 713940 - DNA, 280 bp, Homo sapiens
cagagtgagccaggagatgtggccaagaacatgcactcttgtcttccaccaagttcccccaccccaattgcttagcatgccacttgtgtggcatgtttctccaccactcctggtttttctcttcttaacagaggtccacccagggatcctactcttgggagcttggaggcatctttagggaggtctcggcagcatggttatggtgctgctcctttccccgggcatccacatattccatatccactcaactttggcggccactgatctgcagttacttcgc

SEQ ID NO: 713941 - DNA, 83 bp, Homo sapiens
tgctttgcactgtgggactgctttgcactgtgggagatatcttaagtttagagaacatttcttaagaatgccctgctacctct

SEQ ID NO: 713942 - DNA, 354 bp, Homo sapiens
  misc_feature (354)..(354): n is a, c, g, or t
cttagacatattctgagcctacagctgaggaacctacagtctcagcaccatgaatcagactgccattctgatatgctgccttatctttgtgactctaagtggcattcaaggtatggaacatcaaaggatacttaatttgtaagatgagaaataggaatcggtataagttctatacagtcatgtatatgtgatcatacaacttatatgaattgaagtgagagagacttatagaatacgagatagagaatgagctagggaatgaggacagaatagatggggaagagggaggatagagagagacaatgtgatggaatgctgacagagatgagatacagagacttccttacctactgn

SEQ ID NO: 713943 - DNA, 1466 bp, Homo sapiens
  misc_feature (127)..(127): n is a, c, g, or t
  misc_feature (314)..(314): n is a, c, g, or t
  misc_feature (339)..(340): n is a, c, g, or t
  misc_feature (876)..(876): n is a, c, g, or t
  misc_feature (970)..(970): n is a, c, g, or t
  misc_feature (1040)..(1040): n is a, c, g, or t
gcccggctctgcggcctggaccgaaccttggaccaggctatcacggaatgactgtaggctggcggcgatatgctggcagagtcattcaaacgagatcaacggactgtcacagacgctaccaggtgantacatgcgtgctaacacgcaagtgcacaaccatatgtccagtgcaagcatacatgtgacggcatgcgcctgcgctactgtgtctagcctgcagccgacgaacagtactccatggactggttgcatacattatgttccgcagccaatagtcctccgacgatctgccagtgatcccctcacgtgtcccntccaggcaacagagctgagctcagnnctttgatgtgcatactccacacaggggtccacctgacggccgtctcccaatgcactcctatacgtgcgagatcgtgggcacgtgagggtcgtgggtcttctcacctgggtgcagccaggacagagtatggccttgggtagtaaaacgctggaaagggtagacgcaatcctaggggcgttcccctaacttgtgcgcatccgcgcgtctacacccagcgctactcgcgggaaataacaaaatgccttgtttactacaacaggacccgggtggtgtcctatttttgcgtatgcactctttgcgcgtccctaaagcgctctcttctgggcgttgctccctgacatattagtctgggcgtttttgtgcctcgtactcccctcggcaggacaagacatcacctgtttcagaaccttgagcggtctcacaggcttagaccacaggtaggtaacttcccttcaggctgtctgcgataggagtgacgaggggggggttggagagaccttagtctcaaagagtgtcgaggcttccttgaggatacntttgccgttgaggcgagcgccgaagattaggggttacgctaatcaccgctctaatatgtcgcaattttattattttaaaggggctctaagaganccaaaaaccggccctttgtggcttaaaggggtcccccatatcccctattattaaacacagtgtaaaaacnttttgggccccgaatagttagacccgagaccattggtatgtagaccctccgcgagtctcacacaaacgcattgtatatagaaagccccatattgaatggggggacgccaagttcaatatatccctaaggaccaacagcccagaggtatagcacaggatttccggcccttcttcggggcatatggaggcaaattagcgccggactcccatttgcgcgaatggtaattcgcgagacactcccacggaagatttgtgtgtgtggcacaacccttcgtggttcacacacgacgcctttttttgtgacgaccaacggtctaaacagccctcatcaacacgcggtcaacacacgcgcaaacacactatgttggtcgtctgtgtagccccccacaaacataaagggggcgcctccagaaagcgccacaaccag

SEQ ID NO: 713944 - DNA, 315 bp, Homo sapiens
ccaaagaacgtattacataaaaaggagaaaacgaactgctagactgcttgccaaagtgactgagcattctacacatctatcacaaatgcatgctttctagttgcgccacatcttcaacatttggtgttgtcagcctttcccatttttagccatcccattgggtgtgtagtggtatttcactgtggttttaatttgaatttcccagatgactaatgatgttcagcacttttttcatgtgcttattggcttttcataatagcttctttggggaagtgtctggacaaatacttgcccataataaatttagggttgatg

SEQ ID NO: 713945 - DNA, 152 bp, Homo sapiens
agggggttccgggaagatggtctgatcaaggaattccgtgtggttttacatgttctattcaggagtatcaggttggcagtttactctgttgcagaagatagtaagatgagactgtgtgagaggattgcagtcttaagatgaccttatggaag

SEQ ID NO: 713946 - DNA, 672 bp, Homo sapiens
  misc_feature (53)..(53): n is a, c, g, or t
  misc_feature (129)..(129): n is a, c, g, or t
  misc_feature (167)..(167): n is a, c, g, or t
  misc_feature (173)..(173): n is a, c, g, or t
  misc_feature (202)..(202): n is a, c, g, or t
  misc_feature (230)..(230): n is a, c, g, or t
  misc_feature (234)..(234): n is a, c, g, or t
  misc_feature (418)..(418): n is a, c, g, or t
  misc_feature (460)..(460): n is a, c, g, or t
  misc_feature (462)..(462): n is a, c, g, or t
  misc_feature (489)..(489): n is a, c, g, or t
  misc_feature (531)..(531): n is a, c, g, or t
  misc_feature (563)..(564): n is a, c, g, or t
  misc_feature (580)..(580): n is a, c, g, or t
  misc_feature (604)..(604): n is a, c, g, or t
  misc_feature (670)..(670): n is a, c, g, or t
tcaaacagtccctcctgggataactcagacaggtagaggattacaacacatgnctgcaagtactgggtgactaaagttttggcttctgttccctggctgtgccaagatgggcgatttgagcttcctggnaaatttcctggtggaagtacataagcactctaccgtgnttggcnaggtctggctcactgtcctcttcatattncgtatgcttgtgctgtgcactgctgctntgtnttccttgggggatgagcaggctgatttcctgtgtgttatgattcagcctggctgccagtatgtctgctacgaccaggctttccccttctccttcattagctacttggtgctgctagatcttcttcgtctccacgccctctctggtgtacatgggccacgccatgcatactgtgttcattctgtngaagcgcaagctacgggtggccgatatggccaaagaggtccngngttctggcttttatgagtacccgttgncagatgaaggtatatactgtcctgcttggaggaatggaatgnaaggattgtctctagggcattctgctcaatanntatgtgtgcagcattntgatccgtaccatcatggaggtgntgtcttcattgtgggccagtatcttcatctacggaatcttcttttatcaccctgcatgtctgtcgnag

SEQ ID NO: 713947 - DNA, 521 bp, Homo sapiens
cctgcggcaaagtgctaggattacaggcgtgagccactgtgactggcctattttttcattttttaaagacagcatctcgctctcttgcccaggttaaagtgcagtggtacaatgatagctgactgcagcctcgaccttcctggctgaagcaatcctcctctctcagcttcccaagtagctaggacctatagtccctggctaattttttttttttttttttcgaaacggggtctggtccttttgcccaggctggagtacagtggctatacacaggtgtgatcatagtgtactataacctcgactcctgtgctcaagtgatcctctgtgccccatcctccacatagcagggactacaagtttttgccactgtgtgcagctcttaatggttcgggataattttgtgaacatatggtatcctaaattggatattcagattgttcattgctaaatacagttgactttcatatactgatctgtgtcttgtcacctttttgaactcatttattagttgaggtaacccg

SEQ ID NO: 713948 - DNA, 205 bp, Homo sapiens
  misc_feature (19)..(19): n is a, c, g, or t
  misc_feature (30)..(30): n is a, c, g, or t
  misc_feature (35)..(35): n is a, c, g, or t
  misc_feature (85)..(85): n is a, c, g, or t
  misc_feature (113)..(113): n is a, c, g, or t
  misc_feature (115)..(116): n is a, c, g, or t
  misc_feature (125)..(125): n is a, c, g, or t
  misc_feature (127)..(128): n is a, c, g, or t
  misc_feature (136)..(137): n is a, c, g, or t
  misc_feature (162)..(162): n is a, c, g, or t
  misc_feature (170)..(170): n is a, c, g, or t
  misc_feature (188)..(188): n is a, c, g, or t
  misc_feature (202)..(202): n is a, c, g, or t
cctggtggtgagtggaccnccccgctcccnacaanctctggatggctgcagtgttgtactagactttgttcaggctgtctcatcncagtattgccccttcctttcaactttcncnncttcatctnanncctgttgnnactttccccgaaacgaataaagtcnccccagcncctgctgtgtaggctggncagaaaccacaacncgt

SEQ ID NO: 713949 - DNA, 661 bp, Homo sapiens
tctggtgctggggagggaggcggatgttgcatgtgagctgagattgtgccacttcactccagccgtgggtcgatatgagcgaatctcatctcaatagataataactgaaccaactacacataacacacaacaaaatagaatacaatgaattgagcttatatctcgggattccctttctgccctagctgattacttgtttcttacatctggagcagtggttcttaactgaaggtgattttgctccccagggcacacttgccaaggtctggagttggttgtgagattgtcgggggagcggtctactgcatccagtaggtagaggccattgatgctgctcagtgccctacaatacacaggacagctcccacacagcaaagaattacccggccgcaaataccaatagggctgagattgagaaaccacggtctagaatccagcaaaatctttcgatcttcaccactgtcgactggggagggctcagcacaactcatgaagccatgggtttcagcacagccagggaaggtccccgagtgaaggtcagatggggagaggcctgcatggctggcaccgaggagacacagccagaccagtagctgcatgctcttgggcaagctcttccgtctgaattagtttccttaatgcaagtgaagaagcagcaggt

SEQ ID NO: 713950 - DNA, 111 bp, Homo sapiens
tgtcaggcgcatgagtgtggggaggaatggggtgggtttcgtatgttccaactgtcattttatttttacgttgttagatatggggcagtcgtgtggttcaggtggcgtccc

SEQ ID NO: 713951 - DNA, 581 bp, Homo sapiens
  misc_feature (439)..(439): n is a, c, g, or t
  misc_feature (568)..(568): n is a, c, g, or t
  misc_feature (573)..(573): n is a, c, g, or t
gtcagaacagacatgtaataacgccttgaatttacaaaatgcagttcctttctcctctttttagattggtattttagtccagttagtagatccatgtctactattaaaatattaatattggcagcatttttcatgaacctatgtagatgttcttatctgtaatatttatacacagaacatttacttacaaattagttcatcaaatcttgaatgacaaactatattgtttcattctcctctaatataaatgattttgttggacaaaagttttgataatgtttgatatacatttcagatggcaatttactacattaatgcaaaaattatgaacaaattaagtgtttgtatgacagtattctgttaaatttattgttttctggaaaatgtttactttgtttattcaacagttattgagcatctaataagaacgcagtcctgntacataggcagtaagaatatataaaaatgagtaagctatgtaaaaatgagtaagaaccattttagtgcaatgctgcttgatctttttaggttactaatccctttgcaaaatctgatgaaagctggaatnctttncaccccaa

SEQ ID NO: 713952 - DNA, 213 bp, Homo sapiens
tttccagcttttcagtttttgcctgggcaatggcccggggcccggagtggggaaagtttttatggaggggaaaggggtccccccccccccccgcctggttttagggtgttgcccccccaggccccgcatctgtttgctctgcaaatatgtctctttggggttggaatttccttttttgttaaaaaaataaaggaaaatgccttgtaaggtcca

SEQ ID NO: 713953 - DNA, 244 bp, Homo sapiens
ggccagcagcattggcatcacctgggacttgtgagaaatccagcatctcatgctccacagcaggtctcttaaatcagaatctacagtttatcaagatccccagcagatgtgtgtgtaagctcaagaacctgttcagaggagcacctagcataagtcctggcttgtgacagatctgccaccctctagctgggtgacttttagccaagtgatcgacctctttgagccagagtttctaccttgtaaa

SEQ ID NO: 713954 - DNA, 355 bp, Homo sapiens
  misc_feature (326)..(326): n is a, c, g, or t
tgggaagacccaagtctctacaaaagagaaaaattagcaggggcatggtggcgcacatctgtagttccagctacttgggaggcggaggtgggaggattgcttgagccgggggaggttgaggttgcagtgagctgtgactgcaccactgcactccagcctgggtgagagagtgagaccctgtctcaaaaataaacaaaaaaccccaaagtgaatgaggctgggcatgggttcacacctgtaatcccagcacttggggaggctgaggcaggatcatcacttgaagctcggagtttgagaccagcctgggcaaaatagcaagaccccanccatttctacaaagaaacaagaaaaagaa

SEQ ID NO: 713955 - DNA, 159 bp, Homo sapiens
tattatgcagcaaaaagaacaaagtaactagaaaaaactttaacaaaagaagtttaacagctgggtacagtggctcatgcctgtaatcccagaactttgggaggccaaggcaggtggcatcacttgcaggtccaggcagttccaagtaccgatgcctgg

SEQ ID NO: 713956 - DNA, 198 bp, Homo sapiens
aggacaaaagatattcttcagagggcttgacaattctttgaagattacttctattaaggctagtgtcggtttcttgtgtcgtgtattctacgaagaagcgtatgagcttaagtcgcttgatgatttcaacacggttgaagaatctatccgtggtcagttgcctgctggtggctattaccaaacaagtattgcttttag

SEQ ID NO: 713957 - DNA, 138 bp, Homo sapiens
ggcaaaatattttaaaagcccatttttaaaaaataaatacattaatatagtgtccctgtgtacataagtaattcccaaagttaataaaaagctatgagacattgctagaatttctccaataaaattcctgtagaccca

SEQ ID NO: 713958 - DNA, 206 bp, Homo sapiens
ataccgggagcagtacaaggcaattacccgacgagtatgtcacccgcagcaaagggcgctgctcgaggccgatttcactgaaaaaggtctgcccgtcgccagggctttaggtacagtgcgggatgcccagagctatctatcagtcacatggtcgcaggcggacaacatgccgccacgtccgcctcgttttgcgcctgagcccggcg

SEQ ID NO: 713959 - DNA, 2069 bp, Homo sapiens
  misc_feature (232)..(233): n is a, c, g, or t
  misc_feature (235)..(235): n is a, c, g, or t
ctctcacgctgccttcaggatccccagcccccaactcttcttcctgaggatggaaatccactccagccccactaggactgatgtgggtgccatacaggcaggagcagcccaccaggaaagtgtaaggagggagctgaactccccagagtagctggaccacagagacttgggtcagagctgatttcaaccccagaattgtctcttgggttcaccctactcttctgaagatgannanttgtttggggccttggtaaccgatagcggtacaaactccaaggcactgtggacttgagtccattcctatctgacctctttttgtccccctcaagcctcaggggcctcaagccttccttagtagcccttggtgactgggccctgagcccaagcatccttctttcccaacaaccctccttccccatccttcccccacccttacctacacccaaagtggagcacactgcagtcagattctccaggagggagatccaagcctcctcccaggggtggagtccactctgggcttactttgaggcctgttctgtggattggtgagccaagctggcactccttgccctggtcttacccaggctctctgtccccctctcacttcctgtggggccggaatctgtatttatccatccccctttcccttctttatagaagtccctgtcctaaactccctccctagcccaagagagccccagaactggggaagcctgacccatacagaatggggagggcactctaggcaggagagacattaatgagcctggctgcagagtggccctggaaaggcaggccagagtggctgagaggctgggagtaggggagcctgttctctcagcgatagtgatgggggtgcctttccgagggggtggggtgggaagaccaagggggtggggggtagatagggtacatttaggagggttttcctccatttcttttttctaactgcctggattcaccattggattttgtaaatggaaaaactgaaatgaacaatgctatactggatgttttctctttctgactgtgtgtgtgtgtgtgcgtgcgtgcgtgcatgtgccctgtctgaccacatgtggagagacatgattgagtgatagtgtgtgtctgtgtgactttgtgtggggaggcactcctgaagaaaacttgcccggtgcacacacgtaaaatgcctgtatatggggacagatacagcacgtgcatgcatacacacacacacacacacaccacagttgagaggagacaaactagagtatgtgcccgtggtaggaagtcgagtggtcaagagatggatcttggaaactacataggtcggtagcaagagggtagactcccatctcacaagatgggcctcccttggcccaggccctgagcacgggagggctggggccgccagggaacttgaaaacctcatctcctcacaaagcctgtagccccatctcaaccccgtctcagtctccttcccaaactcaaacaaggtgttcctaaaattggaccaccatggagaatggggactgggaattgaggatcaaatgtgagggaaactgatgaggttaggaaatgccccccacaaagtaatggcttctggagggactgctcagtctgggatgggagcccttcctaggggccactgtatgcagctgggactttggtcagctttgaccaaatttagagggagggatgtcatggggaaaaaaaacccaagcccaggagtctacccagccagcctgctccctagacagttaatttactatctggttattctctcaggtgcacagaattgagttgaccatactcctcagttcttggcacactatatcatcattggtccatgtgaggcccttttatttttttttcttcagttttgtccccttcatcacccattcctgatcccatcctccccgccccctacacaggcacccactctcgtgtatttaacgtacgtccttccaatccaccgttcatgtgtttatttacatatatgtgtatctgtgaaaaatgtatggtattgctgtgtgttttaatttacataacccgtcatgtcccctcccccacccaacaca

SEQ ID NO: 713960 - DNA, 181 bp, Homo sapiens
ggaaaaaaattttaagtttcagggccaaaatcggagatccagggtggagatttaggtgagggccccggcaaaaaaatgtcctaggaaaaagtccctgtccaattttgagttttttgccctttccaaaattttgtataaagtttattaaatttgtaataaccgctagaaccccctggttgca

SEQ ID NO: 713961 - DNA, 1096 bp, Homo sapiens
gcggggcctgccctggactgctgacgccgccacagcttgtgggccagttctgcccagtcagtggtgatggctcgtgtctggcctcgtggggtctgactgatcccccgtgtgtagtgcgactgtgccctgtccatgtgcctcacttccctgctgtcctgcaaaactggtggtggacaactgcagcctaatgtgcagagcctgcgccaatgtgtccctcgctgtcgcctgggctctggctggcctgaccgggcctggggtccgagcgtgcccccgggcctgggggggtcgccgcgatggactcgctggcagcgcccatggaccgcctgtgtgcgagcagcttgctgtctgccgctgggacccagtgaccagaggcgtgctcaatggacatttgacaatgcatgtacgtggcgcttctgacacacttgccccaacacaggtgcacaccgcaatgtccggttgacgcacacacggctttgactttcacactcaattggtggcatggtgaagtcagtgcctggtggaagtccacactggtccacaagactcttcctgcacagacttgtccaaggaccggcaatgccttgctcagtgcttgacggagcgcaattcacgccagacgggtagagcattcctaaaacaccaccacgttggcaccttgaccgagaaggggacgtccaatcttgaagatcaccatcgtggcacacgccgggaatacgggaggcacgccatggtcagcaacaccggaagtgcttgaaaacccatcagccgacctcatgtgggaaccaggcagctttgtagcaggattccgtgcagtacgagcggactcaaccggaagaaccatccaacacacagatgactggtgcttatcaggtcatcgtcccccctatggggcattggccttgggccaaagcagagagcgggttccctggcacggacattgacgagagaaagtgtcaccagagagcccctgactgcgccaacctccgtttctgttcagagtgtaaccggaaacaagcagaacgcaccctggagcactatcagtcgtggacccatacacatcccagagtgaatctacggaagcacaacaccagagatg

SEQ ID NO: 713962 - DNA, 233 bp, Homo sapiens
cacacacacagacacagagacacatacgcacacacgtgcacacatgtacacacgggatacacacacacacacacacacacacacacgtgctatatcgtgagcacgcccctcgcagtgggtctcactcgttgcacctttcttcagagattattatagtgtgaagagatttattatatactatttttctctctctttttttctccaaacatcatcttattatatcttattaagaa

SEQ ID NO: 713963 - DNA, 365 bp, Homo sapiens
tccttatactatccctattaggcatacttataacgcgctaccatcatgctacgcaaaacagcactaaaatcgctacattgcgtagtcttcaatacaggcacatagcccacgtagtaacagccatactcatccaacccccctagaagctacaccaggcgcaatccttctacataatcgcccaagggcttacattcctcattactattctgactagcaaactcaaactacgaacgcactcacagacgcatcataatcctctctcacggcattcaaactctactcccactaaatagctaaaagatgacttctaacccgcctcgataacctcgccttaaccccggtgtctggtcgggccaagggggatc

SEQ ID NO: 713964 - DNA, 332 bp, Homo sapiens
tcagagagtacagttgcctcataggactttaaccccttgagattttcattctactcaaatcctatcacaaaaccatctcgctagtttataactctggctcgtaactagttgataactatatatacatacatacatatatatatacacacccacacacaaattagctgggtgtggtggcgcacacctgtaattccttccttcctccctccctctcttttttttttctttctgaggatggagtctcgttctgtcacccgggctgggagtgcaatgggcagattcttgggcttcactggcaacctccgccttccggggttcaaggcgatttcttc

SEQ ID NO: 713965 - DNA, 430 bp, Homo sapiens
gtcttcctcaaacaatggtggggggggggcgctccgcgctcctaccatacaagtgagggtgggtagagttgtagtgcacatccgaaaatggggtggttgtctgtgttgtatctaccatgtgatgatgtgtgtggggtttaaactagcgttagtgaggagttttcacaacaaaactaagtgtaggtatactggagcgcgatcagggtgtgttgtggtagtagtatgtagaaccgtcaaccgcggcggggttggtatgacagtagagacaggtaatgaaatagtagagaagtgtaaaatcgatggtgtgtgagggtttcgttccacacaatatagttgtttatgtctttgttactaacattcttataatatattggttacacgctccgtacagttggatgcagaggggaggtgagaggtggtcggtcacgac

SEQ ID NO: 713966 - DNA, 844 bp, Homo sapiens
ctactgcaggtgacttgccagtgctcctcttcctgctgctctgcttctgggctcctctctgttggtcactataccatagaggctatcccaatcatggtgactgtcacccactgggacattctgccattgctactaccagaagtcagagaacctacccatcgcaggcgacaggtcaccagacttcaggcccatagtcctcatatatctggttgactgagtgagtgctgaggccgatcggagtttgtggaggaactgtgaccggagcagtccaggatggtgtggatcgagtatgccgaggtcctagctggtaactatgatcacacaaacatcaccgacagtatgtaccatgcatagattctgtctgcagagagaacgatgcatgtagccaatcagcaaccctgaatgtacggcacctgcaggctcaggaagtttgactgtgagagccagtttgcaggaactatccatctattgaagcggatcatacaagaaggttcatggacctagaactgggcagcgctgcctgcccaggagctggaggagtacaacaagatcctgttggatatggaaaccacctacagcgtggccactgtgttgccaaccgaatggcagctgcctgcagctcgagccagatctgacgaatgtgatggccacatcccggaaatattaagacctgttatgggcatgggagggctggcgagacaatggcggcggagagccatcctccagtttaaccctgaaatacgtggaactcatcaaccaggctgcccgggttcaatggctatgtagatgccaggggactcggtggaggtctatgtacgagacaccatccctgggagcatgaact

SEQ ID NO: 713967 - DNA, 293 bp, Homo sapiens
gacacagcccttcctcaactccggggacagactggatcctcacaaagctgagcacaacagccactacgactgagtccactggatccacggacgccgcagattctccacacccaggtagcacctggatcctcacagagcccagcactacagccaacgtgaaggtagccaacggatacacggacaccgactcctacaaccgggcaacagatggcagcctacaaagtagcagaccagcacggacaacaaaacacacagtcatacaagatcccagagacattccctcctccagtcca

SEQ ID NO: 713968 - DNA, 119 bp, Homo sapiens
tgcactgttgttcatacttgcactgttgttcatacctgcactgttgttcatacctagtcgctgtatcgggagtatgctgttcgaattcataagaacagttagggtatgaacaacagtgt

SEQ ID NO: 713969 - DNA, 268 bp, Homo sapiens
aaaaaacaaaaaattagccgggcatggtggcttgggcctatagtcctagctacacaggaggctgaggtgggaggatcatttggacccaggaggtcgaagctgcagtgagctgtgattgcaatactgcactccagcctgagcaacagagttgagaccctgtctcaacaaaacaaaacaaaaacccaaaaaaccacaatgagctgtcacctcatacctgttaggacagatattataataaaaacaaaaaataacttgtttgatgaagatg

SEQ ID NO: 713970 - DNA, 249 bp, Homo sapiens
gggccggtgcagaatacgcgagtttgctcttgttgctccataagagagggacttctgcatgtgcatatctagacacggccacgcttgagttcaggacccttaattaagatcctcaagttggctggaggatacatctcgcgagtagggtaccaggtcgactatgaaaagatctagctttcgtgggcaacgcggtgaaaagaatagttgcgtttcggtgggtgacgcagcgtacatgctgcaccaaagggt

SEQ ID NO: 713971 - DNA, 951 bp, Homo sapiens
  misc_feature (85)..(85): n is a, c, g, or t
tgtgtattaaaggataagtcttcattgctcaagagtatgttacaaatagatcgtacgtaacatcgacgtcgcctttggtcgaatngtccgtttccgttgagttgattaggaatggcctgtcgctctgggacgtgatctctctattaagtccatcccctatgagatgctgatgacatccgtgtacttcagtctaccgggggatggtggaaggagggagaagaggagagggtcgaacgggagaggggcctctattgtcgtaaggtaagtctcccataatcctagcatcgactggtcctgtatgattcgcactatagccagcagtgtgctatcagatgcagacgttttgtaagtcagaacgatgcctgctgcttcatgtgtaggacagatacgatatctattttgtagccaagcatgctaagagctctttaacgaaatggggcgttgaccatagttgtcatcgatgaaactagactgacgacgctctatgtgacactctacgacctatattcgtgagagaataaccactgtctggtctcataaagtttgatcatgcgataacatctcttcgagagcaatgggacgattcgttaagccatccctacttgcaagacacgtggtacttgctcgacgcgtactatggtctcactttgaggcgatgtggagccaagcaggagaggtgggcaggcatagggatatctagtagccaagtggtgaaggatgcaattgtcaattgccatggaatggctgctactcccatttattaatggttcccatgagtttctaaacgatctctctggattcacgacccatttggagtcggtgactggccaatttctccattgggcctgtggtgacctaattaacagtaaaacacacttaaattccatacttgagcatagtcactactttgtgggcgcgacaataattactaaaccgggtaataagcactcg

SEQ ID NO: 713972 - DNA, 793 bp, Homo sapiens
agcgtggtagtgttcggggtcaccgggcgtcccgggcgcggacatggcaaggacgcagccgtgcgggcccgcggacgctaggtgctggttcggcgttcgctgccggagcaggcggctgcgaggtgaagcgtggtgcgggctcattcagctgccccaactttcagattgcgaagagcggccgtgagaatctgaagaataatcgatccatccaaatttgaagatcctatattagttcctcttcaagaatttgcatggcattcaatatctacaggagaaaaaaagggaatcaaagaatgaaacctgggaatattcttcctctgtgatttcttttgttaatggtacagttgtctgggtgatgcatttggatctgcagaaatgggcccacgaggtgtgggatatagttgaccattaaaagcctctgcacttaatgacgcactcactgaggatttttccgctaagttcttaagagaaacaagcatgattcgagtttttggacattggtattgatacttctccaatttggaagattgaattttgagctatactgtgatgtgtgtctcaaaacttgttacaaacttccaaggtcttgtgcacaggaaaaagcagggttttctcaaccgtggccataagaactacatttacaaaaattcccatttttccattcgaaatacttacagaaatgggtgggataccaaggcaggcgataataagtgttttggaaaaccgacattaatggggcaggtgattaagggcaacatttgaagatgaaaactttggagtctcataataaaga

SEQ ID NO: 713973 - DNA, 195 bp, Homo sapiens
ccgctctcgtgagactcaccacttggaggaagatcgaacgcgagcaccatttgagcatggggagggatctctggtcgtgtgtccgtgctactggcgacaagcgccgagcgacagacttaattattgtaggtcttaccggatatgtccatgtgcaggacgcagatgtagagcgagggtaaaaagcagggtttagca

SEQ ID NO: 713974 - DNA, 1157 bp, Homo sapiens
gctcgtggaagtgacttcgtctttaaacccgtgcgtgggaatccctgacgcaccgccgtgatagcccacggaacgacagggacgagccatggtatgtccaagctgagcttcctataatgactcatccacaacgtattgcgatcgatgtatcgcgatacatgtttgcactcgtgtggcagcagagcgaatagtgggactccaacggcaggatgtcgagcgatgagtccggctagtgtccacttcgtcgcgtgacaggctcgtgagttgctagatggtccgaagaagcaccagtgtatgtcgacaagtgcgcactcacgagtgggcattccttagagtaaaacacaagactcgcgatgtctgctaggcagaaaactggtgtggtcgcatcgaatatttcgccggtgtcggagactgctagtgctgcattttgttagctatgccagctcaccaggaacggatcgcgtcagcgtaggatcactcacggggtacccatgtgtgcctcgtgcgcaactgaagggtagccgagaccgtgcatgcctcgaagtctggggtagcggcatgtgacccacgatgttgaagctcacgtgagtggcactacgtcgccatgaactatctggatactacgagtgatcccgtgagaaggacactcgcttatttgtccaaggcgttataggggtattcactcgagctagaagatcgttccacgggggacagccccatttggaacatcgctgaagtcgatcgttgctacgcatgtgatcgacaggactgggtaggaccaagagctggagagcgcatgactgaacggccacaagcgtggctgaaacgtatgcgtacaactaatctctccacctatctctccttgttggcgcgtggtccagtcccagcagggtggtttcggaccaagttggtcaggcacatcttagctaactctcttgagaggtgcattgtagtatcagcgagagagacaaactcctgcgatttcctcgactatccttgggagcggtggtcccgcaagtggttgcccagtgtcatggtctgcaagattgtggtaccccaaactggttggcatcaggtacccccatttctatcattcaacgggttacaaaacgagtccttgggccttgtctgggggagacgggatttacaccttccca

SEQ ID NO: 713975 - DNA, 893 bp, Homo sapiens
  misc_feature (594)..(594): n is a, c, g, or t
  misc_feature (790)..(790): n is a, c, g, or t
tccccaaaattttaaaatttttttaaaaaaaaaaaaaattttttccccagaaagttttccccttttttttttttactgtcttagttgccccggtccatctctgtagtggggaagcgcgtagaaaaaataattaacgtcggcgcacttattacgtggtagcctagagaaaagtagctcttcccgccctccttagaggagtgagtgcttcatcaatccccaccatcctccacccaaccacatctcttttatttatatgatattttattataccccctctctatacaagagatcttatcatcaaacaaccaacgaataaaatatatctactgacgccaatacatatagtgcgaaaaacaaaaaaacaaagagaggggggcggcgcgctccacctacaagacagtatatatcctctcccgaggagcgggcgccccaccagacgatctacagtagcgcgctcacacacacgactacttctttgtgtgtgaccaaacaagagcaggagtgcgctccctcaataaagtagaggagagagcgaccgataaaatatcaaagacagctgcgagccgaacgtagggcgcgcgcgcgcgcgctttnatacacacaaaccgccgcgacggcgaagatcgagtgacgaaacacggcggcgtctcaacccgagaggagcagacctcttgtcggtgagagagcgagcacaacccctcatataactctcgcgccgcggggagcgggcggaccaactacataatctcggcgcgccgaaccaaccacccgcacgcctagacaggagaanatatatctaaaacacgcacgtccccaactaggaggggcacgacaatactaacactagccacgctactcaacaaagacgagtgacaaaaaagagggcggcggca

SEQ ID NO: 713976 - DNA, 527 bp, Homo sapiens
acatgctctactcttgaaggatcgtacctcattgcatctcagaaaaagttagtgatgcgtttggaacaaatttaagcttagacttaagcacagtctgctcccattatttgcggtaattctgtagtcatcatgatcactcatttagtgctgctgagccaatgttcctgggagtgatgtagagttttcaccagagatagattgtggatcataatcttgaatcctaaaaataactcttcctggtagatcctattttctttacaaaacagagaatgctgctgggtgtggtggctcacacctataatcccagctcttcgggaggctgaggcaggcggattccttgagctcaagagttccaagaccagcttcggcaacatggcaaaacccttctcgtcaataaatcctcaaattagccaggtatggtggctggcatccgtggtcccagctgctcgggagggtgagtcaggagaatcacctcagcctagcgcgccgcaggatgcattgaggcgttgttcaaaaaacagccctcc

SEQ ID NO: 713977 - DNA, 160 bp, Homo sapiens
cgtgcaactgaaattcagcagcgggagaagatggacaagagaaagctcgggcgacggccatcttcatcctgataagaaatgatgttaaatgcaaaaccagaggatgtccatgtacaatcacggactgtccaaattcagaagctcagacacgctggagtct

SEQ ID NO: 713978 - DNA, 850 bp, Homo sapiens
gaaacggtcaaatggcccacgggggtgacgagtctgccatagaaaacccgcggggcgcgcaaccaatagcgccgccgtgtcaaggacccaaagtctgacagggacacaccacgcggtgcgcacagggataaattatcggaacgcgcccccgaggggacgcgttggttcaccaagaagctcgatgccccaggggaagaacaagcccgtcaggtggaccccccacggtgctactaccacacgggctcagaaaaagcagcccccgctcttctgcaggaggcagcaaaaaagacagccgccagtggcagcgggcagagaacacaaccgccccgcgcccgtatggtagcgttgtcacccgcccaggaagagcacacacattttggggcgatagaccaccgattctgtctgccgacactctgttgataaagcccgtttgggtagaaaaacagaccccgaagtgccaacatttgtggtataacacaaacaaaagtgtagcctaacgtctcatcttgggaggagaggcgaaagtctcactcagtaccacattattaccaacaggcgaggtgtgtttgatgctgttcgtgttggtgagctcgcaccacactatcattgttcaaaagagtggcaccgccttatacacactcgccacaacgaagcgatccaccaaccctccctcacgcacgagtgtgctcacacagttgttatgggggatctggcggaccttttaaaaagaggtaggggagggggcatatagatgaattttattagatagtagcgccgtctgtctagataagcacgaaaatgatggagggcaggcttatttaaaacaagaaatttcccccccccacataac

SEQ ID NO: 713979 - DNA, 729 bp, Homo sapiens
ttacagccaggctacacagccccaccgcctccacctccaccaccacctgcctacaactagggtgtgctacggcggttacaagcccgggcctgcgtatagctgatgtgagctgaaggcagcggatgctgctgcacttcagtaggtgcagtccgtgagcgaggccagaaggaggggggatgaggacatgagaggccaccttagccgccaaaggtattccgagcgccagcgacatgagctggaggcttatcccgcaggaaccacaggggtgttacctcacgatcacgcgcaataaccgagaacagtcccaaacaaagagcacgcggcagagccccccgggggagccccactcaacaagcgccagcacctgggcgaagcaccataccgacctgcaacagcccaccatcccgaggaagccaccggaaagcaccccagcctcaagggccctgcatcagcctacaccaccaggggaggacgcaaccctagggaaagggagaacaatgaccacattccactagcgcgaacaagggcgactcaaatacaagaaagaacaccacaacagggccacagaaaatgaaacgagcgctcacacagcccgatagagtgcccacacacgtcccacacaacaaacacaaacgcagccgacaacatgccaaagcgataccaacaagacacagaggaaaagaaaaaaacacaacgaaacacaggaacaatacaatgaacgacaaaggg

SEQ ID NO: 713980 - DNA, 170 bp, Homo sapiens
ttagcacctctaaatcaccacgctcaaaagggacaagcatcaagcacgcagacaatgcagctcaaaacgcttagcctaggccacacccccacgggaaacagcagtgattaacctttagacactaaacgaaagtttaactacagctatactaaccccagggattggatcaa

SEQ ID NO: 713981 - DNA, 203 bp, Homo sapiens
tgttacctgatgtcatcccgttgtagtctcaatcacacctctaagttcttttatcctcatttgacagatacggaaactgagactcacggaggttagtgtacacattgcctacgtgttacaccagccacgtaaactctgcagagctagaccctgaactcatgatttgccagcctccacaaggcttccagcacttctaacgcgta

SEQ ID NO: 713982 - DNA, 410 bp, Homo sapiens
  misc_feature (11)..(11): n is a, c, g, or t
  misc_feature (23)..(23): n is a, c, g, or t
  misc_feature (43)..(43): n is a, c, g, or t
actcgggtcanaacaaacctccncctcccgggttcaaataaancctcatgcatcagcctctcccagtagctgggataaacaggcacacgcccacccacaccctggctgaattttgtattttgagtagagacggggtttcaccatgttgccccaggctagtcttgaactcctgacctcaggtgatgcactcacctcggcctcccaaagtgctaggattacaggcgtgagccaccatgcccccaccttattattttttgtagagatggagtctcactatgttgcccaggatggtctcaaactcctgggctcaagcaatcttcctgcctcggcttcccaaagcactgggattccagacatgagccactgtacctggcccaataactttacttttgttatggttgaacattcct

SEQ ID NO: 713983 - DNA, 150 bp, Homo sapiens
cttcatgtccttctccggtcatggggggatcccatgcctccctccctcgacggtgaaggaggccgtcagaccattgaaatcctcgacgaacacctcgagagggaccggtgcagttgtcaggacgatgcactcgtgatcattgcgacgact

SEQ ID NO: 713984 - DNA, 162 bp, Homo sapiens
cccagtgcagtagcgtcatgctgcagacagcactcaaggagggtcgaacaaatccaagagtcgggcttcaaacctaatggtatcccggggggacccaaggggctcttcctcactcaggtcttggcaatctggcatgtccagtttttaaacaagagcggttta

SEQ ID NO: 713985 - DNA, 301 bp, Homo sapiens
tctcttcattagggcactggtgccccttctcccagccttttaagcaacaggcactagggtcacaagcgagctacagaatgacagacatagcccacttgggctaagtgcacattggcgagtggacgaagggaactgggttggatactcaacggtgtacggtctcctgatgcccctgtaatccctggacgattccagtataggctttcaaggaggttgtccttagcttattcagaaaatccaccatggcagagtcggacttgtccacctgggcttgggaggcccggtgaagagtattcagata

SEQ ID NO: 713986 - DNA, 196 bp, Homo sapiens
acaattctggtacagacatgactttggtgaggatacagaggagatgccacttctcactcaccacgtaccagccagcctcagaaggccccagagagaccctgctagaccacggagggagcgacacttgaatgtagaataggcagggggccctgccccaccctatgcagcacttacccgggacccgaggctctaattt

SEQ ID NO: 713987 - DNA, 393 bp, Homo sapiens
tgatatatgatcctaactttaagacacattgacgatatttgcaaaataatttcaataaatgtaaattaccgttataaatgtctctttgtaacacatttagaattttaaaaaatttttgttaagaatttatgtttagacaatttcttttttttttctaccattcgtattttttcaagaaaatacgggtttcaggttaaactccgtcaaatgtaataccgatttagaaagtcagagttctgagtcggttccaacactccaacgtaaactagtacgtaaactttgttcaagtatccactaacgagtcctgtaaagacaatcttccttagcaaaaggaatgaaaaggaatgcgtgttctcaaggcatcgacaagttcaaacacaaagttgacaagag

SEQ ID NO: 713988 - DNA, 1251 bp, Homo sapiens
gctcatttcgcgtgattctagctgaccaggcggagaccgctgcgtgtcccgtatccagcgtctagcgtgccaagcgctgcgcgaccgcacctcgtatcttgcataccacgcttatcgtcaccatcgcatcgagttaggggcacagaaggtcagttcactcggacaggcagtcaccggaccgtccgactgcagtccatagtgagaaagtgtaggtggttaacggtggcctcctcagcgaatgactctccgggcggatcaccacttgtgtagagctcttagcagcttctgccccggaggaagagcagtgcagcgcagcgcattgcaccgcagtgtagagtgagaaccggcgtagtgcctaacaggcccaagacttgacgtgctcagcctatgggcaaagcaatcccaagtcatgggattactactgtgtgaaagcctatgtgcccaaggagaaccctgtgtgcggcagaagaacacgcgagccaagcgaatcgttgtttccgtatgtgactttcgttgggtgacacaaatcgaggggacagacttgcaagcattacgagcgtggagaagacccctaaggaacttggtttgtgcacacaccgcctagaaaacacttggattgactgtggagcacaagtggacccctattccacacaatcgacgcaaaactaggtgatatccttctcccatttggcgcacaaacaacacaggcaattggaagaacgaaatatgagtaaagcggcacatggcggggcttggcacgcaagaaagccctccaagaaaggttacgtaatatatggatcaaagctgcgattttttacccccccatgtgaagattagccatgtatctatggaccatgcgtggagccccgtgagggtatccagggcacctcttctttgatataggccggaagttaacgcagcgtggtggatgtacaatgtgcgcgtagagcgtccagagtacaacaatacgaggcgttcgaacttctacgaacatatataagtttaccggtcccggtcacgtttttggcttaccttgtggcgaattacgtccctaacggtatttgcacatttaccacctaccacttttatggcgtttgccccctatgagagggaccttctgcagctggaagagcccacgaagtttgaaggaagcgcagacgattactcgcgcagggaagagctaagagaacggcgggtagcattgttgctgtcacaccggcacaggcaaccagacaggttacaccctttcgc

SEQ ID NO: 713989 - DNA, 331 bp, Homo sapiens
tgaccatagaggatcccgcccaaacaaccagtcgtaacgcaaccagtcgtggagggagggatatgaagtagatagaaaccgacctggataactaccggtctagaactcagatacacgtaggactttaatcgtatgaacaaacgaacctattaatagcggctgcaccatcgggatgtcctgatccaacatacgaggtcgtaaaccctattgttgatatggactctaagaataggatatgcgctgttataccctagggtaacttgttccatatggtcaagtaataaggatcaatatgagtatagtaagttcgtctaacgactggttgtatggg

SEQ ID NO: 713990 - DNA, 185 bp, Homo sapiens
ggcgggaattattggaggaggtaatttcaggcttacaagggttgacccaaccgcaaggaacatattgccacgttcctcgtagagatttggacttggctaaggacggttcagcttgaaggtttcattgggtttttaaggtgcttgtggctcacttgaggcttaagttaggatttccttcaattagt

SEQ ID NO: 713991 - DNA, 726 bp, Homo sapiens
agcgggccggctaatttttttgtatttttaatagagacggggtttcaccgtgttagccaggatggtctccatctcctgaccttgtaatccgcccacctcggcctcccaaagtgctgggattacaggcgtgagccaccacacccggcctattttttgtatttttagtagaaatgaggtttcaccatgttgtccaggctggtcttggactcctgacctcaagtgatctacccaccttggcctcccaaagtgctgggattataggcatgagccactgtgaccggcccctagtcccatttttgtactatcttttcatattctacttcatcttatttttctgttatccatctttctttttttttaattaaaatcttccctacttgttcttttacaagggcatttgtctgttactggccttttgaatttctgtacacttttttatttcctttgagatggagtctcactctgttgcctaggctggagtgcagttgtgtgatcttgactcactgcaacctctgcctcctgagttcgggaaattctcactgcctcagactcccaagtggctgggattacaggcatgcaccaccacacccggcataatttatatattccttagtaaagatggggtatcacatgtgttggccacggctgggttcggaaactcctggactcaggtgattcgcctgctcaaccttccaaggttgctggattaccaggcgatgacaccat

SEQ ID NO: 713992 - DNA, 611 bp, Homo sapiens
  misc_feature (166)..(166): n is a, c, g, or t
ggaggaaaagcagagtatcgcacctctgaaaggctcaaaaacaaaatggacagccatcctcccagactctttgcatgttccaacaagacaggacaactccttattgaagaggtgccaggagagatgactcaggaagacttggctccagatgatgtcatgatctggnacacctgggatcaggtctttgtttggattggaaatgaagcaaatgaagatgaaaagagtgaagctttaactttagcggccaaatacatcgaatcagatcctgccggtagggataagagaacccctattgttacagtgaagcagggttttgaacttcccacctttacaggctggttcttggggttggaatcatgacttctggagttctgacccactgcatcgggccatggctggtctgaaaatgtaattggattgatctactgtaacaccaagatgactaaatgctgtatgctgcccattgtttacctttttcatccatgtttgatacccgtctatggaaaatctaaacatgtttcttgtcgaaatccttttaaaatgcattagaacttgaatttatttactgatcaactcattgaaaaacacaagaataaaaaaaaatatatgta

SEQ ID NO: 713993 - DNA, 210 bp, Homo sapiens
cttcaccttatgcgtgtgaggataagcacatatcagcaagccaggtttgtagtacctcctctggaacatcaccagtatctcagcttctatggtcagacaagtctagcgtactcccctatctctattgacagctgggtgtattgtgcacaaagctagcaacccaacgtgagataagaaaaagccacgtagggaataatgaggatccgcatg

SEQ ID NO: 713994 - DNA, 1708 bp, Homo sapiens
  misc_feature (287)..(287): n is a, c, g, or t
  misc_feature (577)..(577): n is a, c, g, or t
  misc_feature (617)..(617): n is a, c, g, or t
  misc_feature (619)..(619): n is a, c, g, or t
  misc_feature (623)..(623): n is a, c, g, or t
  misc_feature (1074)..(1074): n is a, c, g, or t
  misc_feature (1315)..(1315): n is a, c, g, or t
  misc_feature (1708)..(1708): n is a, c, g, or t
ttattcaagtaatcggcaaataggaaacctaaagaagggagccccgaggtggggacaaatcatgtggcatacccctctccccaaaaaaaacggggggagggaggtgtggcccctataaacgccttttatgtggctcagatttcggggccccctttggtcaacttcgtgctgtgacagaatctccatgaggggcgagggcgccacacctttccgctgtgggacctgtggggagagtaagtctccgtgcgtaaccccacaggctctgtgtcacatgtgcgccacaggcncgcgcttcttctccccacaacaagagagaggtttctcttgctggggagaaggggagatctctggtgggcgcaagacacacaggagaggcgcacatgtgaggagatatgaacacattgtgcggcgcgcgcgtggtgatagcacagcccgacgccacatgtgcacgcggcatgtgtcttcagaagaaaagtggcacaccatgtgtgacacacaaaaataaaacacacatacacacagagtgtgtgtcacagagaggtgatatgtgtgtgtgtgtgcacacacgagcgacggnacacaagtgtgtgcacaccacagaaaaaactctgtggtgngngcgnggcccgagggggctagagaagaacccaagagaagagagtggggcggacattgcgggcagagaggccgcgcgacgcaccaggcgggtgttgaagagcctactcccggcatgtgtggttacagtcgtgggggggtcccgccccaattttcgtgagacagcgaggaggggggcgacaacatgggggctctgaaagttgtagtggcgcggaaacacgccccacaaaagtgtcacgaggggggtctaacggggggagaacagaaccaggcccccaacaagaggccccaagcatctctctcaggggtgtggtggcgcgggcgcccaccaaggggggtctcacttatggaggggcccctcaaaacgtcgtggggggaccaacatcaaaggcggtcaagacgtggggaagtcccctcccacaattatccaacccccagagaaatatatattgctgtccnctccccaagagaattccccccaaggggcgggagaacgggggccaatgggcgggcgtctttgtgggcagccccaacctggccgtcaacaagcaggcggacgttctgggcgcgcgttttcaccgctccctttccttggggatttcccttgttgaaagccccgaagggggggggctttgtccccaccctctattcgccgggggcgctccagcgggcacttttgcggcgaaatcgcgcatcaatnatgttgggtcgcccgccctgtctcgtcgaccaacaccacactgtctgggcgtcggggggaaaacacaccgggcggggcgcacagaaagcccccccctctcacatgtggggccaacacctctgccgcggcctgcaacggagagcgaggagacaatacacagaggtgcgcacgcacaaacaaacacggacgcgtgcggacacccaactaaaggacgagggagaagcaaccctaacggcggccacattaagtagcaacccacacgagcactcacaagcgaaaagaagaggtgcggcgccacataaagacagagaagagagtccccccacacaagaagggagcgaacagacaacagcagaatgtgaagtacggaactgtacgtacaaccaagcatgn

SEQ ID NO: 713995 - DNA, 390 bp, Homo sapiens
  misc_feature (9)..(9): n is a, c, g, or t
  misc_feature (30)..(30): n is a, c, g, or t
  misc_feature (385)..(385): n is a, c, g, or t
taaacccgngattaccggaagccttttttncctataatttttaaaccttttgaacccttttgtgacaataccttagcttaaaacacctaatacattgtaactgcataaaaattgtttctttgttttttgttttcttttgtttttttcttgagattgtgccactgcagtccagccctgggcgacagagcgagactgtctcaaaataaataaaataaaataaaaaaattttaaaaatacagaaattagctgggcatgtcaatgtgtgcctgcagccccagctacttgggaggctgagttgggaggatcacctgagcccagaaggtcaaggctgcagtgagctgtgatagcaccaccatactccagccttggcaacagagaccctgantagtt

SEQ ID NO: 713996 - DNA, 1238 bp, Homo sapiens
tgggaataatgggggaacttcgtggccaccacctcgtacttgtgggggggtgtttttctgtggggggagaaaacacctctgtcataggggcaaggaccacacctctcggatggggcccaccaccgaggtttgtttcgctgcgtttctacagccaccccacaaactgttgtgccacggtcacggtgacaacaaaagttgtctctcctctggggggcccccctaggcgtttttcaaagacgacccggggggcgccttttagccgcctctaccacaaaattttcgagaagaatctgggtcttctcccccgggggagagaagaatagaaaatagggccggccgcctgttattgtgttgacaacacaacaagtgggcgacaaagttgtcttctgtgtggtggtgtggggcccccccacttctgggcccccaccacggaggagttgtgtgtgtggcggcgcttcatcaaaacacacttgggagcacctctcaccacgaccactgttgttctcgtcttcaccagcggagaatagacacaccacacgtgtggtggtgaagagacgactctcctcgagacgacacactacagtcgtttgtgtttgtcaacgacgcaccacgcagggggggttgtccccctctctgggtgtttctcctacaccacagtgtgatcaccctgcgagtgtgtccccccacaacggggggacgaacaggcacaccctcatactcttccagtgtgtgtcacagtgcgtgtgtgagagagaacccagagactgttcgcagaccactgttgatacagcccgctctgtctggtgaacacaaacacacgcggccacaacccaaaaagggggcccccctcggtgcgagaggagactttttccgccactgggcgcacacctctctctaacacagcgccggagcgccacgagcacccgccacgggggttgaggtgtataaaggagagaaaattttcccgccctttttacaaaggcccacgggctttcaccacgaggataccacttgttttcctgcccccaaccgagtaaagtgcactgacgggacacataggagcttccccacgggctgaaactgggagttccggccacgccacggtgagcccccaccgcttctggagagtttttggtttgttcctttcccgagcccctgccccgggttcccgccacaagcaaaccctgcccaattggggtttatcctgcacaattaaacttccggaagcaagtcagtta

SEQ ID NO: 713997 - DNA, 276 bp, Homo sapiens
gatgagtaagctagcggggaccaggtgaggtggggacagggagggcgccagcccgctgtgctgggggctttccctgagctgcaggaccctcggggggtcccctctgtgccctggctccgctcctgggcacactggtgcccagctgtgggagccaagatttactcatcggccaagatttattcatcgagcaagattaactcatcgaccaagatttattcatcggccaagatttagtcatcgaccaagattgactcatcgggcaagattgagtcatcg

SEQ ID NO: 713998 - DNA, 685 bp, Homo sapiens
tacgcgttactacgagactgaatcgcagtcgcgagtagacctgagtcatgaaggaccgtgctttagccccaacagagtgattggactctcaagctgacttgcagcacacgtagagatggcggcattctatgactctgcagtccaggatgccctgagctccagtgttgcaagtatgctgaggatgtactgtctggaacaggtgtcagctgacatagtactgtgggccgcttcctgatgagcctggttaaccatagttacctgacaaatagttcccgatgagcttcgcgacctatgctcaacagcttagacattcatatgatccttttgatggtgatccttacctggccagacctcacacacggtcacacgattggcactcgacatgatagaacacttgtagacacctgttgaatggagccccaatgcagtacatcttgctggtctaggtattaatccccaggactcagaagtgaaggcgaaatgggtctatgctggtgggctccttgagtcactactgacgcatagtcagttcgtgtggtgactgctacacttaaccggagcctaccttgtggtaagcttaaccatgaaaccgagatacaaaagcgcgagtgctccaaagtcacgcggaacgggcaacaggcggactccctctgggctcgctgcgcttaggggtctccggaacccg

SEQ ID NO: 713999 - DNA, 785 bp, Homo sapiens
ggctgaggcaggagaattgcttgaacccgggaggaagaggttgcagtgagccgagatcgcaccactgcattccattctgggtgaccgaaggagactctgtctcaaaaatgaaaaaaagaaaaaacttgggctttggcgtcatcctagctactttggaggctgaggcaggagaacagtttcaacccaggaggcggaagttgcagtgagccgagaccgacacattgcactccagcttgggcaagaggattgaaagtccaatgagaaaagataaataaagtaaagtaaagtaaaataaactaaagtaaagtaaatagtgaaagaaagtagagcaaagccagaaagtcttagatggcatgaagcgtcagagagcgaaatgcctgttcagctggccagggctccagtcattatgcacaaagcgtgaagcctagcgacagatgtgcaacgtgttctagactacgcaagttactggcaggaccagcatcagggcacggcagccgctgacgcttggcttgttctggcaagtttaaagttagactggatcaggtaaaagtcgagtgtatatgcagtgcagttatacaatagttcgtatagatgggacttacagtgaccatgtggaaaggccaggatttggcaagtagcaagacagaagcagtttatgtacgtaggccctttacgtataagtttgggatgaaatgcattaagttaaacgttagaagaaaatggagaagagtggtggcctgagtatcagggaatggcaatggtgagaaagaaagcacagtgagagc

SEQ ID NO: 714000 - DNA, 333 bp, Homo sapiens
ccgggagctccgtcgttttggttaacattagtcgactagtgccagggagttctccagataagcctggatttattttcggcagtgaaagggccttaccggataactgactttatgcttgccctgccccgtataaaataacttaaaagcagcgtgccttggctacagcttgttccacgtgcggtgctcgccgtgagtgatcacctaccctacaggtggtagatggatgcctgaagtgtagactgctgctagctgaataccatctgggagcataaagttgacctgaaggatgtccttggtgaggagtctgaaaatttgatcttcacaagagttgcc

SEQ ID NO: 714001 - DNA, 156 bp, Homo sapiens
aggagcaggctccagttgtgaagtgaaagcccatgtgatctagtaggcttctatcttcataagtcattgatatcatacatgtgttgcctgatgtgtagctagccagaacatcacggagagccctcaagatgtttcctacagttaaagaaaggttga

SEQ ID NO: 714002 - DNA, 681 bp, Homo sapiens
ggagagagagaactagtctcgagtttgtctatttctgttctggtggggtgagtgaggaatattgtaggagtaggggggtaattttggggggccaaagggaagtatgaatgggggctgtcccggataggccgaggaaacggtgtgggggataaaaaagttaatatttacgccggtgtaatttgcatgagggagatagggagtttgggcagtaaggattggattgctagaggtgattcccggaaaaataggggatagatcataagaatagacatcgccctctatgaatgggtaaatgacttgactccctagtattgaatcatgaagacgatacggggtagatttggggcctagaatcgatgaatcatgctgtcgggagctctatcgcaagtgttacatgatggatcacgtctgagaagtgcgccaacaaacaggcgcccccctcatccgggagccacagcagaatacgcggcaccaactcgtagcgcgcgcctccaatgagccagtggcaagcggcaaccattccagaattcgattgccggggaccggccgtccagagcctcgcaaaatagaactcctcgcacgcctgggtggctgcactgcagaaggatggattgtccaccacggggcgctcgacccatcaccacccccagcgtcaaccgtcggaacgcccccgagcacacc

SEQ ID NO: 714003 - DNA, 142 bp, Homo sapiens
gtaacattgtcagacaagatgtcacgacctaggtggcaggaaacctcctggaaatgtgatttcttgtgattcatgcacaccaactcactgaaccgacccaattcatttgaaagtgtcttgagtcagcacgaactatgttgtg

SEQ ID NO: 714004 - DNA, 232 bp, Homo sapiens
agctaaacgagagctggagtgtcagcacggtgctcatgtgtcgacggaacttgtacacgggatggcatgcacctgatgtggtgaatacacgtcgcccaggctccagcttaacgatatttggagagtcagcacggtgctcacgtgtcgacggaacttgtccagggaggcatgcaccggcagttggtgaatacacgtcgacctgcaggcatgcctgcatgctcgtggtactgga

SEQ ID NO: 714005 - DNA, 109 bp, Homo sapiens
ctaggcaagaagagtactgctggacacacaggctgagttgtgccagctcatgccagctgagagtttcttttctctccccctcgcttaggagtacagttgtaagaatctt

SEQ ID NO: 714006 - DNA, 349 bp, Homo sapiens
gcacgaccacgacagactatgtctgggctgttgacatgtattcacactggaaatttaaaataattccgatttgattaacatactaagggctctaaggaaaaaagtagacaatatgcaaaaatacatgtgtaatgtaagcagagatgcagaaagaatcaaaaacaaatgctaaagatctaaaacactacaacagcaatgaagaatgactttgatagactctgtacactggacacagctgaggaaaagaatctctgaacttgaggatatgtcaataaaaactctcaaaactaaaaatcaaagagaaatgactaaaaaaaaaaaagaacaacaacaacaaccggccaggcgc

SEQ ID NO: 714007 - DNA, 579 bp, Homo sapiens
  misc_feature (373)..(373): n is a, c, g, or t
  misc_feature (450)..(450): n is a, c, g, or t
  misc_feature (452)..(452): n is a, c, g, or t
agatcatgcagattaacccgggagcggaggttacagtgagcccagactgcgtcactgcagtacagcatgggcgagagcgagactctgtctcaaaaaaaaggccaggcgtggtggctcacacctgtaatcccagcacttggggaggctcaggcgggtggctcacctgaggttgagagttcacgaccagcctgaccaacagagaagccccttctctactaaaaatacaaagttagccgggcatggagtcacgcgcctgtaatcccagttacttgggaggctgaggcagtagaatcatttgaacccgggaggtggtggttgcagtgagccaagactgtgccaccgcaccccagcctgggcgacagagtgagaccgnctcaaaaaacaaaaccaaaccaaaccttaatgacttaggaaggtggctttagtggccgcatgaagcacaccctgatngncgaggaacaagagtgcaaagctaagaaactgaggcattttgaagagtttgaagacacttggcttccttatctgacccccaaagatgaattccatcagccgtggcagctgaaatattctaaattaatt

SEQ ID NO: 714008 - DNA, 788 bp, Homo sapiens
gccgaaatcctgcggagcgagttccccgaaattgacggacaagtcttcgactacgtgaccggcgtcttgcacagcggcagcgcggacttcgagtctgtggatgacctggtggaagctgtaggggaactatatgcaatgaggttgtcctggtggacatgcaatggatgactgctgggcatcatgtggcctgtgtgccatgcgcatgtacaacactctgctgtctggcttgagccactaaagccagggaaatagccagtgtgctacttgtgactgcccctatccagttgtcaaagataactggagaactacgacttgtggaaccaaacttccagtgactgctaaatgatgggaacatgtcctcgacagtgaatgcaaagaagttagagaatggccgaggctcgacttaatggcaaagcagggatgacagcgctcagagaaggacacgctcaagaccagcgaaccctctagtcttagaagaggcatcagcccagccaaggcaggcagcacgacaacggagagtcctgttggaactcatcttggcaggacacacaatcctatgcatgtgcgaattctgcggaccttttgactgtgtcctttgggcgatacgagtacttgttggcttggagctggattgttacccctgtgctttgtgcccgcccgttacagggctggttgggccggcactgggtttgggcgatacaactcgtactgaagattgtgggcccccggagcctgggggtccagcccactttccttgttgctgttgacccgcggtctgggatgactcg

SEQ ID NO: 714009 - DNA, 852 bp, Homo sapiens
gcgtcaccgtgtattcatctcgggcgcgttttattgtacatctggccgtgtcttacattaacacaacagggccacatacaagccccacatatgactcaggctggcccttcgagaaggttggctagatagccataggaaacagatagcaggagaagaagaatgtagggcaagtcctcctggtaccagggccagagaaggagaactagggcaagtggctagtagagaccctagagaccagcgaagggagaagttagggaagctacgttctgtatggccaccagactatgcatttcagcctactgttcataatagctactgccctccctaccacccgaagtaactctagtaggtaggatagagcgactactacgcacctaggaccactaccacccgactctcactagacgctactgcacagagggtatagagagacagtagaagcactaatcggatagtaagaggaggacacaacgcccaaggacgaacagccggcagaggtacaagacgaggcaggaccgagccaagatacacatgacacgcacactattaaccccgagcacactagagcaagaagagaggcagataagaggacaggccacacacgataaagaccaaggaacgccaggccaatagaaacgacagtacccatcgtaggccgacgacaagcactacagtgcgtccgatagtcataccctacaacaggacacagtaggcgacacagcggaagccagaacgcacgaacaccaaccagtgggacatcagacgcagctcaccaccgacaaattgaggagcgcaaaacctatcaagggagagtatcaacagcagatcgatacatcaggcatgaaacacaag

SEQ ID NO: 714010 - DNA, 285 bp, Homo sapiens
taaagggcagggtctcactcttgcacagattggagtgcagtgcaggtgtgatcgtagcttactgcatcctcaaagtcctgggctcaagcagtcctcctacctcagcctcctcaccatgcttgactaatttttcttatttcttttttagagacagggtctcgatatgttgcccaggctggtcttgaacctctggcctcaggtgatccttctgcctcagcctcccatgcagctgggatcacaggctcacgccaccgtacccggctgtcctttccttaagcggatcag

SEQ ID NO: 714011 - DNA, 584 bp, Homo sapiens
cggtacctgtttgagcctgctgagtggttagaccagcatcctccagcttcccgggtgtcctgaactccccttccatggggttgtccacatccacagcatttatattgtattgcctgctttctctagtgacttgactccttaaaatgtagacttctgtttccccatcttttgtccttctgaataaagaattcatttatatgcatttcctttagagaatcaaacttggtgtgattttgagaaagaagaagatccataagctcaaaatactgatttcgctttccttgttttcattgctatccctagcacttaacgtggtgtcagatacgtggtagaaattcacatattttaggtgaatgctagtgatgaccagatttttgttttagccttaacctcttctgaattctagtgccatacgtgtaagtctctctctctgacattaccactggggtatcatctaggcactttaaattcagtaaacccagacctcacattatttccctctgggctctcctttcccttccactcccttctcttttttttctgttgttcttctgtcattggcatttccaacctggaaactactc

SEQ ID NO: 714012 - DNA, 778 bp, Homo sapiens
gctatgtgagttcgacacaccatgctgatgtcagcgtgaagcgtgatctgctcttccaagccctgggccgacctacaacatctgagaaggaaataataagtaaagaacaaggtaatgtaaaggcagcaggagcctctgatgttgttctttacaaaattgagtccctgccaatagatatgatctcctgtgtctgggaagggatgggtcgaggacttcaggtcttcaaagaaaggataagggctccagtgtataaacggtgtaatggcctgatggaaaaatccagaaattgattatcacagaagagacagttaagatacgtccttttgcggtagaaggaagttctccgtaatataaggtttactaaaagatcgatatgacagttcatgtgaaacttcaggagaacttacttcagaatatgggaggaaaagagcaggtgttgccatggtacccatgattgtgacactttgtgtcggggccatttattatatgaaaagcgtcctgcagatatcaaattcaagcctctaaataagaacaagggagtatacaaggctgtgaaatggtgaacttattacaaagacgtgacaatcacggtgaaacattttctacattttctttggaaaacaaacccgtgtgtacaggttatctaatgtagcgaaggtggtgcgcctttaaggggcccaacaacaggggggacatccagaaaaaggaaattagaaatttatgaagcgggaacgcttaacaagaaaaatttggattggccagggggattgggaaatgg

SEQ ID NO: 714013 - DNA, 686 bp, Homo sapiens
  misc_feature (686)..(686): n is a, c, g, or t
agcgggcgccagggcccccgcccatccgccctggccaccaccatccgccctggcccacacggtgcgacaggccccaccgctgatccgccaggcccaccggtgatccgccaggcccaccgtgatccgccaggctccaccgtgtgatccgccaggcccgcccgctgatccgccagggcgccgcgaaccatccgacctgccccagaaggtcgtgggcaaccaggccaccgctctggcaggcccttacaaaacccccaaccattccaaagtggacggtgcaaggggcccccccgcaaagggccttaggggccattgcccggggaccccccggcaaggtgttgcaatggagccggggagccgaaaagggagtgacataacagataggcacagcacaggtgcacagcagccaagcggtataccagcagagaaggggccagcgcaggcagccgaggtagggggccacagcgaggatgcagccccaacagcacttaggacaggatgaggccagcggcgcccacggaacagagcaattagggcacgagaacactaggaaattacggcgcccgcgcacacgagacagtgcgtacgagatggggccgatgcacccaaagaaaagcactggggcagaagcggacccacacaaagcagaggacaacgcgccccacagcagggacggaacaaccaaagan

SEQ ID NO: 714014 - DNA, 687 bp, Homo sapiens
ttcttttttgtgtgtgaccctcaaaacttttgaaagttaagagtcctacaataaaacatggaacacaattttggatcattttggttcctagccatattctttacaaataatggcttgaaaaaaacgacgttcaatggattttcggttggggcaacttatacatcccgcgtgtaacaaggccagtattcttaaccatatgaatagccatgaggcatattcggttacctgacattgcaaagttatcatgccaccggtaatagctaaaggggtgaagaggctcaatccttttgcattgctgcagattgaccaaatatgtattttagtctaatgggatttgggtagattggttttaggcaaataagggtagcaatctttgatcttgagtcttcattgtctgccacgcagtcagtttctaactggaaatgatcagtcctgacaacagaatttccacttttggaggcaattctaaggtgtctatgccagccgtcttggagactccatcacatggatctctgagtgaaaggcaaggaggtcagatttattcaattgagcgccagagggcaaaatgccccgtgttggagtgacatatgttctgaggcggattcccctcctgtacagctgagacagcttcttctgccccatcattccatcagtggaccccacggcccaatgctgggaaatccggtt

SEQ ID NO: 714015 - DNA, 408 bp, Homo sapiens
  misc_feature (284)..(284): n is a, c, g, or t
ttcatgatctagcagaaaagttctagcaatggctaatatatggcagccatccagaatttcccctcactactgtgagaggctaacatgtactggtgagttgggctggattgcaaagacatccaatcttgtttttaaatgaatacacttagaaccaggggcctgagagtaaataaagttcaagtcatcactggcactgtgatgtgtctttcactttaagggcttttaaaactgggtctgattggccaagctttaccaaggttgtgttgagcaggaaaaaaaaagcncaatatataaccaagagtcatttgttttatgtatgcattgtcccaaagctccaattcccagtttaattagtatcaatggattgtttctagccagagaagaaggatcctaaagatttttcaaaaa

SEQ ID NO: 714016 - DNA, 941 bp, Homo sapiens
  misc_feature (16)..(16): n is a, c, g, or t
  misc_feature (276)..(276): n is a, c, g, or t
  misc_feature (317)..(317): n is a, c, g, or t
  misc_feature (359)..(359): n is a, c, g, or t
  misc_feature (368)..(368): n is a, c, g, or t
  misc_feature (495)..(495): n is a, c, g, or t
  misc_feature (498)..(498): n is a, c, g, or t
  misc_feature (529)..(529): n is a, c, g, or t
  misc_feature (553)..(553): n is a, c, g, or t
  misc_feature (651)..(651): n is a, c, g, or t
  misc_feature (675)..(675): n is a, c, g, or t
  misc_feature (690)..(690): n is a, c, g, or t
  misc_feature (693)..(693): n is a, c, g, or t
  misc_feature (742)..(742): n is a, c, g, or t
  misc_feature (755)..(755): n is a, c, g, or t
  misc_feature (768)..(768): n is a, c, g, or t
  misc_feature (811)..(811): n is a, c, g, or t
  misc_feature (913)..(913): n is a, c, g, or t
tccggctccgacagcngggtgtccaggccatggggcagccctgggcggctgggagcacggacggggcgcccgcgcactgcctctcgtgctcaccgcgctgtgggccgcggccgtgggcctggagctggcttacgtgctggtgctcggtcccgggccgccgccgctgggacccctggcccgggccttgcagctggcgctggccgccttccagctgctcaacctgctgggcaacgtggggctcttcctgcgctcggatcccagcatccgtggcgtgangctggccggccgcggtctgggccggggctgggcttactgcnaccaatgccaaaaccaggagccgccacgcagcggacactgcnctgcctgcngcgtctgcatcctgcgtcgggaccaccactgccgcctgcagggccgctgcgtgggcttcggcaacaaccggcccttcctgtgccttcagcttcaagccgccggcgtcctgctccacgtctctatacngcngggccctgcactgtcggccctgctgcgagcncacacgcccctacacaaggctgcnctcctcctgcatccctggctcaagtagcacacaggcagagtgtctttggcacagtttgccttggccttcgtgacggacacgtgcgttgcgggtgcgcngctgttcggggctgggctgctctnccatgggatgctgcngcngcggggccagaacacaagggagttggctcggggccagcacttctattanctgggttcctgcnacaacctgcaggnagccctggggccccgctgggccctccgtctggctctggccctncctggcctccccattgcctggggatgggatcaccttccagaccacagcagaagttggaaaaaagcctcctgactcaggaagagcagaactgtcagggaggangggtgagaaggggccccacactagacta

SEQ ID NO: 714017 - DNA, 124 bp, Homo sapiens
gatttagcttgttattccatccactccattgcttcatttgtgcttatattctaccttgtgtccatgtcagccagcatccaaatgatccatcactggtcctccgttgattttttgcaaagcagct

SEQ ID NO: 714018 - DNA, 185 bp, Homo sapiens
cctggcttcagctgcctgagggaagactgacaatctctcacaccacccctcagggtgagcatcaggcacccgctggcctccacagatatccagagccatgtttttcttcaagcgcacaaatgttgaggttagagtcctgtgcatctctgcaccgtggtcatgccccagtgacgactgtgcagaat

SEQ ID NO: 714019 - DNA, 471 bp, Homo sapiens
  misc_feature (84)..(84): n is a, c, g, or t
gacgtagccacctgagtgagcagcagatagtatcaacacgttagttcgagcctcatgacggctgtctgctattctgcaattatntttgagactcccctccgaggtggacgttgcagtgctgaaaagcgcgagcgaaagctgctgcagaaaatacctgtgtgacgaagcagaaggagctacaggcgctctacgccctccaggcccttttagtgaccttagaacaggctcccaaactgctgcggattgttctttgacgcactgtatgacgaggacgtggtgaaggaggatgccttctacagttggggaagaagtagcaaggaccccgctgagcagaagggcaagggttgtggccccttaaatctgtcacaagccttcttcaaaggtggctccgtgaagcagaggaggagtctgacccacaactgagggcaggtgtggctacgtcgaacgtagcccacctgggtccagaggaca

SEQ ID NO: 714020 - DNA, 228 bp, Homo sapiens
gaccctttgtagtcttaactctgaccagacatgtaatacagtcatttatctagtacattctgagaagactcatttttttgacctacctcgtacagatgtgaggatttagatgtccgctaacttcacaactgtgcttcaagtagactaataatatatgctcatatcagatgtcagtattcatttgacttgattcatttttggctcaggtcatagggtactacgctttgg

SEQ ID NO: 714021 - DNA, 1842 bp, Homo sapiens
aattgaggactttgtacgaaggtgggtgtgtttggagtgtgagtcgatcaatggtggttttgcgcatggagagtgggttgagagtgaacgtcgctgcgtgtgcatggatcctgtggcgaggcttgttgcggcggagatcggattatcgtattcgctgagaggaagtagtcgttgaggatttgctcgggtgagctctcgtgatgaattgtatggtgacgtgtgtggttcgcagtcatattttttgatagatgcgtgagggtgtgtggcagtagataaggtgccgagagatggcatctgcccagtgactatgggcgctcgcttgttgtttaagtagtgtatgtgtggggtatcaatagtgttgtgagataaaatttagattgatagttgtagggttaagatagtagaagagttggtatgttggtgagtgaggtggagtgttgagagggttgcagcagtttgagagggttggagtaggagtgattgtagaaggaagttatgcgacaaagatatagtgcgagtgtgagtgtggtggggattgttgtggttgttgtggagtagtagtagtgtaggtatgtggttcgtttcagtgtgggttgttatagtgtttgttttgtgtataggtattgtttgtattgatgtggtgatgtgttgatgtatgtggtctgatatagtgtgatttttggggcttttgtgtatgtatattttgtttgttattgttatagtctgatgattttgtaattttgtgtttatgttgaggtagtatgtatcattagtagtggtgtcggtatagttcgtcgtagctgagtgccgaggcgtcaagtctgtcagggtgtttcgcgaggattgatgagggtgcagtactttgtccgggaagtttatgtcgtgggtggatgtgagagtgggctcgtttaagatttgtcgtagttttgaacccggtgtccagaggtagatgtgttgttcattgtgatgtttcgctgtgtgccgttcaaagggcggtacaatggcgggtttttcggtcgatgggcgccgtatggtttgataccctagctcgtcgtccaatggccgcgtaatggctgcctggagtagcgtcgcgtgctcgaaaatgtgtgacgggagattgcgtggccagtcattggggccgtcttctgtgagagtcgatgggagctaatttcctagtcgccctgctggtctgtatagaatgtcctctgcacggttagggaaggttgctctcaggctgccgtgaatagcatgcagtgcgcggtaagtgtgaggcctctcggcagtgcagggggaggtgaggtgcaggagtcaggcgctcgagggcgtgtcagccaagtgagtgctgataggtaggatagagagagcaagcgccggaggagagcgcaagagtgagattgcatagcgagcgtggctgtagtgtgagctaatgatgtgtatgctggggtgcgtgcgtatgtgtgtagctccgtctcgtagcagagcccgtcagaggtagcttgctgatgtctgccctgtcagccagtttgccgatcggcatcgtacgcgctcagacatttgtgttgtagccacagggcttgcgcacggaccttcacgtcacttattggctcaactttcgctcactagtctgcttcatccgccaactaatatttcacttttacagtccaaacatcagctttggcttcgaagccgccgcctgatactggcattttgtagatgtggtttaactactttgctgtagtgtcgtccatctatgaggggcgtttggtgtgttttgggcggtgggtgggttgtggggggggtggggtggggttgtgggttggggtgggtgtgggggggttgttt

SEQ ID NO: 714022 - DNA, 162 bp, Homo sapiens
atatttgtggaccaagcgaagagaacgagccaaatcagtgtggtactacttcggagctaatggtaaggcttacaagagaagcgattcagctacaggcgatgtttctttaaagactatcaacggtaagaagtatacattcaatactgacggtaagatgcagta

SEQ ID NO: 714023 - DNA, 110 bp, Homo sapiens
  misc_feature (22)..(22): n is a, c, g, or t
tgatctacagatcctctttcgngagactgagggagaagaatacttgaatcggggaggtggaggttgcagtgagattgtactccagcctgggcacagagcaagactgtctc

SEQ ID NO: 714024 - DNA, 809 bp, Homo sapiens
gtataaaatgcttattttttaatttccaatggtaatttattcttcgagatgcgcgcaagcgctcagggtcaagtactgcagggtcatgccccagctcctgacatcctgggtcccgtcagaatgctccttcgaatgggcaaaggaccctgagagttgtcaggccccttcagtgtgtccctggagaggctccagcccttcatgtctctttcccccgacgacctgcacccgtccttctggactcccccgacaatagtagccatccgtggcctctagggcctgctcttaccaggcgtggtactcattcttatgaccgccgcctcccgaccagctgcccccagctcttcctgcccccctcccctctctggcagctagcaggtcaattggcggggaggagtgcggactgaggatctgaggactctagtgggcccaggccctgccctcttacccggaggggctccgtttgcattccttggtgctctctgagtgcacgcctggtgtcccgccctctgttcgtggtgcgggtacgtcctagtgtgtcggtgctgtgatggtgcctgtccagtgtatatatcgtctccttagcttccattattgaagaaattgttctgtacagagagagatgcagcaggggacgggagggcagagtgcaccggaggtggagcagccgcacccccagcaccgggtgtctgcggtaggacacaagaggtgctgagagggtctggtcctggcccaggatcccccttgggctcagcacgaaagggctttcaatgaattaagtgagaacttagtaacctccttacaaaaatgcc

SEQ ID NO: 714025 - DNA, 853 bp, Homo sapiens
cttcacttggggatgtggaattgtgctaagcagtgtaggccacaggtaaatgaacaaccccttcaggtaatggattggaagagctgatccagtggacaaaagaggggaaactatgggagttccgcaattcaacgaatgaagcaggtttgagtgatgatggttcagaagttatcatgaacatatatttctggagaaacacctggagagctttccaacatacaaggaccaacttcgccagcttcagtggcagctggttgacttgtggtgctttccaaaaacccatatcttagtgtgaaagcagaaggttgaacacatagagtggttgagaaagttatttttaagtgaacaaacaaggatattactaaacagaaagtaacataacagtttcaattaagaggcatggaaattattttatttcagaacaacttacgagatggatattgacaagctaaattaaaataatattagctagaaacacaaaagagaaactacaaagatgaaacagaaagcggcgggcgagcgctgtgcaagagacattgcccacgtgaagcgggcaccccagtcaatgcctggctgcgaacgaaatttcccaggcacagagggcgggccacaagaagggaggtgcacagtaccataaggaacagtagagggaccggtcgcctgaaagaacaccgtgcaaaggagaacggggcaagaaaggatgtaacctgggggaattccaggagggaaacaaaccactgtaaccactccaggggggagcgaaaacaacgtgagccacccaagggaaccagaaaagagaatgttaaaacgccacaaagggcaaataccatcaatccaagaggaggggcacacg

SEQ ID NO: 714026 - DNA, 639 bp, Homo sapiens
ctaactagtataaatcacatttcctagagtataaaatgtgactgtgacatcacgttaaatctccatatcacttcatcttaggagatacacctctaaatttcagtacctaattcacaggtggggattcaagccaacttgcctaaaggcaggaggctactcaaactatagttacagactaaatcagcaacagcatcacttgcaagtttgcttgaaacagaaattcttgggccccaccccaatctaactgaatttgagacttgggaagggtgtggagagacaggaaactatgtattaatgagctcaccaggcaatttttctgctttggactataagagatcatgtaattgatttctaaaagttccttctggttatagggtctgtgactacagctctgcaaaaatctgagcaaagaacctcataatcaacagatgaaaactggtaattcaagtccttaaagagatatttaaccatttaacctaaacaggatatttaaacattctagcacaccctaatgaaattatggattaacaaatcttttcagcctggaagttacataacattactcatctaggaccaggtgcagtggctcatgccttgtaatcccaacattttgagaaggcgaggtagaaggatcacttg

SEQ ID NO: 714027 - DNA, 880 bp, Homo sapiens
cctatgtccagcaggtggcgcgcagcggcggtagccgagcgagggcgcggtggcctctgacaggaatgactctgcgcacgtgcgtttcgcagcagtggaagtcttcacacccggaaactcgactttggccgtttctccatttctcctcacgcactgtctttccttgggccctcgtcactcctggcaccgggggaagggcttccccgcctctggccgggcgctggggcgcgaccgaaggcgaggcggcggcgaggaaccttctggaattcggccgtcggggcaggcgtcgagtttacaggagaaggcgcggtgtcccgggatgagcggagtcgccctcacttaaggagcgagggaggcctcgggggtccccagccggtgatgagccctcctcttcagctaggaaaatgacggtgttcagaaagttaaaacttcttcgctggaaggatttcatcttaaagttgggagactggaagaaattaaagtgttctaaatggaagagcattcaccacatgtgttctgttttgggttgacatttagcttttgtttttattttagaaacggaagactctggtagcagtccttgaaatcttgatgccattgctattttctgcattgtattgtatcttcgttttagtagtgctccaataaaaagacctgctactagctgccatgcaattgatatcagtttgttgccagacttctacaattttcctgaaaaataagattcaactagtttatatcccttctataaggtgaaaccttgacgggtgtcaccgaaatggtggaacagatcttcgatgtgacgttgcaccgttagatgtccatatgggtaacgatcgggaggaccattccactaagtacagttgaagttataccagag

SEQ ID NO: 714028 - DNA, 662 bp, Homo sapiens
cctatgtccagcaggtggcgcgcagcggcggtagccgagcgagggcgcggtggcctctgacaggaatgactctgcgcacgtgcgtttcgcagcagtggaagtcttcacacccggaaactcgactttggccgtttctccatttctcctcacgcactgtctttccttgggccctcgtcactcctggcaccgggggaagggcttccccgcctctggccgggcgctggggcgcgaccgaaggcgaggcggcggcgaggaaccttctggaattcggccgtcggggcaggcgtcgagtttacaggagaaggcgcggtgtcccgggatgagcggagtcgccctcacttaaggagcgagggaggcctcgggggtccccagccggtgatgagccctcctcttcagctaggaaaatgacggtgttcagaaagttaaaacttcttcgctggaaggatttcatcttaaagttgggagactggaagaaattaaagtgttctaaatggaagagcattcaccacatgtgttctgttttgggttgacatttagcttttgtttttattttagaaacggaagactctggtagcagtccttgaaatcttgatgccattgctattttctgcattgtattgtatcttcgttttagtagtgctccaataaaaagacctgctact

SEQ ID NO: 714029 - DNA, 309 bp, Homo sapiens
cgggcctcatgttgaatggggtggtcgactttccaggagttttccagctccacattcccatgtatttcagggatgccattctgaagcgggaggtggtacagcacagagtttatgcagtcaggctctggcggacggccttcctgtcacttccaggaaccaatgtgtcttcatctatcgactgaggatatgcgtggcccctgctctccctgggcttcgggaggatgcagagtcactggaaagtgcttaatcttgtgcctggtacagagtacctggcattactattagcccagcagctgcaaacacacaatg

SEQ ID NO: 714030 - DNA, 568 bp, Homo sapiens
cctatgtccagcaggtggcgcgcagcggcggtagccgagcgagggcgcggtggcctctgacaggaatgactctgcgcacgtgcgtttcgcagcagtggaagtcttcacacccggaaactcgactttggccgtttctccatttctcctcacgcactgtctttccttgggccctcgtcactcctggcaccgggggaagggcttccccgcctctggccgggcgctggggcgcgaccgaaggcgaggcggcggcgaggaaccttctggaattcggccgtcggggcaggcgtcgagtttacaggagaaggcgcggtgtcccgggatgagcggagtcgccctcacttaaggagcgagggaggcctcgggggtccccagccggtgatgagccctcctcttcagctaggaaaatgacggtgttcagaaagttaaaacttcttcgctggaaggatttcatcttaaagttgaaacggaagactctggtagcagtccttgaaatcttgatgccattgctattttctgcattgtattgtatcttcgttttagtagtgctccaataaaaagacctgctact

SEQ ID NO: 714031 - DNA, 393 bp, Homo sapiens
  misc_feature (200)..(200): n is a, c, g, or t
  misc_feature (210)..(210): n is a, c, g, or t
  misc_feature (215)..(215): n is a, c, g, or t
  misc_feature (217)..(217): n is a, c, g, or t
  misc_feature (346)..(346): n is a, c, g, or t
aggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccacatgtcctccctgagccacatctcgcccttcagccactccagcnacatgctgcnacgcncncgccgatgcacccgccatccagcctgtcctttggaccacaccacccctccagcatggtcaccgccatgggttagagccctgctcgatgctcacagggcccccagcgagagtccctgcagtcctttcganttgcatttttgcaggagcagtattcatggaaggcttaaacgcgatgg

SEQ ID NO: 714032 - DNA, 137 bp, Homo sapiens
tatatgttcttttaatagttgggggaaatgacctagaaaccaatgcagttggtagccaaattactcttggtttatttgtcctttgtgtgtgaaagtcctactattccgtgcgtcagacttcctcacagaactgttga

SEQ ID NO: 714033 - DNA, 434 bp, Homo sapiens
ggagtgtgcctcggagtcatggacaactagtttggcgtccgcaggcactgaatgtggcgctgcgaccgtacgtcccctgtcaggcgtgcactagaaggctggctctagaacgtgctaggacggagggccacagatgtgaggcgtggcgggcgcgtcgtgagcatgctcatggatactgtccacattagcgcatggtgtggcgaggtcctgtgtccacttggagcgcagcccccacgagactagaatgtaatagcaagaacgagaatcactgagtacgcgctaggacagcggtttcatccgctgggaacgcatgaaaatactcccatgtacagtctgcttgccgagcaaggtataggaattgtggtcaacacacaatagtcattatctgtaaattgcgaacataagagcagaatgtcccaagattgcctggactg

SEQ ID NO: 714034 - DNA, 368 bp, Homo sapiens
cagatttcctttcatccgagagttctaagtctttccttaagttttcatggtctaaaccatcttgagaaatactggccaggtatcctgtagaatgtttttgaaatctagatttgtctttttttttttttttggaaaggggcgtctggctctgtggcccaggcggaagtgcaagggcagaatctaccttctttgcaaccttctgtgttctcccaagtttcaggcaattttctcctgtgccttcagcttccccaaggttcgctggaatttacagggcattgccaccacacacactgttggtttaatttgtggtatatttttataagtataaagaagcgggcgtttctcctccagcgtttggtctccaaacg

SEQ ID NO: 714035 - DNA, 388 bp, Homo sapiens
gggaccatcatggggttctggacatcatgatgttgaagagggcatcagagtatctggagaaacgttcaccacttccgtctccatccacaatcgttcaacttgttctagaggctccatgtagcatgttttaggttcatggcagaatcgagcagaaggcacagagatttcccagacacccctgctccccagacatgcacggactcccccgtcatcagcatcctccactgaagtggtccatttgttacaactgatgaacctgcgttgacatgtcttggtcacccagggtcacagtttacattagggttcactgttggtgttgtatattctacaggtttggacatgtagccacgtgtcattatacattttagagtagtttcactgtccgcaa

SEQ ID NO: 714036 - DNA, 150 bp, Homo sapiens
tggaaagggagtctggcttgttgcccagcggggagtgcgggggtgcaatcccagttcagggaaagttccacctccggggttcacgcaattctcgggcctaagcctccggagcaggggggcaccacgggcaccggggaggtagagggtacg

SEQ ID NO: 714037 - DNA, 711 bp, Homo sapiens
ggtcgttcgtagggcggagctgggttgcacgctcgtcgattgtgcggctcttgcctcgggcagcggaagtcggcgcggcgcggtccggtagaagtggcactaaaacttcggcgttggtgtgaaagaaaatggcccgcaaccaaagcgagactgctcgtaagtcctaccggtggtgaaagctccgccccggcagaaacagcttggccacgaaaggcgaccaggaaaagcgctccctctaccggcggggtgaagaagcctcatcagctacgaaggccctgggaccgtggcgcttcgagagattcgtcggttatcagaagtcgaccgagcatgctcatcctggaagctgtccttccagaggttggtgagggagatcgcagcaggatttcataaaccgacctgaggtttcagagcgcagccatcggtgcgctgcgaggaggctagcgaagcgtacctgggtgggtctgttcgaagataccaacctgtgtgccatccacgctatagatgagtcaccatcatgcccaaagacatccagttggctcgccggatacggggagagagagcttaagtgaaggcagttttatatggcgtttgtagtaaattctgtaaaaatacttggtttaatttgtgacttttgttgtaacgaaccttgtttataactatgtggccttgtacttagtcatcccatctttcactcaggatgaatggaaaagt

SEQ ID NO: 714038 - DNA, 229 bp, Homo sapiens
  misc_feature (222)..(223): n is a, c, g, or t
tctaagatcccctaggctgagtgatgggtgatctcagctccgcagctctgctcttggattcatgccgggcaacagtgttagactctgtctcaaatataaataaataaataaataaataaataaacaagggttgggtattggtggtacactgcctgcactatccctagcactttgacgaggctgacggtacggcggactcacttgacgctcacggagttcgannctccag

SEQ ID NO: 714039 - DNA, 966 bp, Homo sapiens
gcttctttctccctccggcctcccgagcaccagtgcgctctgagctgcccccagtggtccctcaccccgcctgcagcaggcccatttggagggaggaacgataagggaagattgacgagtgaagtgtgtacgacttttaccgtactacacacatgcacatgaagcccagcgctaacactgtgccttttcgtgcgttgaaccacaacacaaacaaacaatctccaccccagctattttacccaagaccacaaaccaatctaaacaccacactctacaacaacactcaatccatcaacaacaatacaccacaacacaaattcacaaacataatacaccaatctcaatcaccaatcccatcctactatcaccaagaacaatcaacacacacacaaacacaacatagcatagacatctcatcaacaatgcacccactacacgacaccagcacgcgagtaccaatcgctcacacacaagcgcaacacacaagacatacacaccagtctcgacgaccaagaaaaccacaagaaacatcacacaatgcatatacataatcaggcaagccaaaatgtctataacccaaatccacttatcataccacattctctatctctaatctatgaattcactacatgccacaacccacacatcaccactcaccatcaactactccttgtcatcctaatctcacgagatgcgggacctgcgaattaacggtgggaagcgctgcgaggacgacttccgtgacaggaagagaggcggtgcggacgcatgagcgaacatgacaggggggacgcactaacgtctcgccgcacggtgctcgcctcgaagcagactcaccgcgcacaagtgagcgagaggcaggcgcagacgcgacggagcagagggacaggcgcgtgtcagcgccggagcatccacatgaggatgagagtgcgcgtcggagtggcagccaggaatagcgctggccca

SEQ ID NO: 714040 - DNA, 335 bp, Homo sapiens
atcagaagaggcacatgtgctcatatgagcatcttcgctgaacgtcacattgtagagaaagctggaatgctggttggttatggatatgtacacatgctctcgacttatgatggggttgcctcctactcaagccattgtaggttggaaatatgtaagtcaaatacatgtttaatacacctaacctcccaagctcatagcttagcctcacctaccttaaacatgctcagaacacttatcttcacctacagttgggcaaaatcatctaacacgaagccaactttataattaagtgttgaatatctcatgtaatgaattgaagagtgtactgaaggtga

SEQ ID NO: 714041 - DNA, 762 bp, Homo sapiens
  misc_feature (139)..(139): n is a, c, g, or t
  misc_feature (143)..(143): n is a, c, g, or t
  misc_feature (356)..(356): n is a, c, g, or t
tggaaacacagtctctgtcaccctaggccggaatgcaggggcgtgatctcggctcactgtaacctctgcctcccaggttcaagcgattctgtgtgcctcagccttttccggagttgtgcgtgggattatgagttgcacnaccnacaacctcccgtgctaaatttttttttatttttttttggaagaaggggagttcctcacaacctcttgtgcccggaagctgtggaagtgttgccaaggggggtgttgaactcctcggggctctccactgtgcaacacccctctgtgccctctctcgaggttctcaagaaaaatctcctcgcgtgcgcctacaagcacctccccgaagtgtaagntcgtgggaaacctacacgcggttttatgttgccccccacctgtgcccccaggtgtggatatttttctctattttttcttgcagtataaggaaagatagtggggttttcccacccaagtgtttgtggcccgagggcgtggttcctgtgaacacctgtgtgtgacaccctccaggttggatatctcggcccaccacctcgtgtgtggtcctctccccacaagagctctagtcgtggggatataaacaccgagggtctagtgaaaccccaccgcggtgctccggtggccagaaaaaagagtctttcctttatctccggttttcgtgaaagaaggtgtgtgacagcggttccagggagaaaccccaaaaatattccaaggtttcctccaacaactctttgtcacaaacgc

SEQ ID NO: 714042 - DNA, 387 bp, Homo sapiens
aatggttgaatactaatgagaggtgtcccatatgcagagtgaacattgaggctcagatgacaagagagagacgctaccatgtttaagaactctcgcccttgctctcattctgatcgctctctggtactgcagtcaaccaaagatggcatgacttacctgcgcagattgggaagcattgaactgatagtgctggatctggtatatggtacaattaatgctagacctacaggttatgtatacagttgattgtgatgtatgtatgaatgagtacttgaattgcatctatttgcacatattatgggcttgtgaccctcgtgcatgcaaggatagctgttgtagtaagttgaatattgtgggctgttggttgatgacatggcagcagccttg

SEQ ID NO: 714043 - DNA, 469 bp, Homo sapiens
  misc_feature (74)..(74): n is a, c, g, or t
  misc_feature (81)..(81): n is a, c, g, or t
  misc_feature (101)..(102): n is a, c, g, or t
  misc_feature (107)..(107): n is a, c, g, or t
  misc_feature (109)..(109): n is a, c, g, or t
  misc_feature (164)..(164): n is a, c, g, or t
  misc_feature (183)..(183): n is a, c, g, or t
  misc_feature (257)..(257): n is a, c, g, or t
  misc_feature (261)..(261): n is a, c, g, or t
  misc_feature (265)..(265): n is a, c, g, or t
  misc_feature (370)..(370): n is a, c, g, or t
  misc_feature (440)..(440): n is a, c, g, or t
  misc_feature (443)..(443): n is a, c, g, or t
  misc_feature (451)..(451): n is a, c, g, or t
  misc_feature (460)..(460): n is a, c, g, or t
aagggcctggactataaggaaggtggctcccccttcctgccctaaaaatgtgtgatttcctccccaggaagggntgggcantcttgcaccccggccgcctnncccantnccccgaggggctgccaacgacctggggcccacgctacatcatggtgtcctttgtngacccctgacactcaaccnctttgccaaacctgccctgccattgtgcctttttagggggcctggcccccgtcctgggagttgggggatgggtntttntgtntccccccttcctgagttcatgttccgggggcctgaactgaatatgtccccttgctcccaaaacccggccctctcaggaagctcccggagtccccccctttttccnccgcccccaggggtttgtgggcccagggcttttggggactccccgcgtgataaattattaatgttccccngtntccctttnaataaaggncagtttgta

SEQ ID NO: 714044 - DNA, 101 bp, Homo sapiens
tcattcattgcctcccacaatcctaggctacccgcccaggtagtgatcattctatttcccaactctattgatccccacctccaaatatctcatcaacaacc

SEQ ID NO: 714045 - DNA, 122 bp, Homo sapiens
ggagggtaaaagaagggcaggggaaccggaaacaagggcaaaagcggtacccggaggaaaacggacggcaaggaaacacggaaaacggggaaaaacggaaacagggaggaaaaggaaggaca

SEQ ID NO: 714046 - DNA, 90 bp, Homo sapiens
gagagagatgaagggtcttactactgtgcctgtgacacaccccccgactgggggatacgccatagctcctgggacacccgacagatgttt

SEQ ID NO: 714047 - DNA, 564 bp, Homo sapiens
ccttcccatagaagaaggtagacaagctgcacataagatccatgactctcatataacatacaacagtggcgagtagcagatattaaactgaaatggcgcaaagacaggtgaaggtgcaaaggataccaaagagtacccccatgccatcactaactgaagaaaagcgtccgacagttgaactaagtatcagacactgcgtactgcaggtggtgagcgatgttagaggcaagagaggcattacataaccacccaaaggccaattcaacaggtagataaaacaatttatcaataagcagagcaatccacttcatataatatcaaagtatgtgaaccaaaaagttacagaactaagagacagactcatccacaagcgcagactctcaggggccgctgacccagcgttcctacttctggatctgtactcaacagaagtgtgaatacatgcacagcggaaggagacaaagaagctttcattgtaaaagcctagaattcagaatgtaccgatgtccactaacagtagactggatacatgaactgtggcatattcatatcatacaatattat

SEQ ID NO: 714048 - DNA, 581 bp, Homo sapiens
  misc_feature (477)..(477): n is a, c, g, or t
  misc_feature (568)..(568): n is a, c, g, or t
accaactcccatagccactctggcctagaggaactccaccatctctggcctgcctggaggggagagcacaggaaaagggatgcctgggctggatgtcaagccagtctgcactgctgtgtatccagctcaccctcccaagccctgcagatggacagcggtgacctcaggcatctctcctgggttcccaaggcaccagaaaccttagtgggacctgtgagcctcaggcaaggtctgtactaagggcatggtttcctgtgacctcccgctgttgggagcaggagtgactgtccacctactgtggacggtgctctgctgaaacttcaacctacatccaacccatgatgtcctggacctcctggtccccaaggagtgcaggcacagggaaggttgcctctcctgaacaactcctaggcagcagtcctcctcacctcattgtccctcccggacagggacaccaattcaattgctttgtggctnggccaagaacaaaatttggggcctgtcccttcctttcgcgacccaacccttaactttcttttcctcttccttcttcccgggcaacctcctncccccttttttcc

SEQ ID NO: 714049 - DNA, 345 bp, Homo sapiens
  misc_feature (1)..(1): n is a, c, g, or t
  misc_feature (122)..(122): n is a, c, g, or t
  misc_feature (151)..(151): n is a, c, g, or t
  misc_feature (189)..(189): n is a, c, g, or t
  misc_feature (212)..(212): n is a, c, g, or t
  misc_feature (234)..(234): n is a, c, g, or t
  misc_feature (273)..(273): n is a, c, g, or t
  misc_feature (276)..(276): n is a, c, g, or t
  misc_feature (283)..(283): n is a, c, g, or t
  misc_feature (334)..(334): n is a, c, g, or t
ngaggggatcttggggtaggaggaggctggggtactcactgtactgtagtgatgtggctaggaggtgttcacaagcccagggggcaaggatatctagtaaagaagggtttcctaagtaagtnccttccgggattgaattggggtggggatnggtgaaaaggaaaaaactgtagttaacttctttctggnttggagatgttcttaacaaaggngagagggaaggttgcctaacanaacaaagttgggaacctatagatggtagtgtccggtttnganatccaantccggagatctccttcttcaacctcactaggtttagagtgaaacagttagngaaggaacaac

SEQ ID NO: 714050 - DNA, 494 bp, Homo sapiens
taataagggcttataactatgggctgggatcttttggctctagtcttctaagaaggggccattttatttttatagatgtcacttctaaagtcatggtgggtaattaatcttgggaagactggtgttggcgtatagagtggctggatacaatttaaaacccaagtagacctcattggcttggtcaccctatgaatggttggacaatgggacagggaatacctggcctggtagtatcactggtgcacttctgggattggataacgctggaggaaagaaagttaacgttccttttttacataagtcagaaaaacttacagcgggggtccctagtttccgggttggacctcagcagatgaagtgaacagatcagtggtaatccagatggaagaacattatctggaatctgggttggggtagatttacaatctacttgcaatattacctaaatcagatagcttttacagtttcacttgtgtcacataggttccctccgg

SEQ ID NO: 714051 - DNA, 106 bp, Homo sapiens
gcaggcagaatctattcatctatgtatttccagtgcctagtcacaatacctggtcatcaaaaaagatcctaaactattaactattaaattaacaaactaaaaaact

SEQ ID NO: 714052 - DNA, 505 bp, Homo sapiens
aagtagtaaaattgatacctttatctaagtattttacctatttactcaaataacaaaacctatgtaaacactaaaaagttagtaatttaagagttaatcaggccaggcatggtggctcacacctataatcccagcactttgggaagcaggtggattgcctgaggttaggagttcgagaccagtgtggccaacatagtgtaaccctgtcccttctaaaacttcaaaaaaattagctgggcgtggtgctttgcacctgtaatcccagctactcaggaggctgaggcaggggaatcacttgaaccagggaagtagaggttgcagtgagccaagatcgcaccactgcactcctgcctgggtgacagagagagactctgtgtgaaaaaaaaaaaaaaaaaagtttatgattatacatgtcacaaagaaatagcagttaccaggcagcaagtatttcaaggataagaaaagtagagcttctcttaagaaaagtggagagtaggcataaact

SEQ ID NO: 714053 - DNA, 410 bp, Homo sapiens
attgcttgaggtcaggagttcactaccagtctggccaacatggtgaaaccctctctctactaaaaatacaaaaaattagctgggcatggtggcgcatgccggtggttctagctactcaggaggctgaggcaggaaaattgcttgaatccaggaggcggagtttgcagtgagccgagattatgccagtgcactccagcctgtgcagaagagtgaggctctgtctcacaaagaaaaaaaaaaaaaatagcttgtacttcctagggtggggggagtttcagtaagataaagcaggtgtaaggcacttagaagagtgcctatcacagagtaggtgaggatataatagtaataatggtaccgcaggtttctcctgctgggaattgtttatccctgcccccttgcaggttgcaagg

SEQ ID NO: 714054 - DNA, 152 bp, Homo sapiens
agatattagatgtctgtagatgatcacacatatactgagactcactccaattattcctttatttaagaggctgccagcatatctaatatggggttgaaccggactacctacttatattgtcattcccggcatgagaacaaggtaacagtgga

SEQ ID NO: 714055 - DNA, 942 bp, Homo sapiens
  misc_feature (159)..(159): n is a, c, g, or t
  misc_feature (306)..(306): n is a, c, g, or t
  misc_feature (361)..(361): n is a, c, g, or t
  misc_feature (365)..(365): n is a, c, g, or t
  misc_feature (368)..(368): n is a, c, g, or t
  misc_feature (387)..(387): n is a, c, g, or t
  misc_feature (413)..(413): n is a, c, g, or t
  misc_feature (419)..(419): n is a, c, g, or t
  misc_feature (425)..(425): n is a, c, g, or t
gagaagtctatctctgtgggaccatgcgggccatcattacaacttccctcgtgtacttcagcagtgtggttctctttggcgcctgcattgagtgagtgtggttctccgggacaagtatggcgatggtgtcagcaggaacttggtggtgggcacactggnctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacggganggtgaatggtgaacccacatgggcactcctcctgacggcactcatcgccgagctngggnatncatcatcgcctccctcganatggtggaccccatcttatccatgtncttacntgatgntgctacctgttcgtgaacctcgcctgtgcggtgcagacactccatgaggacccccaactggcggccccggttcaagtactatcactgggcgctgtccttcctgggcatgagtcatctgactggacctatatgtaagtctcctcctggtactatgccctggtggacatgcatcatcgaccggcatgatctacaaatcacatcgagtaccaaggggctgaggaacggagtgggagtgacgggcatccgaaggcagacccatgaaacgcagacccagcaaagcgcatgaacgcaggaatggaggcacggggcacaactccacaccaaagaaaatgggcaggcccaggcgagccatgagcgcgtcgcaacaatggaccgcccgcgcacgacaggaacgatacacacgcagacggcaaccccggcggaatcccgacacacgtaagacagtccaacagactccaaggacctgagacaaaggagcccgacgcaacaggcaggatacacggccatcccaaagggg

SEQ ID NO: 714056 - DNA, 948 bp, Homo sapiens
attgtacttaacattttaggccatccttttactgttcctgatgctttaatatatattaatttataattatcctgatattttgtacatttttcaaacttaaaaatcaggatttttttttttttttggggcaatagtactaccatagggtttaatctggggatacatatggtatgggtctggttgggtggaccttgacatctggatcactggatgtcaatggacctattgggcctcattcaggacaccggcagagagtatgcaaagtccgagaagggaaaacagaaatctggtatgtgagagggtcatggtacagaaagaaggggcccctctgcaattggtcctcacagaacacgaattgggtggtggtcagccaatcaacatctgagaaatgttagacctttggcaatttaatatggtcctggacctttttgggccttttcggggggtggagggggggataaacaacgatgggcattatcaacgaacggtgacttttctttccctcaaaaaataaaagtccttttataatcttatgggtcccatgttaccttgtggtggtaatttcacactggcgacttggaaagggtatatagggaactgcggctcttcccttcatataaaaatcccgggggtggccctgtaaacaatgcagatgtttcttccgggaaaagctttcttttttctaccgaaggaaaaattcgttgtcgcgtggtataattccggggtggcgtggttttctccagaattaattaggggtacctggcgtgtggttgtaaattaaaccagattttgatgtgcttaggacaagaacgaagagaacacacacaattgtgtggggggcgcggacgaggaaagtgtttgtagacacacggtgtggggggggcagagtgaataagaacggtgaagaggtatcacagaaaactggctacatatggggggtgttcacaa

SEQ ID NO: 714057 - DNA, 467 bp, Homo sapiens
ggtgcagtaaagcatgtactgtcggaggttgggttctgctccgatggtctgccccaaccgaaattgaaaatagcaggtttggtagtaaaggaccatgtgggatttgttaggtacagtactgcataaataaattagagctccataatgggtcttctcgtcttgctgtgtcatgcccgactcttcacgggcaggtcaatttcactaggttaaaagtaagagacagctgaaccctcgtggagccattcatacaggtccctaattaaggaacaagtgatcatgctacctttgcacggttaaggtaccgcggccagttaaacatgtgtcactgggcaggcggtgcctctaatactggtgatgctagaggtgatgtttttggtaaacaggcggggtaagatttgacgagttcctttaactataatttaaacctttccttatgagcatgcctgtgttggtcacacaataaatat

SEQ ID NO: 714058 - DNA, 925 bp, Homo sapiens
  misc_feature (925)..(925): n is a, c, g, or t
ggcgtgaacgccgccggccgcgggtcgggctctgtgtcagcagccggtgcgggcgctcgtggctgtgtgacattgcagcctgtacagccctggctgtggccctggcctgtgggcatgccgctggtggtcccggtcgctgactggggccctggtggccaaggcctgctctgtgcggctggccttgagctggatgccttctctgccagcgtcgaccactgacgactgcggaggcacctctcgtcccgaaaccgaccagagggcaaagtgttggagacagttggtgtgtttgaggtgccaaaacagaatggaaaatatgagaccgggcagcttttccttcatagcattttctggctaccgaggtgtcgtcctgtttccctggcaggccagactgtatgaccgggatgtggcttctgcagctccagaaaaagcagagaaccctgctggccatggcttccaatggaggtgaaaggcaaaactcacacttactatcaggtgctgattgatgctcgtgacttgcccacatatatctcagagatctcagacagaagctgtgaccttcttggctaaccatgatgacagtcgggccttctatgccatcccaggcttggactaatgtcagccatgaagacatcctcccctacagctccaattgatcagggtttcccatccaacatgaacttcttttgaaagatttcttctgtatgaccagacaaaaagcaccttcctttatgtggcctcgggagaacgctaaggggccttgcaaacgacgaagaatcaccccttggcttggagctctccgattgttcatcggggaaacaaattgaggaacgatacgttgtcactgtgatccccttcttaattggcattgaggggacgccagaattccactgtgtactggtggcgctactgaatccggagggagacn

SEQ ID NO: 714059 - DNA, 1046 bp, Homo sapiens
ggcgctttccgggtccagcttcagctgtcaactcgcgagccctgggcgtcagcaggtatgagggaggatggagcagcggtgcatgaagcgcgccatcagaggaggcaccgcggtgtccaactttgtcggtctccggctatcacttgcgcggacggcgcgtatcccgaccagcactggcaattttctgctgcgcactgcgcacgcgattgccggttgtgacggtgcacctggctccggttggggtcggcttctgtcaactgcgccgtcccagtccgaccacgtggtcccctgagggggaagcatcggtaaggtgtcagtatctcggagggactcggcgtgtcgtactgtgggcagaggagggtggcgtgtgccagccttggctctcgttgggattaccggctggatggtgacggcataggagaaaaggagacgggtgtctgaatggagaggaaagtcctatgaaccaccgtgtgtcgggcgattcccaggagagcgtgacgggacgcgaaagcatgggcatgcgccgcacgcatagatgtgctgggagaactatgggaacctgccttgctattatgaggaggactccatcgtagcccaaagagatttacgatgcgcctggcatttacaacaccacgttgttagggagaggttcgttagggaagaactccaatttcacaccattgggactctccggtggaattgggcacgaaaatggtggcccgtttggcggggccgggataaatcctttggaggcacaccagacccttctgacccggaaaacgaggacggtaactttgcaaccggacggagcaaggggtttgggcgccccgccacgaagccaacattggaagagaaagattcccgaggaaaaggaccaattgtgactggaaaacttttcccaaagaaggcaattgaagcgaagaatttctcgccatttttgcaacgaagagccttagctttaccatggccacaagaaaccttcccatgttttgggatgggaaacacccaggtagagttttcctcccacgttcaaaccaacgccagca

SEQ ID NO: 714060 - DNA, 330 bp, Homo sapiens
tgcacacgccgaatccccatacggaggtgggaggatcacctgagcttagtaagtcgaggctgcagcgaaccatgatcacaccacattgcactccagccagggtgatgagagtgagaccctgtctcaaaaaaaaaaaaaaaaaaaaacccccaaaattttcccccccttttttttgggggggggttttttgcaaaaatttttttccaaggcccccaggggcctttttatttttatggtgggccttaaaaatttaagtttaattaaaattttttaagtttttttgaaatattttttttaagggggaccttccggggttgccagggccccgcc

SEQ ID NO: 714061 - DNA, 529 bp, Homo sapiens
gccgggcgcggtggcgcgtgcctgtagtcccagctactcgggcagagactgaggagggaggatgataagggatcccggactctgtatgattgaaataaagagaaataaacaaaaaaaaaaaaaaaaaaaaaaaaaaaaaaacacaaaaaaacaaacaaaaaaaaaaaaaaaaaaaaaaaaacaaacacacaaaaaaaaaaaaaaaaaaaaacaaaaaacaacagcgcggggggggggggcgggcagcgagaagaaaggaacaacaaacaacaaggggggggggggggggcggagaaggggaagagagggggggaggagaggggagggaaggggcgagggaaaaaaaaagggggggtgaggttcacacacacaaaaaaaaggggggcggggcagcaggaggagggttgtaggtgacgagaacaaccgaggaggagaatgatggagatagtgagggcgtgttgtacaaagaagcgaggaagagaggaggagaacgaagaaaaagccccggcggaggggggggtgttggggt

SEQ ID NO: 714062 - DNA, 265 bp, Homo sapiens
ggccccaatcatcgtgttccgcggggagcatggctacatcggctgcctgcaaggtcacggagtcagccctggactgccaatcgctcctagctatgacgtcttccatgctggagttcaacgatggcgcctacacacatcagaatgactccatcgaggcgaatactggagcggtgggcagtgactccggggtcaccagcagcggtgacgctcctgtggacttcttcttcgagttctgcgactataacaggggtggccactcacggct

SEQ ID NO: 714063 - DNA, 133 bp, Homo sapiens
tttttcccttttcccaaacagccagaaattttttatggccaaaaaaattccctttaaaaattgggctggaacatgggaaagggtaaaagtttttcatgggttccatccatggggaataaaattttatttttga

SEQ ID NO: 714064 - DNA, 1454 bp, Homo sapiens
  misc_feature (502)..(502): n is a, c, g, or t
  misc_feature (615)..(615): n is a, c, g, or t
gcgctgctccagcgctctggggcgcattgccaaccttccaggcgctgggagcggtcggaggaagataacaattactatatgtgctgtgccccgatactatactcgtggcagagcgagcgagacacagaaatttgagattatgtagaccgatgtcagtggcaaatcgctggcgacatcgccagaggctgggtcagctgtgggcaactcggagatcggatgccgaaggtctcctgggtcaggctgagtccaggatgactcggaagcgattggcaagttctgaatccgcctagaccgagtcacctctaactcgatcggtgggatgcggagtcgatctcgtgtcacgtctcgagtagctcgtgagtcgtctggtgatatctcatgaattgtaagtccacccagtggtaggtcacaactactggtatccgtctgcttgccgataccctggggtaggaatcttcagtaagccatggggtgtacgcaagtagtgtacgtcgtagtatcncgcttcaaggggtcgcattattggcgctcaaggattcgttggaagaagctcgagggaccaacgtttcgtgatatttagggtcgacgtcgtgtggggacgcctaggctcaaccnaacattgtgggcctgaaatagtgcacacaggtaactcacttagccaggggcagtccggtcagacactggggcttaggataatcggtgatcccttggacatcgcttgggtgaccgagcagaggggaggcgcagcagtagcctcgttgtcacatctggcgttgctagggcgcgttgccgagactagacactctaacgtgcagctatggcgacgtgggggcctaccaggggctcctggggcatactggggccaactgcatccctctcatccagccaaggatacccgaagaacagaaataacccctgaaggcagagatcattgacattgcgctatctacgctgtggttgtgcgcttcaatgccaataatgctgtgctggacaacccggtgggatccggaatgccctatacaaaattgtcaagacccatcttccaggtaccaattcaagttggggacgaggacaatactggacattgaagacaccttattgggcactttggaccaacagacgggcccttcataatggagaacacgcgggtagccggagagaatcagaaaagggtggacacagaaccgaaaacctaaagggggaacataggaccaaccgtcgtggtcccagcaacccatgagcgtggtgtcaacaaccgtgaatcacggtaccgagggccggcgaaaaggggaccccccgaaactgtcgcacaccaccgtggcgccattgcagagacacaacaccatgcacgggatgaccaattacacacgccgggaacgcgaacagaagccacaggggaaacacacgaagttcagagcaaaagaagggggacccaagggaccaacacatgacag

SEQ ID NO: 714065 - DNA, 137 bp, Homo sapiens
cgtgggccacaaattggactcgaaagcccttacgtcttacagctcgtatctcgtgccattgcttggcgcagtcgctagctggcggcagcagcgtctcatgcacgaattgtcgttattgcgggagtgtaagatagaag

SEQ ID NO: 714066 - DNA, 311 bp, Homo sapiens
gcatcactgtgtgctactgagagctgtatgtgcccatgggtagggccctgcctactggactcatcccctgacgcccaggactgcattctggtcctctctgagccacttgtagtgtagtctcttcagtttctatctgggcatatctctttttcttctgggtcatctcctcttctggtttagtaacaatctgttccttttccgtagggatcatctccctgtggcagggagagctcatgtctgggttaatccgatcttgagctctgtagtgtccggcggcgcatcttaggtgcttcgttcacttggatattctc

SEQ ID NO: 714067 - DNA, 1095 bp, Homo sapiens
ggactgtatctctaagtgatgtgtactagtataaagtcctggtgaggtaccgctgagataaatatggtcaaatctattgcgcctgtgggaactacttgataggactctagcagagagttgttggtcgccgtgtgtcgtccacgtcatcgactcaggtctgttaagatgactcaaggactgggggatctcgatgatgctcgctctacctttttggtgttgttggtcttatagcttggttggatgctacagggttgacgcgaacgacatgacgcggcaaaagggtccaggacgatggtaggggtgacgcggtgtgtgtcaattgagggagctctcaggtggaaggtggggacttgggtgttatgcaaatgggtttgagttctcctgatagagctgattggcagttgggaggagtccatctttatgaaggactggcaatggtcccaatcacagctggggataaccaaggactttggtttggtggaaaacccatctctcgtaggtggtcccacgtgtgtctaattgtgatggccaaacaacgagtagctacgagggttacgagggggggcgtacaaggttactcgacagggtatagagatattaccgtggcatcgagtagttaacgggggcacaaagttgacagcgggggtggtaggtggtagtaattagagggttcctatgggtatccgtctagtaggcatggtggacgcgttgccaattcttttcaagcgatttgggtcgtactagcatataatggttggagggtcaaccctgggcatgggtgatggctcaaaagtcacaagtagtccccagggggtcatacccttgtacaaagcttactctggacctaagtaatcacccgcccaattcgaggggtgttgggcaatccttgtccaagcacttcgagttctatcacaggaaagggagggaaaccttttggattgcttgcccggcaggaacagcgtttggcccacttatcgtgccatccaaaggtatcactcttgaggaggggtatgtgggattcagggggctccgaggacccagaagattccagtccccatggttagggtttgcgtcttcaataattgcctttaagcg

SEQ ID NO: 714068 - DNA, 298 bp, Homo sapiens
ctgagagtgggagtgtgtgctcgggctcggacacacattatattagaaaatcagaaaaatctaaaaaatcttttaaaaacccaaaaaaattacaaaaaatccgcgtctcccccgcggagactttattttttttcttcctcttttataaaataacccggtgaagcagccgagaccgacccgccgcccgcggcccgcggcagtccaagaaggaaccaagagacgaggccttcccgctgccggaccgacacgcaccctcgctcgccgccggcagcggcagcagcggagtggattcgacccg

SEQ ID NO: 714069 - DNA, 224 bp, Homo sapiens
tgttttcctgcgcaggagccgcaggccgtacagccatggccgcagggaatggatggtcttgaagccccacttccacaggactggcagcggcgcgtggccacgtccttcaaccagccggcccgtaagatccgcagacgtaggcccggcaagccaaggcgcgcgcatcgccccgaccccgctcgtcccatcggcccatcgtgcgctgccccacggttcggtaccac

SEQ ID NO: 714070 - DNA, 267 bp, Homo sapiens
  misc_feature (61)..(61): n is a, c, g, or t
gaaatagtcataatgggcaggtgggattggggtaggatatggttggggtgacccatgtctntgcacacatggcagtcttaggagaaggcataggctggtgacaagaagttaagactgcaactgccagtcaataaagctttgtcaaaaagcggtatcactgtatttccatattaatgtacttgctagcattgtatactcagttttatttatgcctatgtaatgctttgtaaatttgctttacttgattaaattttttgatttgccagt

SEQ ID NO: 714071 - DNA, 756 bp, Homo sapiens
tgatttaattttgacactagggagatctcacagcagaagtacaaatcatatgtacaagggttgtgtgcaatgaaaatttccattggggattttttggcagaatattggtcttgactctgtggaataaatgacgacgtaaacgtagctgcacaggggtgttcccgtataatgcttgaatcaattgtgtgtgaaagcatcatgcagagggggggttaaattgggtgatgactgaaagggtataaatccttcattccagctccacgagcagatccccttctccaactgtggctccagcttgacaggtgacagatttcaccgggccacgcttcccacctggcataccattctgcattttcatgggtgcaatcacacaattgtgttggccttgctggtccttgggggggggggggggttaagagagtctctcgccgctcgacgtgccagagcgaggggggattagagcactggactgggaggtgcttatttaagctggggggaggggcttgagggggttgtggggcggaggggatgctagggaggagggaggaggggggcggggtggcaagcggttgctgttgtgggggggggggaggcggggtgccggggcgggggtggttcaggcgaggtagggagtggaggtcacggggttagcgtttgggggagggcgcgtcctgggggagcgtagcgacgcaaggtcgcgccgtgcgttactcgtcggccgcgaccggtggtggggggggtcgctgagcgcgtggt

SEQ ID NO: 714072 - DNA, 628 bp, Homo sapiens
cttaaccagtacaccaagacatttggttacccacccactgacgaagatccctgccaagtttctttgggagcatgctcggtcaggagatagacccgctcaggaatgtgctggtgactgttgctggctatggggccctgttcacaacgttccaggccctggtggacgaaggagacgaggtcatcatcatcgaaccctttgttgactgctacgagcccatgacaatgatggcagggggtcgtcctgtgtttgtgtccctgaagccgggtcccatccagaatggagaactgggttccagcagcaactggcagctggaccccatggagctggccggcaaattcacatcacgcaccaaagccctggtcctcaacacccccaacaaccccctgggcaaggtgttctccagggaagagctggagctggtggccagcctttgccagcagcatgacgtggtgtgtatcacttccaccatgtaccgatcacatcccagctctgcatggcccctgctaaggctcaggtataacctcaccttccctggctcatcttggccttggggagttgccttttagcttgagtcctcaagcctctccttttcgtccataataaaatgtttaagttattaagaaaaaaa

SEQ ID NO: 714073 - DNA, 113 bp, Homo sapiens
tgccctattactatccatacctcatcctagcaataatacccctccccacatcaagcccgaatgatatttcctattcgcctacacaattctccgatccgtccctaacaaactag

SEQ ID NO: 714074 - DNA, 193 bp, Homo sapiens
ctaattggttcttcgatgacgtccaaatccctgactagcatctaaactacacttaaggtaggagatacaaggagagtgggtgtagaaaagcaagcaaagaccagccagtagcacaaatggaaattaagaaatcctcaggagcaaggaagtaacacggaaggttatttcaccacgtcatcgaagaaccaattag

SEQ ID NO: 714075 - DNA, 762 bp, Homo sapiens
  misc_feature (119)..(119): n is a, c, g, or t
ctgagatcgcggccttttatttactctttggagacatgatgttgctgtgtcaacgaagctgtttggcacaccttcttgtatcagcttgtgctcactgcctcgtcgcttatcacatatantggagactactcacaactactccactaccgcctgcattattattagatcttttatggagatctgggatcgccatgtctcactgatcctattgatactgctgagctacaccatgactcctgctcatatcttatagcgtactgaattcgtagatatagcgactggactactcctctatctgaatagatatattatagctctctctctaattgcgagttgctgtgacctgtggcacaacactgttgaaaatatgccacctaataacccaattattcgcctctattacatattgcctctcactctctgtagatggccgctaactatttaagtgaaacgaagagttccgcatgtatcactgtggctgctcagacaggtggagtaaatccttatcaacacagcgtgtcatagctaagatatacttgtcacactgcctcttgctgcaaacagcgacgaagctcgtgtcaagtgtccctagcggagacagacgttctactctagtgacacatgaatattaggatagcagtacaaccttcttagctgtatcgggatggagtagcctagatggacgattatacctgctgcaacactaccttaaggccaaggcgtattccacagatgtgcctcacactctttattagggggccg

SEQ ID NO: 714076 - DNA, 341 bp, Homo sapiens
  misc_feature (182)..(182): n is a, c, g, or t
gaggactagagcaccgaacacatcacaccggataagaatacaagcctgaggcaggttgcctggtgtactccttgagcgcaccgatcacgaacgggccgatatagccgccgaggttgcccaccgagttgatcaaggcaataccggccgccgcactggcgccggcaaagaagcgccccggcagngtccagaacacggcggtgcaggaaaacatggcaaacgccgccaggcacagcgcggccatttgcagtactggcaccgtgagccaggcgctgcagaacaggccgatggcgcccagcacatagagcgcggcgagatggccgtaacggtcgttcaaacggtcg

SEQ ID NO: 714077 - DNA, 109 bp, Homo sapiens
ccggtcagttgtttcctaagtataggtgaacacataagcaggtaaagtgtgaggaagacttagatacagcattgttcccacctaccaacttgaaagcacacaccatggt

SEQ ID NO: 714078 - DNA, 287 bp, Homo sapiens
cacggtgccgaagcgggtatccctcgcgagccggatcgggatcgctccgaaaacgctcgacagagttctcaacggcgatattctcgctcccctcgaacgcaccatacccaatccttgcgccgtgcctcccgccgccatccgcgtgggttacgaatccgcccgcgccgtatcccgcgcgcaagtagtcgagctgcccggtaagagcggtgatctggctcttgcgcgcgttacggatttccgcccggccacacccgccggatcgccggcgccatgatctccgtcgccgc

SEQ ID NO: 714079 - DNA, 148 bp, Homo sapiens
ggaccgccaaaaagccagtgtcatgaagaactatctgtgaagacaatctttggcaggcacctgaactcccaaagccactgaggagaagatggaggccattgaactttcagtggatccaacgtctaacaaaagacaatgtcttgttttc

SEQ ID NO: 714080 - DNA, 1076 bp, Homo sapiens
  misc_feature (17)..(17): n is a, c, g, or t
  misc_feature (69)..(70): n is a, c, g, or t
  misc_feature (83)..(84): n is a, c, g, or t
  misc_feature (142)..(142): n is a, c, g, or t
  misc_feature (154)..(154): n is a, c, g, or t
  misc_feature (246)..(246): n is a, c, g, or t
  misc_feature (289)..(289): n is a, c, g, or t
  misc_feature (314)..(314): n is a, c, g, or t
  misc_feature (364)..(364): n is a, c, g, or t
  misc_feature (430)..(430): n is a, c, g, or t
  misc_feature (452)..(452): n is a, c, g, or t
  misc_feature (476)..(476): n is a, c, g, or t
  misc_feature (558)..(558): n is a, c, g, or t
  misc_feature (707)..(707): n is a, c, g, or t
  misc_feature (719)..(719): n is a, c, g, or t
  misc_feature (722)..(722): n is a, c, g, or t
  misc_feature (735)..(735): n is a, c, g, or t
  misc_feature (776)..(776): n is a, c, g, or t
  misc_feature (781)..(785): n is a, c, g, or t
  misc_feature (787)..(789): n is a, c, g, or t
  misc_feature (795)..(795): n is a, c, g, or t
  misc_feature (818)..(819): n is a, c, g, or t
  misc_feature (993)..(993): n is a, c, g, or t
  misc_feature (1017)..(1017): n is a, c, g, or t
  misc_feature (1027)..(1027): n is a, c, g, or t
  misc_feature (1043)..(1043): n is a, c, g, or t
gcgagcccccaaagtgntgagccgccgcgccccgccgagagcgcgcccctgcccccgggaggagcccannaaggaggaagggnncccaaaaaaactgaggcgcccgcagctcctgccgcccaggagaccaaaagtgacgggnccccagcttcanactcaaaaccccggcagctcggaggctgccccctcttccaaggagacccccgcagccacggaagcgcctagttccacacccaaggcccaggnccccgcagcctctgcagaagagcccaagccggtggaggccccngcagctaattccgaccaaaccgtanccgtgaaagagtgacaaggacagcctataggaaaaacaataccacttaanacaatctcctctctctctctctctctctctctctctctctctctatctcctctctccctcccctcncctatctctcctctctctctcncctatactacacttgtttcaaatngcgaagatcacatcgatagtgtatgtgcccaaggaaaaatacaggatgttgtcccatcaagggagggagggggtgggagaanccaaatagtatttttgtggggacaatatctaatataccttcagtcaactttaccaagaagtcctggatttccaagatccgcgtctgaaagtgcagtacatcgtttgtacctgacactgccgccacacgcactcctccaccgctgagagntgaatagctttnctnctgcaatgggagntgggagtgatgcgtttgattctgcccacagggcccctcccnccccnnnnngnnntttacngagagccgagtattttctgtgtnntctttttaattcacagcctttcttattttgatatttttttaatgttgtggatgaatgccagctttacagacagagccacacttagcttcgtctcacatggatctcaatgccaacccaccaccccccccccccagatatttttgggagtgacaaacattctctcatcctacttancctacctagatttctcatgacganttaatgcatntccgtggttgggtgcncctgtagttctgtttattggtcagtggaaatga

SEQ ID NO: 714081 - DNA, 169 bp, Homo sapiens
  misc_feature (162)..(162): n is a, c, g, or t
gctggggtatcaaggatcctttgcggagcctcagatcaaaactcagtgctgggccgggcgtggtggctcacgcctgtaatcccagcactttgggaagccaaggtgggcagatcacttgaggtcaggagttcaagaacagcctggccaaatgtgggtgaaacncctgtct

SEQ ID NO: 714082 - DNA, 765 bp, Homo sapiens
  misc_feature (26)..(26): n is a, c, g, or t
  misc_feature (104)..(104): n is a, c, g, or t
  misc_feature (108)..(108): n is a, c, g, or t
  misc_feature (113)..(114): n is a, c, g, or t
  misc_feature (133)..(133): n is a, c, g, or t
  misc_feature (143)..(143): n is a, c, g, or t
  misc_feature (150)..(154): n is a, c, g, or t
  misc_feature (163)..(163): n is a, c, g, or t
  misc_feature (166)..(167): n is a, c, g, or t
  misc_feature (172)..(172): n is a, c, g, or t
  misc_feature (176)..(176): n is a, c, g, or t
  misc_feature (190)..(190): n is a, c, g, or t
  misc_feature (194)..(194): n is a, c, g, or t
  misc_feature (201)..(201): n is a, c, g, or t
  misc_feature (207)..(207): n is a, c, g, or t
  misc_feature (215)..(215): n is a, c, g, or t
  misc_feature (218)..(218): n is a, c, g, or t
  misc_feature (221)..(222): n is a, c, g, or t
  misc_feature (233)..(233): n is a, c, g, or t
  misc_feature (238)..(239): n is a, c, g, or t
  misc_feature (243)..(243): n is a, c, g, or t
  misc_feature (248)..(248): n is a, c, g, or t
  misc_feature (271)..(271): n is a, c, g, or t
  misc_feature (278)..(278): n is a, c, g, or t
  misc_feature (320)..(320): n is a, c, g, or t
  misc_feature (384)..(384): n is a, c, g, or t
  misc_feature (690)..(690): n is a, c, g, or t
  misc_feature (753)..(753): n is a, c, g, or t
tggctctccattcattcgccaatttnagagtacagtggtggggtgcggtgtgtgcatcggtgcacggacagacagaaccacgagcagcaactaccatgggtganaggnttttnnttggggtgtgacccttganattagaagangcctcgnnnnntttggtttnatnnggttngtanaatgaaataaagcntagngaagctncctttncaaaaggncantgnncagcaacagcnagggnncggnctggncaccatcccaggtcttcgggganggggaangtgtgctcccaggtaagcagggtcaaaccacccccaagagcntcactttttcctggtggctctgccactgaactgactcttagaaaccggaaacggatgagctttntagccagaaaaccggagggaatcttgacaggcacacagcatccaaaccaacagcacttctgcagctggggcgcggctggcgagaggggtgctgcctgctgcctgcaaatcctgccagagtcaagggtttgctttcctactggtcttcctttggctagaaaagtgacaaaactgagctgggtggggtataagttacaggggcgagagcttcagtggcctgtttatcgggaggagttggagctggagcggctcctgtggcggcggcggcccggggaccgtgatctccggcgcacggggggactgcgcntcggggagcgggaccttctcctcatccgtgggggagactgcgccacataggcggtggtggcanattctcctggga

SEQ ID NO: 714083 - DNA, 152 bp, Homo sapiens
cccccccctttccaaaaccggccggcttaaacccttaaccaaaaggtttaggggggaaaacccttgggttttaaaaagtggatggggtttattttttgccccccaaaccaatttaaaattttttaaaattttcccgccttttttgggcggga

SEQ ID NO: 714084 - DNA, 252 bp, Homo sapiens
  misc_feature (155)..(155): n is a, c, g, or t
tactagatatcaatcaagacagaagtactatggtggtgcaggtgagggaggagcatggatactgttatgatatagagttcagttgaaagataagacattctgggatggaggtggtatatttatataacagtgtaattgtgttaattacactgaanatatacttaaaaatgggtaagaagggtaattttattgttacatattgttctatcacaaattacaaaagaatctccctacaagagattgcggtgtttg

SEQ ID NO: 714085 - DNA, 1226 bp, Homo sapiens
tggtaacccccccgtgcccagccctccacctgcacgggaacccccagggcactggggaaaccggggtgtgactgcggagaccggggaaactgtgggggacaggggagacaagcagcagggcatgtggcacggggtcgggggccctcatgtggaaacgaggcgcccgagggggcaacttggtgactggcacacagcggttcaagggagggccctgtgcaggactccttacacccgtgtgtgcctttgccaatgggtgccgtggccagccagaccttccggccaatattgggtcattagacgggacagcaacgttggccagtggtgtgcatgtggccctccagacactatactattctcacagcgcgggggcaatttgcacatggtcgtgttgcaggaaatttttgtgggaacgcgggggctacaccggtgaaacttaacgtgtcttttgggtgccctacaggggggccgctccaggtaaggggggtgccaaaggttcagaagaagaggctacactttcctgtgacaacaacgcgtgtaattcccttcacgccgtggctcctcccttaagacccttcacagagttcagtggatggcgccacaaggactcctcctcgcataatgagcgacccggggttccagtgcgggacaacctgggctgtgaacgagcacacggaggggggacaacatgtggtcctcccaatgagaccacatttaccggggacccttgagagcgaagaaactccagcgccaattgggactgagaaactctcatcaccaaaaaacgcccagagtccacctgtaacctcagggcggggcaaacacccacacgggaagcctgggagagaccccagggggcgccaaggcgccccccccgggggcagaaacccgcaaaaacgacgcgccgagacagagaggggaaactaaaggggccggcacccccccaggggacgtggcgccacgcctgtacacgcgacacgggcaaaaacagggaagtggaaggggggacactcaggaagacggagaaaagagctgctgcccaccagaaagcagacacaagcggagcccaacagagcaacagacgcagagaaaagagacataacaaaggcgacacccgcaatacgaatacgccgtgtgtcacgcaaaaacgacacggtgagcagtaccaaccccagcgatacagagaaatgaacacgcactctgtgtgtgtgagcgccaccactgacaca

SEQ ID NO: 714086 - DNA, 152 bp, Homo sapiens
acccttataggaaaggttaaaaaagtaaaaggaaccggaaatcttaccccgcctgtttatcaacaaacatcacctctagactatctacccagatattagaggcaccgcctgcccagtgacacatggttctaacggccgcggtaccctaaccg

SEQ ID NO: 714087 - DNA, 386 bp, Homo sapiens
ctagtttagaagttcattgctgcctggggtctactgaagctaggtgctatgaacactcctagtctagaagtttcaatagcagactaattgttgagtaactttttgtagtagagacggtgctttcacgcatggtgggcaggctggtctatgaacttctagcctcaagtgagctgcccacgctcgccctcccaaagtgctgggattagaggcatgagccgaggtgctcacgggctgaaccttttattaagagtggtaaatataaagtgttgatgtgagctgtaaagcataaattctcttgaaacagaggtttaaatctctttctatatgtcgcattcttgcggtgcctattaattttactgttgctgatagaaacttctaaaactagg

SEQ ID NO: 714088 - DNA, 261 bp, Homo sapiens
  misc_feature (4)..(4): n is a, c, g, or t
tttncatctgatgaaaaaagtaatcttagaattcagtccatcaggtaatcttctcatacgcaagtcttctaggacttgacagggaagttatcccttaaaacaaaagccgaaggccaaagtcaaattcccccagttgtctccctagagagtgatcgtgtattgctgatgggtgctttcctgttcacattcagagactgtctccaaacaccacaccactagtccaacaaaaagaaagctttgctgggattttccttgatattt

SEQ ID NO: 714089 - DNA, 1238 bp, Homo sapiens
cttagagaggtccccggtgtccgacggcggctcaagtcagagttgctgggtttgctcagatggtgtgggaagagcctgcctgtgggtgagccgggcccctgaccggtcaccatgtgggccttctcggaattgcccatgccgctgctgatcaatttgatcgtctcgctgctggagatttgtaggccacaagtcaccctcatccctggccttccaggggccacttcacttgcttgcagcgccatctgtaggtcagtgaccatcaacaaaaccagccagacagcatgatcccaagaatcccagggagtgactcagcggtgctgtatatccattatcatccatcttctgcattcatccctttccccttcctgaactgctttgtgacaggagcagtgtaaggcattcccccaaccatgactttgtggccctgatagcgtgccctccttgccatctgcctgcactgatcttcctgaggcctttgcggatgatgtactgaatctgcgctggcgccataagctgctgcatacctacagctgacatcaacatacctctcctcatggtctatctcaccaaacttaggacaccacgacattgatggtgccccaagaccttccgaccgatcacttggacctgcatctaggacttgcggaatcctatgtactattgtctcaacatggggtgcttggccagtgttcctggaaccactgccgatcacagtatccattagcaacgcacttaacagtgcttacaagcgtggccagacaacacaccccttacatgataacaatcaatagacattcaacctggccaagttgacaacgcacatcacgcagacaaccaatctatccacccaccacacctaatacatacccactacactacacacaccctacagcatatgccataacaccaagctgaaatcccgactagcagacgcattgcgtatgctgcaaacattgctcggatgccgatcacgacgacaagactaatagaagaaggagagaaaaaagcaaaacacattgcagaatgcagcgatgcaccaatcgacaggccgagagcagaatgctcatccgagcacgcaagaacaatacatccgcggccctcgcagccagacgaagatgctcatcagaaaaccagatctacccacacaccaccattcacaacatcaccactcccgccatgcatgaagaatcctcgctccgcttatgtcgcttccttcttgtggttgcacagtccaatag

SEQ ID NO: 714090 - DNA, 989 bp, Homo sapiens
cttagaaagtggcagcccctcggcttgtcgcctggagctgagaaccaagagctctgaaggggccatatgacatctcctcctcggacccctggacacacacagccctggacgactggagccttggagcatggcaagtccagagcaccctgggagccctggctgcatgggacccataacccagtgcacgggcaaggacccgagcgaggaagcacctatgcctactggtcccctgtaccctccccgcgacccatggtacctgactggcgcacttagacacacacagtggccctgagctccatagcgtcctatgcatgaccactgcgggagcttcagcagtactgggcagaaccagaaatgccgctggaagcacgtcaaactgctctttgagatcgcttcagcctcgcatcgagtgagacgaacaacgtctctaagcttctcgtgatcgcgggaaatcaaggcctggagagatgagcttatccatgggctcacgtggcgagcacacgtggacagctaccagaaccagacccgcagatgtccacgtcaaagtgacatgctctgagaggcagcacactacagaataaccctgctatccaaattccaggaagctcttaggggtcatccagctgggcctaggggtgcagggtcagtgctgatggcctgggcagggccgctagcctccctgagctttctggccttcagtgctgggagtgcacagttcagggtggactgtgaccccttggcctagaatgccctttagctctgctctctagtggctgtccccatagctggaactctagtttggagtggccaacaccagttccacctgctgttagggcgtaggatggctccaacacattccccagcaggcctctcttggcgctccaaaagccaagctgtgcccagccacagttccaaattgcttcttgaccccatgcagcaatgctttaagtggctttccaggatttcctgcatgcacacacagccttctc

SEQ ID NO: 714091 - DNA, 160 bp, Homo sapiens
catgatgcgcaaggcacatccgagggcacatgtaaaacaagccgcagatctggagacactgctgcctcctatccgggggaatgtgaggctattgtgttcaccacaggaggacctcactgacgatcagggcacatgttgcatggccactcaaggtgccagc

SEQ ID NO: 714092 - DNA, 418 bp, Homo sapiens
tgcacgagtcgcttactcctgtaatcccagcactttgggaggcccagtgaggtgggagaatagcttgaacccaggaggcagaggttgcagtgagctgagattgcaccactgcactccagcctgggtaacacagtgagactcttgtctcaaaaaaaaaaaaaaaaatctaagatagaggttgggtcaacagtgcttaataataaataagaacctcctgccattcataatatcctgatgaaccccataccccacacacccttcacgaacatagatatcagcagtattaccacggtataaagactgtgcaccttgattatgtcatttcaggcacatggatccaggagaaggccagtggagtggaagaactggtaaacatttgaggtttgccccaggccttgtgtacacgcaataagtggtg

SEQ ID NO: 714093 - DNA, 561 bp, Homo sapiens
cgcggtggctcacgcctgtaatcccagcactttgggaggctgaggcgggcggatcagttgaggtcaggagttcgagacaagcctggctaacacagtaaaaccccgtctgtactgaaaatacaaaaaaattagccgggtgtggtggcaggtgcctgtagtcccagctacttgggaggctgaggcaggagaatggtgtgaacccaggaggcggagcttgcagtgagccaagatcgcgccactgcactccagcctgggcgacagagcgagactccatcttaaaaaaaaaaaaaaaaaaaaaaaaaaactttttggggggcttgggccctggaaaggttttaaaaaccatccgtggggcacgcgggccacagatgggtagaggaacaggggccaaacgggtcccaaggaaaccgggcccggacaaagggcgggttctcaccaattaaaaaacgccggggggacacggcagggtcgtggaaaaatcccagaagggggtcagaggggcaacacgggcctctaaaaggaggacccagcggagccgaattaaataccgccgggggggcc

SEQ ID NO: 714094 - DNA, 644 bp, Homo sapiens
  misc_feature (110)..(111): n is a, c, g, or t
  misc_feature (619)..(619): n is a, c, g, or t
aaaaaaaaaaaaaaagaaaaaggtgctctttcacaaaaaaaaaaacccccccccccgggcccttttttttgtgtttttttttaaaaaaaaaaaaaaaaaaaaagaggggnnaaagggtggtgtgtttttttctccccccccgggggggggggggagaaaaaaaaaaaaaaaaatttggggggtgttttttttttacacaaaaaaaaaaaaataatttatgttcttcccccccccccccccccctcttttttttttttttgggggggccccccccccccaaaaaaaaaaaaaacacacccaccccccaaaaaaaaaaaaaaaaaaaaactttcccccaaaacaatttgttttttgcccctttcttccctcacaaaagggggccgcggcgggcccttttttcccagaagaacgggggagccccggggacaattttttttaaccccccccccccccccacctggggggaaaattgggggggttcaaaggaaaccctttttgtggcctttggaggcccaaaccaaaaaacccgttgtgttccggcttaattgggttccaattcccggtcagggggcaaaaccattagaatcgctgggccttaaagggaaaatagtgcaggtcntggtgcaggggggtgacccggacgt

SEQ ID NO: 714095 - DNA, 925 bp, Homo sapiens
  misc_feature (103)..(103): n is a, c, g, or t
gtgtctctatccggtgctctggtctccttcctttgtgccccacatatcgtccacttgggccggcaagacgtctgtcccgcgttgttataagcgccgcctctcnctcccactgtttatcctaagggcgcgccatgagatttgcgtcggtgcgccgcctcgtaaatttttgtggttgagggtcctcctcctatattcggggatttattgggacgccccccacgagggagggtgcttctgttaccaccccgcgtcccccgggggtctatgttcgttggtcggcccccagctactgtgcgttggtaacgttgttctctccgcgcgggctgggaaacacctagccggggtccacggctgccactgtagcgtcgcctttaagtggctcgcccacttgtcagcccaaatgcccccgcctgtcccaaaggttaaacccacctcctttttgttgtccaacataatataaggggaccagtgttctgttgcaccactattagtttaattttcctttccctgttatggaggcacacacacaaaacaatgcgcctatggacaaatcgtgtataaccacgtccacgcttccgccaacttcatcccctctgaacaccattattcattccgcgccaactataataaacagagtcacatccactcgtcgtatataatcatccaacaagggcatctattctctatttctaccactagaataatcattattatacatttattccccctagctcagcttttcatgacccacccccagttctctaacattagtctagtctttcaccacataaagtttataataccacctcgctgtttctctttcccacatcatcttcaagggatcatgcaacaacaatgacagcccccccctcttttcacaatcacaggaaaaaaaaaatatattttcttcgaaccacatagacaa

SEQ ID NO: 714096 - DNA, 291 bp, Homo sapiens
  misc_feature (77)..(77): n is a, c, g, or t
  misc_feature (248)..(248): n is a, c, g, or t
  misc_feature (259)..(259): n is a, c, g, or t
gtagagacggggtttcaccatgttggccaggctggtcttgaactcctgacctcagatgatccgcttgcctcggcctnccaaagtgctgggattacaggtgtgagccaccacacctggcccacttgtattttaaaatacaagaccaaagaatatttctgacatgtgtgagtcatacagaatggcaataaaacgaactcccatatgcataccccctagcttaggacataagaaattactatctttgaggnccccatttcgnctcttccctaatgctattcctctttattcgca

SEQ ID NO: 714097 - DNA, 278 bp, Homo sapiens
  misc_feature (50)..(50): n is a, c, g, or t
  misc_feature (53)..(54): n is a, c, g, or t
  misc_feature (59)..(59): n is a, c, g, or t
  misc_feature (105)..(105): n is a, c, g, or t
  misc_feature (165)..(165): n is a, c, g, or t
  misc_feature (216)..(217): n is a, c, g, or t
atttaacatatttgggtccaacttcaataatgtaataattaatacattantannatttnatttcctttctagaaaaatgcacaggctaaggcatagacaaaacanagagaaatgctgagaaatttgccactggagacaagcaatctgaataaatatttgccaaangttctttttatgtcatatagtgtcaggatttgacggagctattcccccccnnatgttgcaactagcaactcatcttcggaagacacagccaggagatgacgtagaggtgaaag

SEQ ID NO: 714098 - DNA, 570 bp, Homo sapiens
  misc_feature (249)..(249): n is a, c, g, or t
  misc_feature (259)..(259): n is a, c, g, or t
  misc_feature (276)..(276): n is a, c, g, or t
gtgaacatgtacatggtctgctctcatttattcattcttctctcaaaagtcaaatgaatgcagagggagctggtcaaactgctttgtttcaactgcaggcaggggagcaaaaggacgccatgtgagcattaggaaaaaaaatactcactcttactaacaatttttatacagaaaatgagtcatttggaaatgattcttatgttttttttttttctccttttagaaaattctccaaaaggtttggatgtngaatctgggnctgggacctgttttttnccttggagggtttttggtttttggttttttctaggatttcatggtgatgtttgggtttggtttttggcttttggtttaagtggtgctgacaccaaacacatccagtttataatcagtacatgggaaagcgggtatggatgtagaaccagtgcataacttttaagggggttggtaatgggtttttttttttggtaaagtgtgaataacagggttatgttactcattttccctgaacacggtgtgggtaaggtgcttcatgacaattccagtgaaggtgagctggagctggtgggc

SEQ ID NO: 714099 - DNA, 1247 bp, Homo sapiens
agtgttgactggggtgattgatccagactatcaagatgaaatcagtctaccactccagcaacggaggtaagaaagagtatgcatggaatacaagagatgtgggaggatcacttgagcccaggtgtttaagtccagtctgggaaacatagtgagaccctgtcactaaactaaaaacaaaaataagatatcgttcagcaatttgtgcgagcggcgtgtaacatttcaaagcactatttcaacatactttacaaatacactcacaaacaacaggaatcctattctgagggccgctcctcctcaagacaaatcggtgcccggtggctcctgtcgtgacattagggcgggtgtcacacagtggggggcatgaatctattagatcgatggactatggccacccaatgactcctatatgagcgcaaggtgcctacttctacgaccagactatgtgcctcgctagagtagcgctctttttcgcgggcacaagtttgacagccggtttttactgcggggatataactgatcagcgattgctagtagtctacactcaacatactaactgcagcctctgtgcctcgttagtctctctgcgtcctcccgcagttccgcgcctacattcttctcttttctccctctcgctgtgctcgactcctgctcgcatcgcgaggtctctatcttgtctttcttttccccctttgctcgtctcgtggttggctgttcactccgtacgctctgctgcgcttctctctctatgcagttctacgcgggcttctgtgctcttcgagcggtgttgcgtcgcgggcgttcctcagagtggcccgcgcggtgttttgtcgctctcggcgtcggttgtgtgcggctacgtccccgtcgtggggtgtcctcgttcgtctctctgtgggtggcgtctcgtccgtcgtgcgtcccgtctagtctgcgctccccctccccttgcctcttcttttgtgtgcggtgttggctctgtcgtctgtgctgtgcgtgttcgtctgtgggtgcggtcgccgtgtggtttctgtgtgccacacctccgtccttgtgtggtctgttcttggcgtgggtccggacgtacgtctatcgtgtcggccgccctgttgtaggtcgtgtgtgtcacgtcgagtgctgaccgcctccgctgtcgtcgcacgtctgtactatgtcactcgtacctactcgcgccactgggtcggagttcgccccggctgctgtccgtgcgctacgtctctcttccc

SEQ ID NO: 714100 - DNA, 466 bp, Homo sapiens
  misc_feature (45)..(45): n is a, c, g, or t
  misc_feature (90)..(90): n is a, c, g, or t
  misc_feature (163)..(163): n is a, c, g, or t
atagggctctatatttattcccggcatgcataccatgctcttggngtaaaatggaaaaccaatgttaccaagggagttctaccaaaggangacactattttccttctttatccacttctggtattaaaatcttgctattgtgggggaatatttttgggcaccngaactgacagatttacagtgctttttcttctttttaacttttccctctgaaaccaaaacggtaatacatgaaaaatgcagaaaacatccaaaaggatgaaaatctaaattacttataaacctactaccaactcccactgttaagaatgtatgttatcattcttccagatttcacgatgcacaaatttgttaatgattaattttcaacctccttctttcatttaaatatattctgtatatttaatccagcattaaatgttcttctaaaacattatttttcatggctgcttactagtgcatattt

SEQ ID NO: 714101 - DNA, 781 bp, Homo sapiens
ccacgcgtcgaggcagggtgggcaggtgcccaggaggaaagatatctggtgtcctgcaggctccagtttgagctctggcgaggctgcacggcataggcaggtgagcgtggctgactctgcttcccaccccgtaccgtgaggaaggacgagttcttttgttggttatttttcactggatggctgtgaggattgaaaaaaagaaatccccttatagaacagtaggagctgtccgggcgcggaggctcacacctgtaatccccagcagcttggggaggcccaggcgggtgtgatcacctggaggtcaggagttcaagaccagtctggcccaacatgtgtgatgaccccggtctcgtactaaaatagctagaaagacagttagccggggcatggtggtgggcgcctataatcccaagtactcgggagggcctgaggcaggagaatcgcttgaatccggtgaggcagaggttgcagtgagccaagattgtgccagctgtcactccagcctgggcaaacaagagcgaaactctgtcacaaacaaagtaatgaaaacctgtaaggacctgttcgtaaaacacacacccgaggatgcctttccccgggacagtaacttcccatagagagagctcaggttgtgacgtatgcttcacccaagtgaccggaccgctgtgcttttccacaggtgagtaactcaatcgaggcctcataacgatgctatgacgaatggatctatgattatacgcactagcaggtgaaaagatgaggagcagagttgagggacttc

SEQ ID NO: 714102 - DNA, 1295 bp, Homo sapiens
gcagaagacgtgcggagggagacgcacgagacagagtgagatggcctggcagccacccagtctcgtgggggagcacttagctcccccgccccgtgctcccgacctgtccgtgggtggctcctgaatgccctcagccccaaccccgtggcgtccaccatggaagccagctgtgccaccaggaggagcaggaggatggtggagtctggctgaatgccacacggatgccgcaccgtgggccccatgagcacgatccaccgagtcctaggcgcgctgccactaatgggacacgcgaggaagaaaaagaagcacacagcagcaccgagggccgagcacgcaagagagcgcgacaaggaagcggcggggcgggcagagagagaggcagggcgagagacaagaggaggcggcgaggagcgcgcggaaggcggaggagaacggaggggcaggagcgaagggagaggcgaaagtcagcgaggagagagaggaggtagcggaggggaaagacaagagagaggacagagggaggagaagagagggaggggagaggagagcaggcgcggggaggaacagcgcacgagaacacggagcgagaagaggcgagcagagggcgaggcaggaagagaaagacggcgaagagggggagggaggcgaggcccggcggccgaggagcggaccgcggccaacagcggggcggcggagaggaggggagaggcacaggagaaaggaagagaagggccacgccggaggcgaaggaagcggaggaacgcgggcaccggagcgagaccgacgaaggaccggcaaggagacgagcaggaaggaaggcaggcgaaaaacaacaaagaacgaaacagaaagcaggaccgacgaggcaagaagacaggcagggagaaagacgcgagagagcgagccgtgcagcgacgaggcaggagcggggcgacaggcgagaaagacagaggagagagaaagaggagaagagaggaggagaagcacgcggacacgcagaccaaagaggagaccggcagaacaggcgacagggacgcgagagacagacgggggacggcaggaagcagaagcgcgcagacacacaaagaggagaccgacaggcaagacaaggcaggcgacaaagccgaaagaagcgaggagaaggaagacggacggacagacaagaaggaggggagagaggggaggacaagagagaggaacgaacgaggagaggagaaaagggaagggagacgggcaggaagcccgacacgcggagaacagcgggggcggacaaggacgaagacagacggcgtgaa

SEQ ID NO: 714103 - DNA, 231 bp, Homo sapiens
cacgaggagagatcccctggcccaccttgacactccccaaaccaaactctcacggtcccactccatgtaacatcgtcttcctgtagacttcagaccggtccaatcccatcttcctgttcatgtgctcggtggattcggccgccagaactcaccccgtttcccacgtgctggtcctgatgaaagggcttccgggtggccacccctctctgcctcggtacctgcgtatctcac

SEQ ID NO: 714104 - DNA, 265 bp, Homo sapiens
cgggtcttcgtactgtggtggtcttgccgctggtggttagagcagctggcgctcgagtagctgacggcggtggtggtgctggtcgtactggcgtcactgttggtcgtcgagctgctgctggatttcggattggtgacggtcgccgtgcagctgttgctcttggcggtgcacgtgtaggtaccgccgccggtgagcgacgccgacttgccggtcgaggtggtcgaaccgctgacgctggtggagctgctgctactggacgaggttg

SEQ ID NO: 714105 - DNA, 441 bp, Homo sapiens
  misc_feature (369)..(369): n is a, c, g, or t
gtcgactgataatacaatcatacatcacttagccacagggtaagccacagggaaatgcatccttaggtgattttgttgtgtgaacatcgtcaagtgaacttactcagacctaggtggtgaaacctactacacacctaggctgtatggtacagcctgttactcctaggctacaaccctgtacagcacattattgtactgaataggtgctaggcgtggtggcttacacctgtaatcccaacactttgggaggccaaggtgggaggatcccttgaggccaggagttcaagaccagcctgggcaacatagtgagacacccccccacacacaccgattccctgtctcttaaaaaaattttttttaattagctgngagtggtggtgcatgcctgtagacccagctactcaggaggttgaggcaggaggattgcttgagcccaggagg

SEQ ID NO: 714106 - DNA, 248 bp, Homo sapiens
ctgggtacggacgggaggatacccggtctttggatgatgagagggagacgaaagccgagacgtggactctggttttacctgtggcaggtttaaacaaagtcctcaagatttctttatgtgccagagagtacatctctggacttaatctctaggggggcaaaacagaataactagaaacaaatataatgatcattctggaatccgtgttctttacttggttcacgcgcatattaattctcataccttca

SEQ ID NO: 714107 - DNA, 425 bp, Homo sapiens
tcctggcaggtcctacctttagaccaggattgggggatagggaggtctcatctggaagacaattaaaggcggcttttcaaggtgtaatatatgcaaggtagggcatggaagcaatctgaaatggcatccggtttggactggccatggctttggtatgttcttatccagcacccttaaaaggtccaaaggggtggggaaatttggtcaggttgggtgcccccaaaacacacaaatccccattcctagccgggggatgattgaatctcggggacggagcagctaccaacggcaaagccaaagctctctgctggtatccaggcccctagggcaaggccgggatctcgagggcgcctaagccagagctggagtccggaaggctggtcccacggtagagggggtgacgacggctgaataagcagcccttg

SEQ ID NO: 714108 - DNA, 159 bp, Homo sapiens
cggaggcagaggtctagaggagtcccccctgagtttagaagtacacagcagcggttaggatacacaaacatatatatacaatttctaagacaagtaaataaaagcagtttagtatatctgcctgaattcatatattcaaaatcttaccaaaatattgat

SEQ ID NO: 714109 - DNA, 586 bp, Homo sapiens
  misc_feature (360)..(360): n is a, c, g, or t
cagcccgacattaattgcaataagttaaaaaaaattgattagaaaaatttactttacattaacacaaacatgctgtttttaacaaaatggtgccaaatcggagtaatggcatctacggatcatgaattattcttatcatattactcttttttttcttaaagcattcaccattgcacacatgccgaacacaggagtattagccattcatatctgaaaagctacaggatttaagaatcatacaaccccaaacataaacaccagtgacactggcggatcaaaacatctgccaattctatagctttacattgaacaactctggatactcagcgtgttgccaaggaaaggaactcctgtcagtgngatgacaaattgtatagcatgcaattgaataagaaggccgtttaccgctaggccactgacgttactttgaggccaaaagccaagcaccggcattttcaaagctttatgatccatggttctgtccctcctttaaaactctcaacattacttgatcggcagaacaatacacaggagacttatggctaaagtcgcttggtgccccagcttactttaacaatcaagaaaa

SEQ ID NO: 714110 - DNA, 494 bp, Homo sapiens
acccagaacacgtgggatgcaagtaatcagagtagggaaactagttagaatataattatgtgctccgcacttgggcttctctttgctcgtgctaaggacgtgctctcctatccgctgcctactacctctccctactctcctctggaacaagacacaagttaaactgaggtggaggagcttggtgttctctaagtaatcattgcagtaatagatcactgcgtgactaaacgtacacccagtaggctggtgcatcgtttgtgtctctgggtcaaatacacgttgagagaagtctcatttattgttcctcgaatttgtgcaaacctgaacatatgtctatctctaagtttatgccacccctatttacttgcttttggtcctgtttcctttcttcatataacactctttatcctgtaagaggacagtttccttcgctgcagtgggaccacagactatagagaattaggacctggaaacagaatgtgcagttatagggg

SEQ ID NO: 714111 - DNA, 170 bp, Homo sapiens
taatcgatgaaaagttacacattttggcagagaaaagtcttagctgaaggaaaatcaagtggaaaaatgaaatctatttttaatattactactatatgaattatctttttttaaacttgtagataaagagtgttccatgtcatcaggaaaatcctcaagacaaattgact

SEQ ID NO: 714112 - DNA, 805 bp, Homo sapiens
taattaaccactcattcatcgacctccccaccccatccaacatctccgcatgatgaaacttcggctcactccttggcgcctgcctgatcctccaaatcaccacaggactattcctagccatgcactactcaccagacgcctcaaccgccttttcatcaatcgcccacatcactcgagacgctcacatcatggctgaactcatccgcctaccttcacgccaactggcgcctcaactattctttatctgcctcttcctacacatcgggcgaggcctactacttacggactcatttctctactcagaaacctgaaacactcggcattatcctcctgccttgcaactataccaacagccttcactaggctatgtcctcccatgaggccaaactactcatctctgcaggggccacagctaattacaaacttactatccgccatcccatacactcgggacagcacctacttcaactcaactctgacgaggctactcacctacacacgtcccaccctcacacgactccctctaccttccacttcatcctgcccttcatctatcgcagccctagcaacactccacctcctattcttgcccgaacccgggatcccacaaccccctacgaatcacctcccattccgatcacaatcaccttccacccttactacacaactcaaagacgccctcggcttactttctcttccttctctccttaatgacattcaccctattctcaccagaactcctacgcgacccaaccactactcccaaaccacccctcaaacccctccccaatacgccccacgccac

SEQ ID NO: 714113 - DNA, 1035 bp, Homo sapiens
agaaatcggcaatatcatctctgatgcgatgaaaaaagttggaagaaagggtgttagttcacaggtaaaggatggaaaatctactgacatgatgaattacaaattattgaaggcatgaagtttgatcggaggctatatttctccatactttattaatacatcaagaaggtcagaaatgtgaattccaggatgcctatgttctgttgagtgataaagacaaatttctagtatccagtccattgtacctgctcttgagatattgccaagtgctcaccgtaagcctttgtgatcataatcgctgaaagatgttgatggagaagctctaagtacactcgtcttgaataggtccgtactaggttgggtcttcaggttagtggcacgatacacacggctccaggggttaggtgacaagttaagaggagaaccaggcttaaaggatatgcgtctattgctactggatggttgcacgtggtggtggagaacgatggggattgaccctgaatgccttgataacgacgtttcatgcctacatgacttaggaaaatgttggagaggggtcattgttgaccaaagacgatgccatgctcttcactaggaaataggtgacaggctcattctgaaccaacgtatccaggaaatcattgagcagttcgatgtcccccctagtgattccaaccaggaagatgaatgaacggttgcaaagtcgaatggagtgggtgatcgctgaagggtggtgggccatgatgctttgacgggaacttgaacgaaaaccagttcattggccttatggttcaaaactgcgttgaaaagcgtgtttgcgcggggggggtgtcccccccttaagatcaaaccggggacatgttcccgcttggtagagaacaacggtttgattcttgtaaaccacagccccacgtctagaacgagtggatacgtatagagacctcacctatatggcgtgtccagcattcagaagcacaacaaacaatgagagtggtcacatcaaaccaagcatcaaggtatcactaataagaagct

SEQ ID NO: 714114 - DNA, 600 bp, Homo sapiens
gaaggctaagagcgaaactgtcccagctgttctgtcctaggggagggggacatagccctagcaggagctcccagcccctcttggcactctgacacacaagtacacccatctggggcccgctttgccacgaagagctgggcaggcctgcagggtgtagggtgaaggacggatcacgaacctgcaagaaaggagagcgtcgaaccccagggaacagcgggtcccttcccgtccgtgcagacacaagccacctcagcatatgtggctcttggcccccagcccgcaccaatcccacctgttgcacttagttcaacagacaactgacagctgatatttattggacaatttgcagccatgctcaagcattcggcttggattatacccagttgtttctcacagccggtatttattgtctgctctctctgtgccaggtatctgtgctctggacatggggcactgcatgggctgcctgacctgagtggagcttgtggtcatgataggagtgagagctgacctcaagcccacccacattgcctatacagggcatagggcaagagtatacaacaggggcctcatataatatgtcgtaaatatataagacgg

SEQ ID NO: 714115 - DNA, 516 bp, Homo sapiens
ttccctgtcatgtaccttgtctttgctgaagttacttgttttatatgattggtggcatttaaaaacttggactaactcataacattctttgcttttttattgtcatgttgtgtttgtgcaggaaatatgttttttattcatttgtatagtataggtctgatacaccaaaagaaattcattagaacatatttatttgatgtttgaaggactctttaaaatagtttatctgtttaaataatgtgtaagatttatgcatttttatataacaaaccaaaatcacatgtgtatttaactgctttgttagttgctgataatttatgtaacaaaattttcttggagtcttaagtctcacaaaacatcttatttttgtgcatccacacatgccaataagtgaatcatggtgcctttcccaagccttgtatgaacaggactggggtaagggctattttttttcttatcatgggtacttagaataagctttacaaagaaaattccatgtttctcaggcaaaaaaaa

SEQ ID NO: 714116 - DNA, 464 bp, Homo sapiens
ccatcatcggtgctgggagcgtgctcgatgtaggacggattaaatgggtcggtgtatgagacgtgctggagcagtgtcacgcagcatcatcaccatttgaatagctattacctaatgccctgcagatgcactggcacaaagcaagagaggcatattgactaggctgagcagttacctttagattctgacgttatttgcacatgaatgtatagcgatagttatgggtcacagtgagtatataatccagcttaaggaagtagacccttgtctagctgtattagacttacgatatttccagatatgggtccagctattagaatttggggttactggccatcttcttgctctaatcaatattcactttctgaagtctttcctcagttctcatgtggactccagctggggctttcccttagaaccggactcatgggatattacaggccagggcttcaggatcctccagc

SEQ ID NO: 714117 - DNA, 908 bp, Homo sapiens
cagaccgctcatcacgaacatcatcgtgtgatgaagaagaggagaatgaagagatccctcccaaatcccaaccagtttccttacctgacgaatagaatcgggttcgattatcactgggcatgcagttgcccactctagagtgagaaactctgaccggagaagagttcatcagagtgtttctgccgtgctcctcctcactcctaagctccatctcgaaaggccagcagcatctctcgtttcctcgcgtctgctccggaaaagcagcagtggagacttcatgcaacaatgattcccaaatttagaagcctcgaatgtctcggaattctcaggctagaatcataactggagaaaccggtgtgttgctcgtctcgcactgtgtgcccagagaggcaaacttccccttctccacccaggagtctgactctgaatcaacttgtctagactcagagacaccactgcaaaggttatccgagaggggccatcccatgtccgagcagcaacccggttccgaatggtagagaagaggtctgagaatcatcatgtctcctgcaagacatcgtcgtcgcattacgatggaaagctcgtggggagggactcctccactaccagcacgatgccagtaagctatcattcatgctgctagggatccttcagagaatcggggacgccagagggaatccggcacggggaagacagctgattcggtcatgcagagctaattcaccgatgctggccgcaaggaagtatagccggaacactcccaggggggctccgcggtgggaacccggatggaagggcaccgcggggaagggggaacccggaacccagacaaaaaggcgccgagcgccttgcaacaaacaaggggagcccaccaccccgggcggctcaacttccctacaaaaagggcc

SEQ ID NO: 714118 - DNA, 878 bp, Homo sapiens
tacgggatcgggctgcttacctgcagctgcccgtgctgtgactgtgacctagaccccgactccctttggctcagccctgtgcgccccagtgccctggcctggtgtgtgcgcgacgggaggatagagctggcgggctggtggaaggaggagccgctcagccgcagctgtgcaactggggccctcaaagtctccgtctggagtactggtgctgcggagcgacgcgtgcctgggaggataaggatgaattttcagatgtgatctactggttccgacagatcattgctgtggtcctgggtgtcattatggggagttatgccattacgagggttctctgggaatagcagggtaacgtcttgaggtatcttatatatcacatggtatcatttctttttagatagacggcttctccttcctgttcccggacaaggccattcgctgcaactggacccttgctgctgtgcgttcgtcgatcgactctactggcacgaaacgtagtaccctaacacgactagggtcccatacactggggacctgagctggcacaacgtacgcctacaggacagctaccactggacactaccctggaccacgactgcaactgacacgggacaatccctagacagccgcccaccacctcccgggccggaaaccgcacacaccactatgaccgacgcacccgacagcccatgccacgccccacgccagcaaacgcaccagaccgacacacgaaacgcggcctccccacgaccgtaccccgccacgcgccacgcgctcactagtgggccgccacaccgacggtccccagccaacccaacccgaaggaggaacgcgtcagcacggaccgaggggggcagactggcccagaggacacgaacagc

SEQ ID NO: 714119 - DNA, 341 bp, Homo sapiens
atcggtggcatgtgatctcatagttcaattcccacctatgagtgagaatatatggtgttggtttttgttctgcgatagtttactgagaatgatgatttccaatttcatccatgtccctacaaaggatatgaactcatcattttttatggctgcatagtattccaagcctgttaatctttaatcaaattccagatattgtgaattttatatttttgggtgctggattatttttattcctattaaatcttgagggtgatttgcaattcagttattgtatttgtcaacgttcgcttttttttttttttttttataatttggtagggccagtattataaacataa

SEQ ID NO: 714120 - DNA, 182 bp, Homo sapiens
  misc_feature (34)..(34): n is a, c, g, or t
  misc_feature (108)..(108): n is a, c, g, or t
  misc_feature (130)..(130): n is a, c, g, or t
  misc_feature (134)..(134): n is a, c, g, or t
cctcccagtctcagggtggccagggagatacttnactatccttgggttccctgcaaaaacctgccctccttccctggttgtattctccagccccttgtgggaagaganatctagccactgtgctctgagnacantgtgtgtcctaggattcattcagttcaggaagttacaaatgaactttc

SEQ ID NO: 714121 - DNA, 213 bp, Homo sapiens
  misc_feature (86)..(86): n is a, c, g, or t
  misc_feature (97)..(97): n is a, c, g, or t
  misc_feature (105)..(105): n is a, c, g, or t
  misc_feature (135)..(135): n is a, c, g, or t
  misc_feature (168)..(168): n is a, c, g, or t
  misc_feature (171)..(171): n is a, c, g, or t
  misc_feature (190)..(190): n is a, c, g, or t
ggcacgagattttaattagacatgcaacagttttcactaccttttcaggattttttgttcctgttaacagaggcttttgctttttnacagagaggtnggcaggtngagaggttatcttcttcttcagttcttaangttgttaagattcctcttggaaggctacccttnttngggacttacagtttcaatnccagcaagctaggcctgctccag

SEQ ID NO: 714122 - DNA, 94 bp, Homo sapiens
catgagctggtccgacggtttccctgtgagcagcagagcacacaatatatgaggcactgtgccagtgctccaggtggcctccctgtgctgtcac

SEQ ID NO: 714123 - DNA, 494 bp, Homo sapiens
ccctcgggatgcaagtgtcggtaattggcaacagtgatcgtgagaaggtcatagtctaagaattatctaaaatattttaaaaactataaagctgcaacacactgatgtttacaccatagttactaagaaaactaagagaaagcacttattacgctctgcaataacagtaacatgagaaagcactatttacataatcagacaaacaaaaaccttctatatgcattatcagcaaagattttatacatacaagagaggcatattgctcaagtcagaaggggttctataacgaaaagcacttactaagttagcgactaacagaacaaccagtttaaagatgaattaaatgcccaatttggggaggcatggcaggtgtaagagaaaggaaaagcttaagaaaacatttcctgataataccaacctttctttcatcatctactgcatttgacagaaattaaccttttagagtttttacccgtgacactttgcatccagag

SEQ ID NO: 714124 - DNA, 155 bp, Homo sapiens
cgcccgctaccaataaggaaccagctctcagagagccctgaggcagctcagaatgcagttatttaagccaggacttaattgttgttcatgcgccaaaaaagagtgttagttttcctctatgcttagctcaaaaattctatcaaatatagagttcc

SEQ ID NO: 714125 - DNA, 594 bp, Homo sapiens
taatgggcttgggtgagggaggtaggtggtagttggtgtttaatattttagtggggtgatgaggaatagtgtaaggagtatgggggtaattatggggggccatagggtaatattaagtgggggcattttaaattcttgagagcgaaagcctataatcccgggcggcccgctcataaggggactgggccagggctgaggtctacataaggatagtcgggtggggtgggggggtacatgagtgagaggcagagacgtcccgaggaggtataagtggtggggcacatcaaacaatcgactagaccagcgatcctgagttatcaaacggaaaatcgagggtctcgcccacctctgaacaggctgaggtgcaacgcgcggcacactccactgagggcgattccgacagggtacagactttgagcatcaaaagccactgaggtccggcggtggccagaatccaagcccgacattgaacgcaatgaaacaaacataagcgcaacaggagcgacgcacacaaaaacaacagggggggcacacataccaccgagcaccccgaccacgagccgaccgacccacccacacaagcccccacgagcc

SEQ ID NO: 714126 - DNA, 160 bp, Homo sapiens
cagctcctctgattctgaatctgaatgatgaggctgacgaggatgaagaacgaaggcgacgtcactttccgacccacctgacgaagcttctgaatcagaagaccctgttttctgagtggaggacagaactttctgttaggaaactctaccaaagtctttc

SEQ ID NO: 714127 - DNA, 197 bp, Homo sapiens
atggttcatttcccagcaacagcaagcagcaatggccaacagtcatgcagcacaggctgcagcatcaacaggcagcatagggatgcagccatgccatcagcggcacaatcacacatgccatcaacatcatcatcacatttcgcacagcattcatcagcacagcacaggagcaacatcagcacacacatggcaccacc

SEQ ID NO: 714128 - DNA, 524 bp, Homo sapiens
cctccgcgtaaaagcactctacaagatactgttcacgttgaaaggaaaggatattttgcatagcaccaaccgcaggtgatgagccctgttcaccggacagggtctagctgcgacagtgaatataaacgcactgtttcctcgggcacaaagtgaagtgatcatggaacgagacggtaacgctcatttctcggatcctctgtttacaacaacatctgaagaataaactaaggcgtctggtgccgtgaacagcatataatgcaaatctgtacaaagcgcctgttttctactctagcctgttcatatgcaccgctctccaacaagtaacccaagtataatttggcacgagcgggtgttcacaatcacgtaaaaaagggtttggggaaaaggtgctcaataaggcaggaggtgtcctttttcccagacgcagtataaccctgtcgcagacgggattttaagcatagaaaggccccgtatgaatctataaaattcccagttggatccggaaaagcaaacgtaaaataaaa

SEQ ID NO: 714129 - DNA, 157 bp, Homo sapiens
  misc_feature (2)..(2): n is a, c, g, or t
  misc_feature (42)..(42): n is a, c, g, or t
  misc_feature (132)..(132): n is a, c, g, or t
tnctgggacaccatggtttcaaacgaagatgaattgaatctnctggttattgtagttaatgccaacccaatttggtggggaaagcaagcattaaaggaatctaagttcactttatccaaatgcatagatgcngtgatggtgctgggaaattgcattt

SEQ ID NO: 714130 - DNA, 180 bp, Homo sapiens
cctgggtgattaatctcgaaggaggataggaatgatggatgataggcgagtccctgcacgcgttccgctccgcgcgggggcccggctcccgggcgcggtcctcgggcggacggagcgggcggccggcggcggagacggcgcgcggcgcttccggagccagcgggtgctagtggagccgga

SEQ ID NO: 714131 - DNA, 135 bp, Homo sapiens
actgcatccgagtgtcgcccctaccgaaatttttaatgcatggctttggtaatttagagacctgtgggtttgttaggtactgtttgcattattaaattaaagctccatagggatcatctcgtctcttctcttgta

SEQ ID NO: 714132 - DNA, 435 bp, Homo sapiens
ttttttttttattttaaggtttgagggggaatgctggaaattgtaaggggtatggcaccgtgggtttaagtaatgctagggtgagttgtgtaggaagtttttcataggaggtgtatgaattggtcgtagcggaatcgggggtatgctgttcaaattcataaaaccgcgggaggttaaaagtagggtctgggctgccacacacatattttggggggtcgagtcagaggggtgcaagaaggtgcgtcaatctatgtgtggctcccttagtggaaacgaatgggctacgctggagtcggcagaggcttgtgtaatgagataaataaagtgatatagaggtgataatctcgggcgtatgtcaagacaaaatagaggcggaaaagaggtgcacattgcggaggagattatatcatagtgttagaaagcccctgtagaatt

SEQ ID NO: 714133 - DNA, 426 bp, Homo sapiens
  misc_feature (210)..(210): n is a, c, g, or t
cggatctatctgcaccacagcgcatcgcacgtctggtgcgggctcatcgcacactgtcctcctttgacctgcttctaccgagactgctgctggtgcacgcttctaccttatgagatgctgctcatgtgggatgcgctgaaccagccgaacctcacctgcggcaatcagacacagatctactgagtcagcatcagggtccccagcctctgngctcctgtttccataggaaggggcggcccttcctcccaggaagctgagacctttgtggtctgagcataagggagtgccagggaaggtttgaggtttgatgagtgaatattctggctggcgaactcctacacatccttcaaaacccacctggtactgttccagcatcttccctggatggctggaggaactccagaaaatatgcatcttctttttgcg

SEQ ID NO: 714134 - DNA, 177 bp, Homo sapiens
ccataatataagtatttatcatgtattctgtgtctggaatacaattcaatgacctatttcagaaaaatcttttcaagtactggctgaaagagtgagggatacattaggagactgcaaataaactggcaatcacaagaactttttcggataaaatgaaattgtgccgaaatgtataca

SEQ ID NO: 714135 - DNA, 154 bp, Homo sapiens
atacatcggggctcattttctctcattctgaccatgtatctccttgtgatcagaacctccaaatactggcatgagaaactagagggcaggtcttcatacaaatgccctttgaacccccttcctgccctgtgttcatgagatagggttaatgggc

SEQ ID NO: 714136 - DNA, 251 bp, Homo sapiens
gaaacagaaaactttatcacccttccccctcccaaattaagccaaaggtcaaagatctcaaatgaagcgaagcacatgcgacggggaaaggtgattccataatgatgaataacctacctccccagaacaaggcagaagggaagattaagatacacaacttgtacagtttaaaaactggagaccaacagtacgctgtacacatgcaaatagttgcaggtggaaaacatggacagtcagacagatcaagatac

SEQ ID NO: 714137 - DNA, 891 bp, Homo sapiens
ttgtgtgaaaggcccaggtgacaggtcatgatgtagtagtgtcttaacggttttttaataaatcctttgtataaaaatgtattggtctttatcatcagaataggaaaaattgtcatggattcaagttattaaaagcataagttggaagacaggttgcgaaatgaggaatgattaaaatgcagtgaagttgaaatgttgcagaaaatctaattttttgcataatgtgtcctcccatgtccaaattgggaagtgacttaatgtcaattgtgtgtgggtgttttaataatacttccttatgtagcgcattaagatttatactgaatattgttcccaaatgcccagtttgtgttaatatgtatagtgcttttagaacaaatctggataaatgtgcaaaagtaccgctttgcacagatagttaatgttttatgcttccattaaataagaaggacttaaaatctgttaagttataatagaacatgggtagttcagagagatttgtagagctgtggtggacttcatagatgaattccagtgtcgagggaggatttccgaaatttgtgcgtgaaacacaaagcaggggggcggcaagaataactggagggggccagtttagggtacccagtttttgtacaggggggccctatggaggacggtcaaagcacaggcggggcggcgaaaacggcgggtgggagacacggacccggacgttggagggccctctctggggggcccatcggccacaccgcaagagaacgccaaggaataacactaaggacagggaccacgacttgggcgcacgttgcggactacaacttcaggcgagaccaggggacagcgagcacgcgacacaaagcaacacaacgccacgacacagcaaacacaccgccacca

SEQ ID NO: 714138 - DNA, 486 bp, Homo sapiens
gtttagagaactaacatgctgtaacaccagactaaatcattttcccctttccgataaaggagcaggcttccgcacaaaaatctttggtctctctctaacctgactgactaagtcccttcatgctaaagcttgcacctaagttggtctacacccccctagtcaacatacaataccaagcagtttctacccagggtgtacaggtcatttgatcacttaaagccattctcatgactacaatgagtacaccaacctccacagcttgaaaaatggtgagacagaccccgcagatcccttactttgagaacatgagcctgtgaaattcatctatctttgaatctaattgggctttctcctcccttcggagtacatgaacatcacaccaaaatagattgcctggcaactacattgctaaatcgggggcactaggaacctgtactagggcacgcttgaatagaagagctcccagggtccctactatggtacact

SEQ ID NO: 714139 - DNA, 167 bp, Homo sapiens
ggtgagaatctagggattatgaggctaccaacatgcatccagccagtaacggagccggccctggaaaccggaccttcggaccacaagttgtccgggtgtggctacacccgtcccttttccaactcatacggtcacctgatgggagcaagatgggggtaccgagctcg

SEQ ID NO: 714140 - DNA, 796 bp, Homo sapiens
tgttgttttttttcggttgtttgtttgttttttatcatctgagattctgtaatgtatttgcaaataatggatcaattaatttttttttcgaacgctcataacttgtatctttttaaaacaccatgtccgttggatatacaaaagccacgagtgaccacgtgaccacacaatctatttacgcgttctctgtgtatgacatcctcgatcttcaactgctagcgattcagctaaatcttctgagcttctatgactctgtggaacattccggccactgaatatggcaactctcatatctcgtaccataccagtagctatacttcaccatcctactatacctcagttccatacgaaaactgcttccagctaactgttgaactcaacactacttaattccgatagttcacggaggcctaatttacgattcaaaaagactaatactaactaatactctaactacacatgactcacatgacacacatgtgttcttgagcgtagcgcttcttgcgacagcatcctaggataagaactgcctgctcgcgtacacacaccactctacgctcttagttcacccagacacgcgaggcaacagtcaacattacaactcggatacacaaacatttcaaacaatcatctggttgtctacactccaccccagtggtgcacctccattatataggggacacacaatctctcgtgcgtcctactcttgtactttattgtcgcgagtcgttgtaaactttttcacacactacagtttaaacaacaattaccccaacaagtggtatgaataaataat

SEQ ID NO: 714141 - DNA, 192 bp, Homo sapiens
  misc_feature (39)..(39): n is a, c, g, or t
ctcagaggcacaaggaggtccataggttctccttgaganccatcccaatcggcactgtacaccaccctgtcttgccacccatgcagtgctgtagccccgccatggtctcctggcagctgcttcacctgcctaaggtctatcttccgcttgtggccacagggacccatgaaattatttccatcagtccacact

SEQ ID NO: 714142 - DNA, 1030 bp, Homo sapiens
  misc_feature (12)..(12): n is a, c, g, or t
  misc_feature (72)..(72): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (96)..(96): n is a, c, g, or t
  misc_feature (112)..(112): n is a, c, g, or t
  misc_feature (122)..(122): n is a, c, g, or t
  misc_feature (134)..(134): n is a, c, g, or t
  misc_feature (136)..(136): n is a, c, g, or t
  misc_feature (144)..(144): n is a, c, g, or t
  misc_feature (164)..(164): n is a, c, g, or t
  misc_feature (168)..(168): n is a, c, g, or t
  misc_feature (175)..(175): n is a, c, g, or t
  misc_feature (178)..(178): n is a, c, g, or t
  misc_feature (181)..(182): n is a, c, g, or t
  misc_feature (185)..(186): n is a, c, g, or t
  misc_feature (190)..(190): n is a, c, g, or t
  misc_feature (197)..(197): n is a, c, g, or t
  misc_feature (212)..(212): n is a, c, g, or t
  misc_feature (223)..(223): n is a, c, g, or t
  misc_feature (236)..(236): n is a, c, g, or t
  misc_feature (268)..(268): n is a, c, g, or t
  misc_feature (278)..(278): n is a, c, g, or t
  misc_feature (280)..(280): n is a, c, g, or t
  misc_feature (311)..(311): n is a, c, g, or t
  misc_feature (341)..(341): n is a, c, g, or t
  misc_feature (386)..(386): n is a, c, g, or t
  misc_feature (395)..(395): n is a, c, g, or t
  misc_feature (397)..(397): n is a, c, g, or t
  misc_feature (419)..(420): n is a, c, g, or t
  misc_feature (513)..(513): n is a, c, g, or t
  misc_feature (533)..(533): n is a, c, g, or t
  misc_feature (730)..(731): n is a, c, g, or t
  misc_feature (763)..(763): n is a, c, g, or t
  misc_feature (773)..(773): n is a, c, g, or t
  misc_feature (834)..(834): n is a, c, g, or t
  misc_feature (1000)..(1000): n is a, c, g, or t
ttattattatanataccttcacagacaatactgtaatttttagaggagttccacatcattacatcaacagtntgaatntanaanaaaagcaaaaanaaacaccatagtttanaagtagaaanaacatgcttgangncaacagangttcactaaggatgcacgantganctgagangtnttnnaanntcgncctcgcnctcctcctcctcggnctccccttgtncgtcggccgtggngtcctggtactgctggtactcgggcaccaggncgttcatgtngntctcggcctcggtgaactccatctcgtccangggctcgcccgtgtaccagtgcaggggggncttgcgccggaacatggccgtgaactgctcggagatgcgctttancagctcctngntggccgtgctgttgccgatganngtggccgacatcttcaggccgcggggcgggatgtcgcacacggccgtcttcacgttgttggggatccactccacgaagtagctgctgttcttnttctgcacgttgagcatctnctcgtccacctccttcatggacatgcggccccggaagatggcagccaccgtcagtagcggccgtggcgcgggtcgcaggcggccatcatgttcttggagtcgaacatctgctgggtgagctcgggcaccgtgagcgcccggtactgctggctgccccggctggtcaggggcgcgaccgggcatgaagaagtgcgggnnatgtattgtctcatgttcaccgccagcttgcncaggtctgcnttcagctggtccgggaagcgcacgcaggtggtgaccccgctcatggtggccgacaccaggnggttgaggtccccgtatgtgaggggtggtcagcttcagggtgcggagcagatgtcatacagggcctcgttatcaatggagtaggtttcatctgtgtttttccaccagctggtggaccgagagggtggcgttgtagggctccacaccgtgtctgacacttgggtganggcatgacgctgaatgtgttcatgatgcgg

SEQ ID NO: 714143 - DNA, 152 bp, Homo sapiens
gatgatgagctggtacccaacagctgggtactggcttgtctccgggtgttcggctgcccccactggtccccagaacggacactttcgccctccagtggatactcgagccaaagtggtactcccaccctccctcccagagagcctggaattct

SEQ ID NO: 714144 - DNA, 207 bp, Homo sapiens
ctcgctggagtccagtgttgcgactcctcactgcactctacctcctggttcaaagtcattctctgcctcggctcctgagtagctgggactacaggcgcgtgcaccaagcctggtactttttgtatttttagtagagacggggtttcgccgtattggccaggctgctcttgaactcctgacctcaggtgatcctcctgccttggctcc

SEQ ID NO: 714145 - DNA, 202 bp, Homo sapiens
tgctggaattacaggcttgagccaccgcacccagcctcctgacccttcttataagggcactaattccctcgtgacttagttacctcccaaaggtctcacttccaaataccatcgtactggggaggcttcaacatatgaatttagggggaccaaacattgaacggtagcttgcgggtccgagctcattcgtatctggctagtg

SEQ ID NO: 714146 - DNA, 1390 bp, Homo sapiens
tgttgcagcagtcacattggaaggatagagtggtaggatagaggtcaaggtatcgttgagtttgatagtgagtttgttagtgaaagatgaaggagaagtctgtgggatggtctcgacagagtagttgcagggggtgcgtataagtccagagtctgtgagtcagggagataggcggactaagctagagtgagcggagtgacgattcgggcggcggagcaggacggggcatcgacggtcttgacaagggggatccggcggcacgaatagggggcactgtcagtgacgacggtaatgtggactaaaggtccagaagtggaatatactcgaagtgtgactttatatcaggtaaagttaggaaagcagaggatatatgaataggtacttgtgacatggctatcatgaaaggtgcaaggggtatggcagtaggctatcgatgagagatgacgaatacgatggaatgtgtatgggatggaataatagtccttggataggggatgaaacggagacatgacgagattgacatgaggcggtaacttggcgacgtggatagacaggccggacgaagcaaccggctagatacggatacgctaataagcttggcccaaaacaggacaccgcagacaggcggggtgaactggcaccgcagcaaggttaacacagggtaccgcaccgaaaggggctcaactggaaacgaaggggtaaaccggtgaccgtgggggccgggaaaaagcttgacacgtggtcacaagtgcaaccggcaataccctggtggggcggcaaatgcagaacactaaggcacgcgcaacacaaagatagtgcacggcgagcctcaccggggcttataacgcaacgcatcggaccttggagaggcgtcggacaaacctcgtcgtttacacccgcacgagagaacagcgcactcgggcagggaaaacgacaggacaccccgcagccgacaacttccccgcagtgggctgaaagaataaggcccccgagggtgagagttacacacgagaagacgatacagggggggacaacggtgcacaggcgaaggcgagtacaacccagtagaagaccaacaaaaaagagggacaaccgtccaccaaggtaacagaagaacaccacgatcgcgagccgcggggaacaggagcaacacaacacagggacgttataggtggaggaaaacctgctagtggaaaaggctcgggcaagcagtgaagataaaggtgaggagtgaccagcggagtcacaaagttatagacggacagggttatagatagagcagagcaacatcgtcgacaaagatgagttgttccctcttccttccttttttttctctacttttatcctttgcgatgagtggagaagcagtaaacaaaaagagagaaatagc

SEQ ID NO: 714147 - DNA, 276 bp, Homo sapiens
tacgtagactattgttcaagaactcaacgactggtaacttgtgtaacacttcttcattctcaactgtcagtgagccattcatcaagtcactagcatgatagacaacatgagcgtcttctgtccacgtctcgatattgtattcaatgttaacttgctgaacttgtccgttcgttgtgattgtttgtactggaacataacgcacagccataatcggcttgtagtcaacttccgtgttataaatcatgaaagtgttttcaggggtaggcgtacgatgcg

SEQ ID NO: 714148 - DNA, 887 bp, Homo sapiens
agcggacttccgcctccagcctcttcctcgttcccggctcccagggcccgtcggtcccccgggagccctggaggcgcagccccaccccggccggcgcggctcgctcccactgcccccgccgcggctctcgcgtggagcggacggactgagtcagagggggcgcgcatgcggctgcaggagctgactatggaccctagaatcctcgggccgcccgtggcatgcgccagcagctccgccgttcgggagcagccagaattcttctgaggacattttacagccagatgacagagtttgtctttcctctgtcccgatcgtgctatctcgagtcgcagagacccccgcataggtacgtatctcgagtccatggaacgtgatatgtgcgacacactgtgagcaagtagaacttatggacgctgtggggacccggtgtgcagcaggatgtgttcttgccgttgtcgaaagatccgtcctaaccaatcccgcgcagtcgtcgtggggggtggcacgaagccatgttggtaggatgctgagcctgacggtgccttacatcagacgaggaccacatctaggacctcctcctcctcctcctccgacttcctccagcgacctgcgaataggccaatatccaagtgatgatggagcagatacgcccttggcacagtcggatgaagaggaggaaaggggtgctggaggggcagagcctggagcctgcagctagcagtgggcccctgtctactagagctgacacgctggctattctccactagtgagaccacagggcccagccagagctgtctgggagaagaccagaattctttacttgcaagtagggcaccagaggtgggaaaggatggtgggaatggtgtacctttctaagaattaaccct

SEQ ID NO: 714149 - DNA, 199 bp, Homo sapiens
gtcactctaagatccaatcacggtttctgctattgcatatattgtcattttttctagctcttaggtggagctgagatctgatttgaagctctgttagtgtataacttgcctataagtacaggctgatatccctattaaaatgcttgggaccagacatatttcagattgcggactttttagtacttgcagaatatctact

SEQ ID NO: 714150 - DNA, 477 bp, Homo sapiens
  misc_feature (318)..(318): n is a, c, g, or t
  misc_feature (354)..(354): n is a, c, g, or t
  misc_feature (361)..(361): n is a, c, g, or t
  misc_feature (376)..(376): n is a, c, g, or t
  misc_feature (412)..(412): n is a, c, g, or t
  misc_feature (424)..(424): n is a, c, g, or t
cgaggagctgtagggagattggtttttagtataaattacaataaaattttgtgtatgtgtacagctgtgttcacatccacagtgtaagctgtgatatggtttggatgtttgtcccctccaattctcatgttgaaatgtgatccccagcattggaggtggggcctgatgggaggtgattgggtgatgggggaagttgcctcatgaatgacttggtgccctcctggaagtgatgagtgagttctcgctgagctcactcaagatgtggttgtttaaaagagtgtggcacgtccctcccccaactctccctctcactcccgnctctcaccatgtgacacacctggcttcccccttcgnccttccnaccatgattggaagncttcctgaaggcccttaccagaagcagaatgccagnccccacacttcnctgtaccacctgcagaaccataaaccaaaataaagctcttttctttccccatt

SEQ ID NO: 714151 - DNA, 464 bp, Homo sapiens
ttttccaagttttaatatggtgcttttaagaaaagaccctcctgactcagttgatgattacatgtattcatcttactccatcttctaactgccgatttcaggcgggggattcgaagcctaagagttgtttggataactagtgaaatactaatttgctgaataaacgtatgcataggaaaattgatcctatatttacgcaaaagtcggatactcctgtggctactaaaaacgtttagccctcaatgcctgagaacatggtgaaaggagacttgcaggtctttgcaccttgtgagagggttaaactggacccaataaaattgttatatgcctgctcagcttaatgctatgcgaatgttttccataataccttgggaaatctcacacggatgtactcctgatgccagttataaccattgtgcattgatacgggcttctaggtggttaacgctgagtgagatactagt

SEQ ID NO: 714152 - DNA, 846 bp, Homo sapiens
  misc_feature (846)..(846): n is a, c, g, or t
cggccgcatagctgcccattttatgcgctcataggctcagactggatgccactgctctactgctatggagagctatgcgctctatggttagcataactgactcctatatactaccaagtgatatatatcattggtcgcttcaacctaatatgtagatgcaatgacgggcgtggcgtcaacgcacctatatccatactggtatttttagtagagatggggtttcaccatgttggccaggcttgtcttgagcgggtgatctcatctcaagccacccttcttggcctccgaaagtgctgggattacaggcatgaggcaccgcgccgggccgaacatttaatttttgattgtagaacttgaatatctcttgcagtgacactttggttatcacttgatcagaaaaatactcgtcccagctcagacattacctctatggtaatgaggatgacaatcatccactccaagcggagggccctcttctcattcaggtgattcccgattagatctgttagtttcatgcagtgctgaaagtttcattcatgaacttaactcttccggccatggctaaggaattgacacgttttatcgtaaaggtccttcaggtttttttttgcccaagaaaaatcagggagtatcaggaagtttaactcaagtttatacggggctggagcggtgggtaataaaaaagtccttgcacttagttcagactgtggggaaaaaccatgattgggaaaaatatacggggatgggcttttggcaaaaattcctggatttcccccgggggtttccaggggaagaaaaaaatttggaggtctaggcggtgggcagtgatatagaaaaccggagttn

SEQ ID NO: 714153 - DNA, 256 bp, Homo sapiens
gctgatgatcccaggtttagaccaggaggtgaagatacttgggtaggaggagggcggctgatctctgggttagaccaggtaggtgaagatactcgggtaggaggagggtggctgatctctgggttagaccaggaggtgaagatactggaggaggaggctggctgatgatcccagggttagaccaggaggtgaagatactggagaaggaggctggctgatgatcccagggttagacgaggaggtgaagatactcagg

SEQ ID NO: 714154 - DNA, 394 bp, Homo sapiens
ggcagtgtcatggagccacacacacacagtaaacatatcccgacagggacagacacagacacacagacacacacagacacacacagacacactcagtaaacacatccgaacagggacagacacagacagacatgctcagacacacagacacacacagagagacacacacacacagagacacacacagtaacgtatccgaacagggacagagacactctgtaaagacatacttacaggtacgcatacacacacacattcagacacactgagacacacatagttgacacattccgacagttacagacacatacagagagacacacacagacacactcagtatgcatatcttaacagctacagacacagactgacatgcacagacacacagacacac

SEQ ID NO: 714155 - DNA, 151 bp, Homo sapiens
ctgtgatagaccctgtggcatcttcctaaatgtcaacggatgtcttagcttctagggtaactacgacgctgaacttgaatgcccgcattcaggtaaacgagaaggaacaatggaaggagggtgaaggggtccaattaggtttggaaggttc

SEQ ID NO: 714156 - DNA, 261 bp, Homo sapiens
  misc_feature (72)..(72): n is a, c, g, or t
  misc_feature (110)..(110): n is a, c, g, or t
  misc_feature (117)..(117): n is a, c, g, or t
  misc_feature (135)..(135): n is a, c, g, or t
  misc_feature (197)..(197): n is a, c, g, or t
  misc_feature (226)..(226): n is a, c, g, or t
atcagagagaaggaatccaccttcttacgctatggcaggtaagaaagtactcattgtctatgcacaccaggnacccaagtctttcaacggatccttgaagaatgtggctntagatgnactgagcaggcagggctncaccgtcacagtgtctgatttgtatgccatgaactttgagccgagggccacagacaaagatntcactggtactctttctaatccctgaggntttcaattatggagtggaaacccacgaagcctaca

SEQ ID NO: 714157 - DNA, 438 bp, Homo sapiens
gagtggtctcacaaaactaagtatactgtcaccgtaagatccagataattgtcttggcatttaaccaaaggcatggaaaactgaggtcaacacaaaaatctatacattgatgtttataggagttttattcataattgcccaaaggtggaagcaacttcagtaagtgaatgaataaacaaactctggtacactcatacaatagaatgttattaagtgataaaaaggtacacactatttaactatgagaagacatgggaaaaaaaaaaccttaaatgcccatcgctaagtgaaagaagccgatctgaaaagactacatactgtgtaagccgaactatatgacattctttaaaaggcagaatgatgaagacaatgaaaagtacagttgttgccagagattggcggggagaaggagggatcaataggtggagcacaggggat

SEQ ID NO: 714158 - DNA, 961 bp, Homo sapiens
aatacaagccctgcggccgaggatctgtagatgctatggatatattaacgtcaggaatacaggagcctggttccatccattgagaattagatcccatctactgaatggtcgtaatgcccgtaacatagaaccatggcaaacttgtccaaaactcaacgcggatgttttcctatctgcgtaggctagaatatgaaacttctttgttggatcaaagctactatgtaaatcatcgtaggtcatgatgtaccttattaccccatcccacagcagggtcgtggtaacacgtcgatcagccagacgccgtacagtggagagacacccttgaatcactttagatcggggtctgttagtcgtactagtattgttttcactagttaacgcgctggatagtaagggcaggtatcttctaaagtgctctcttctcgtagacgctctttcagataagggttgaaactagttcgttcgcgagctggagatcacatatacgaacgcccatgctaagcactagttgagacgtcgaggccctctctcgagtgaagacccttgttctgcaacacataggctctcatgttcactccgagcgggacctgttaatccggaatcccccctctagtcgattctatctgggcctaggtggctataagcacacgaagactgcgaagaggttggggatgtatactctccacgcgcaagcacaagcacctgtgtcattcagtgatccttaagtgagcggagtactttgactaaatacgcgtgttggcgtcattggttactatgtacgctcgtggatcttgctcatttaagtaagcaccaatgggacaatctgattgaaacgttcaaaagtgggagtgcgagatacctttaagtcggccggttggaagattgagttccattgtagcatggtcctatcaagaagtgcttggtagcgaaccgtagtgggccatttccataattttagcgg

SEQ ID NO: 714159 - DNA, 685 bp, Homo sapiens
tcaaagtgaaaaagacgctgttttggatttacaatgaacaaaatttacaaaagggggtgggggggtctgggaactgtcccagtcccccgcggacgggggggggctctagggcagccgtgtctgacagaccaggaccccaggattgtttgggccccgacgataggatttgacctacgtctcacttgtgaccttgtgacgtggggcccagcagccgtgagtccaccacagaggtgccggacaccctgggggaggccggtgaggtcaggaaggacatcgataccgcttttctccctcctcccatctcggtggtgagacagacagaaccataggatctggggaactggcccggggggccacaggccctcagatcccccaggggcccaacctagggcatgggaggaggctagctgggtgcagtgggcggaggcggaggccagttgccccacagtgtggaagcgtaaggcacattttcaaaatcacctcgagaaccccgacaggtgaacaccccgagtgcgtggctacgtgacggccggagggagcgggggcgggggcgtggcagcatggacagcggatgcccagcaggaatatggcctcagaaggaagcatgatacgagcctaaacgcaggggcgggtacaggcgtgcaccccactccggattgaggcagcgtccacgggaaaagaaggg

SEQ ID NO: 714160 - DNA, 1246 bp, Homo sapiens
  misc_feature (400)..(400): n is a, c, g, or t
  misc_feature (463)..(463): n is a, c, g, or t
  misc_feature (760)..(760): n is a, c, g, or t
  misc_feature (772)..(772): n is a, c, g, or t
  misc_feature (790)..(790): n is a, c, g, or t
ggggttttcccgtcgccagggtcccctcgggggacccgggctctttgggcggtggcccttgccggattttttttgccgcaccgaaaggcgccgtgtgtgccgttgtctataaaggggccgaccgggccaccaaattcccacgcggcaatctaatcccaatatttcgcagccaacaaaggggaaacgttaaatggggagccaagcgtggaaaggtttgtgggggaaaacccaacttaaagaggaaccgtgaaccttggagagcgtcctcgccactgggagactcctccacaggttccatagagatttttgggagaaataaaatacacccgcacagggctgtgtacccacacgtggcacagggtgctccctcacccgcggggagaagtcccgtcgttactcnccccgagaaaaacccccccggggtggggcccacaaaaggagatgaaagagagagcgcacattntttggagagagcatttggcgccaaaatgtgaactcggctgacccacaaagaatgggtgttgggcccgcaatgtgggttctaattgagaagaatttctcgttggaattctccacactttctctcacgcgaggacccccacttggcactctcactttggcccgccaccacactcgggtggtgccccactgaggaaaaagccccacgcaatgagacttgtggcccacacaagggtgtgagaaatatgtagaagagataagttaccacacaagaccacgcggatacacgcctgtgagaagnttcgctttgtgngctttgtgggtgttatantttgggagattcgcgccgcacacatatagacccctttccctctggagatgtaagttctcgagagggcccctcctataactccacttctcgttattctctcggctaagcctcgtatagagaaattgtattcctcgagtataaccacttataaccacctcgtatattcttataaaagggtataattgtgtgacctttttcaagagttgcctttataaagtaccctgtagtgaggaaactgagatttatgagtccccttggagaagaatttgtaataagttttaataaaacctccacgtttaaaatgtcctgtttccaatgaccctgtaattttgcccagacttaaatccccagatgggtattaaacttgtccagaatttctttgtcaattcaagccctgtgaataaaaacccctgtatggccccttattatgaggctatttaaagaatcccaattcca

SEQ ID NO: 714161 - DNA, 166 bp, Homo sapiens
tagtgacaccccagaagtgctctgacccccaatcctcaaaatgaatgatactgacaccagctttgccctcccctgtcacctgcgcacccaccctgaccactccctcagctgtcctgtgcccctgccctctcctctgcatagccgtgtacatgcaatggggtaccga

SEQ ID NO: 714162 - DNA, 202 bp, Homo sapiens
agcctgtccatgagctcaatagggaagcctgtgatgactacggactttgcgaacgctacgccatggttcatggatacaatgctgcctataatcgctacttcaggaaacgccgaggggccaaatgagactgagggaagaaaaaaaatctcttttttttctggaagctggcacctgattttgtatcccctcctctctgcgtttg

SEQ ID NO: 714163 - DNA, 198 bp, Homo sapiens
atcggcttttacctgcttggtgcccgtggatgcgaggccgagggcggtgtaggcgcgctggtggatggtgttgagggcctcgccgccggagaggacgtagatcttgaagcgctcttcggtgccgcgggcgaggtggacgaagtcgcgcactttgcgcttggtggggacgtcggtgacgaggccgtgcatcgtctccgg

SEQ ID NO: 714164 - DNA, 1011 bp, Homo sapiens
cgcagtggctcacgcctgtaatcccagcactttgggaggctgaggcgggaggatcacctgaggtcaggaattcaagaccagcctggccaacatggcgaaactctgtctctactaaaaacacaaaacttagctgggcctggtggcaggcacctgtaatcccagctactcggaaggctgaagcataagaatcacttgaacgcgggatgcggaggttgcagtgagccgagatcacgccactgcactccagcctggatgacacgagcaagactctgtttcaaacaaacaaaaaaaaattcaaattagaacaaatggcacaaaagaccattcaacagacattttactgaatacacatatacagatggcgactaagcacaagcaatacggcacaacgaacaacgtgtccaacttcatccactattcagagaagcaccaattaaaatccacaatgaaggcccagtactttgcggaggctgaggccagtagatcgcctgacgtcacggagttcaagaccagcctggacccagccctgggcaacacaggcgaaacccaactctactaaaaaacacagaaattagcccgggcatggttggtgcccactttgttaatccacagcttactaacggggacgcctgagggcccgcagccacacagctgaacacgcgcggagggccagaacgcttggcacgggacgccacagacttgtgccactgaactcccagcctgggccaccaggcactgagctcccggaccacgagcacgaccaacgtgcagaagcagcagaccagactgtgctgctgcgcgccctccgccccccgtggtcagagcgcctgtcagcaggaccaccactaagcttagtgggggaccgcggggcaccaccagtgagggctggcagctgcaacaatgaggaccagcagggatcgcacctcagagcaccccttggcgagccaacaacacgcgggggtggactcccacctacgcaaataaacacccccaccgggtgtaaccaggcgg

SEQ ID NO: 714165 - DNA, 319 bp, Homo sapiens
tgatctagaggatccctcataggttcgcaggctggggaaggaatgcttcccaggggtaggcctgtagacgaccactctgggattgtctgtcttatgcagttgagataagggatgaaatacaccctgttctcctgcagtgtcctcaggcttactaggattgggaaattccagcctggtgaactctagtcagaccggttgtctgctctccaacccagtttccttttaagatgtttatcaagacaatacgtgcccagagggacatggaccctcatcagtaattctaatttcacccttgccttgtgatcctgcgaacctatga

SEQ ID NO: 714166 - DNA, 135 bp, Homo sapiens
tgggtgcaccaagcaggcgatgaattagatctaatagttacctggtctacagaaagaagatgccagatgacacttaagacctacttgttatatttaacatatgcaataaaagacctattgatttggaaaaaaaaa

SEQ ID NO: 714167 - DNA, 308 bp, Homo sapiens
tataataacatgcttgctatcagaggaagtgaagaatgtgccttcctgaatgacaatggagtcaccaggggcagaatctacatgaccagaaaatggatttgtagcaagccaaacaattaggttacaagttgccagtaaggtcccccttggaaactacctaagaaaagtggtaaaaaaaggcccccattcttcaaaattcaaaaagggggaattatcagcagcttcccccatgcccctggaaaaactgcaagtaacagacctgcacatgtatcccctacatttaaaataaaagttggaaaaaaaaaaaa

SEQ ID NO: 714168 - DNA, 295 bp, Homo sapiens
  misc_feature (208)..(208): n is a, c, g, or t
  misc_feature (210)..(210): n is a, c, g, or t
  misc_feature (213)..(213): n is a, c, g, or t
  misc_feature (217)..(217): n is a, c, g, or t
  misc_feature (232)..(232): n is a, c, g, or t
  misc_feature (238)..(238): n is a, c, g, or t
  misc_feature (252)..(252): n is a, c, g, or t
  misc_feature (258)..(258): n is a, c, g, or t
actatggtcttactggaaactttttttcaaaaaaagcacaaattaaagtaggaaattcatatccatagatagttcattcattcaacaaatatttaccaagttcctaatataagtgaaggaccacttctcatattagattactaagtcatttgtatgaatatgtgtggcagtgaagagaacaggtctttcaaaaagcatttgattatcntnatntttnttaaatacactctcntatttntctacttgtttttntgttantcatagcaggatatgacaactcttatttgaattgatt

SEQ ID NO: 714169 - DNA, 711 bp, Homo sapiens
  misc_feature (308)..(308): n is a, c, g, or t
gcaggacatctgtggtacatgcagggacagatacaaacggagatatctttgttgcatggagcgtgtgcgcactgactcgtgtggtgatcgcgtagtaacatcggaacagtgtatgagcgctggtggtacgagaagctcatcagcatgacctagtgtcccatgacgagaggtgttgtgcttgtggcgtcagaacatggcttctgcaggacccagtctcaactaagttctatactaaaaagtgtcgggagctgtactacatgtgctgcacaggacagcatggcagcgcgctgccgcccgacagcaagagnagtcaaacccgggacctgcagattggcgtggcgagttccctgtgcacggacctgaacgactggtgatgggttggacctgctcgcaggtgaccctgggaagggatcaacctctaattcatgcagcaatcaggtttgcgataggatgcgtgagtcagcagttgacaacaagtgcgactaccatgtatcggacggcgtcgtttcgtcctgcggaggaattaatgttaccatggaatttcaaggaggtggtgagccacgacatgtagcacaggacatcgcgagatgggcactagggaaatctgctactccgtattatgtctcttcgtcgtacgtggcgtgcagttcatagcagtgaggaagatctcagaaccccgtcccgggtctgtctctagctgatggagagggg

SEQ ID NO: 714170 - DNA, 334 bp, Homo sapiens
  misc_feature (137)..(137): n is a, c, g, or t
gacaggctgtctggatactgtccataaaaataaaatgtgatcggctgggcacggtggctcacaactgtaatcccagctctctgggaggcccaggcgggtggatcacgaagtcaggagtttgagaccagcctgacaancatggtgaaaccctgtctctactaaaaaaaaaaaaaaaaattagccgggtgtagtggcacgtgcctgtaatcctagctactcgggaggctgaggcagaagaattgcttgaatccgggaggaggagattgcagtgagccgagattgcaccacggcactccaacctgggcgacagagtgagactccatctcaaaaaata

SEQ ID NO: 714171 - DNA, 593 bp, Homo sapiens
  misc_feature (25)..(25): n is a, c, g, or t
ttttttttttaaaaaaaaaaattancgcccgggaacttccacttaataggggaattttggccctgaaggccaaagaattcggcacgagggcaaaattagtgctcccaaagtggataacttttgactatggaattgttagaaaacaagaaactttaaggtttatatattgtataaacatacccagtatgtgcatccgatcgcgagaacgttggcgtcttttaggaaactccgcgcacgcactttatcagccgctgctgcggtggtggctccaggagaaactcaactgccaattgcagaccagttttttttttttaaacacagccacttataattcttaagctctttgcaaatgtttgtttaaaaaatgaaaaattaaaaaaaatctagtagtgtcaaacgcatttggtcaattttattttgctttgttaatattagaaaacttatttattattgtttgctaccatttctacttatcttgattcattttttacgttttctactcgagatcattttattttaatttagcaaagccaactgcccttgtttaatgtattttgttttgcaaatgattaaaataaacgtgaaaaggggga

SEQ ID NO: 714172 - DNA, 392 bp, Homo sapiens
  misc_feature (54)..(54): n is a, c, g, or t
gtaactctgatatagtacgtctactcatgtataatagcatgggatagctaactnttaaaaattatgatttctcctgttaagattacagaaactcatataaatcaggccttttgacattttaaattgtatctttactagacatgagatctttttccttggagctgaattataatgtgggtttggcggtttcagcagcaccagttgactgctcgtgtgccagcggtgtggggaggacggggcaggacgctgcagctctctccagccctgttgggatactcagtgcctgcaggactctcgctgcctgttgggctgtctggggggtgcgcatttagggatcgtggggacggggtccaccccaagaagaagaaaggccgtcacaggccggtctgggc

SEQ ID NO: 714173 - DNA, 265 bp, Homo sapiens
ctcggctcaccgcaacctctgcctcccgggttcaagcgatcctcctgcctcagtctcccaagtagctgggattacaggtgtgcaccaccacgcctgactaattttgtatttttagtagagacagggtttcaccatgttagtcaggctggtctcgaactcctgacctcaggtgatccacccgcgttggcctcccaacgtgctgggattataggcgtgacaacccacggcccgcctaaaatccatattcaaagaagcaatttcagtt

SEQ ID NO: 714174 - DNA, 870 bp, Homo sapiens
atggatccagctgtgtgcatggatcaggtctcatgatagcaaagcagagaaagaagggagatgacgagggaggggtccctggaagaatcaggcagtggctatttcctgcaacagctcccttctcctctccttccctgctatgcctctcatttttctaatttgttaattctggataataatatcacataagagtgttgtgaacattgccgacagaatatatgggaaaccattttctccactgtaaagctctgtgtaattatgtaattatgagccattcattcctctctctgactatattgcttgtggctctattttgtacacttgaaactctatcttctattttgtgtgtgtttcatcttttttttttcctgcacttgtgcctcaccatccacccactgcccatgtctattggaagctcctgggcagcaggggttatttctgaaattctcttcctttgccccaagagctggcaaaatacgggtgagcatttaataaacattcattggactgaatgaagttgaaatggtttctgtagcttgcagctccaacactctccaggactcaagagtggcttgatgcagattttaccataaatggtgctgcaccgtctccccagcgccccccagccgggcgtctggaacttcaaagatgctctgtgtctgttaaagggaacacactgcgtcttggattggcgttcacatttatacctcttctgtcctcttgccagtctctaaggatgggctttcaaaaaaaaaaaatccgaggttattccttggcggaaaaagggttataattggcatggcatgttttccgaccatttctgtcaaaggggaaatcggccctagagcggttattgaacagacaataaga

SEQ ID NO: 714175 - DNA, 266 bp, Homo sapiens
actagagttcccaagtatcagcagagaccgagaagataagagaagagaagagaagagaagagaagagaagagaagagaagagaagagaaaagaaaagaaaagaaaagaaaagaaaagaaaagattgtttccatgcctgctaacacaacatccattcttcagcccatgagtcaaggagtaattttaactttcaagtcttattatttaaaaaatatatttcttaagactatagctgccataaataatgacttctctgctggatacctt

SEQ ID NO: 714176 - DNA, 1507 bp, Homo sapiens
aggtgcaagaaggcttataaagactccagcaaagctccagtctcttaattatgtcacctcagggtgatgcggtcgagttatgaaactttgggaaaagagagaacaaggaacgcgggcgatcagaggcccagccgcgagacctgccccgctggggcctccagccggcaccgcgacgccccgggacctggcaccgcctcgctccacccctgcgaatccggggcgaatccgggcggagagttcctgccggccgcgcagcgcagagccccctccggcccgccctctctccctccctcccgctgagctccagctgtgccagaggcacccgagccctgagagtccgccgccaacgcgcaggtgctagcggccccttcgccctgcaggagagaatatcctttgaacctacgtggaagcctacaagaaggggaattctgggcaatgtggttcagcccagccacatcacatactattatttagtagtcatgaagagagagacatagacagtgaagagtaagtgaagaatttgagggtcatcagccattgtgaactcatcaaaatattcccactctgccactgcccaaaggggctcttatctgaggaatactgctgacttcgtgtacctagttttacagagccatctttctgaagcataaattagattacattattctacagcttaaatccctccatgaacttcccatcacccaagagtggatctgaaactccttagagtgtcattcaagacccttctgtatgtggctgccatgcatttttttcaactttatttccagccttgcaatgtacatacatccatctctgtcccacgccctctgcagggctttttggttccagaacgtgccatgtgcttttctcctttggagctctttgaataggatgcccttcctcccttgtctgcctgtagatagaaacatcctgtgcattggtgagttggccctgaccaccattttcttagcatgctgaattacttctgttcccctctgtgtttgcacagctttgtttgtgcacagtagacttttggctgggccatgtagactgcctcctccatgagtttgccagctttttgaggacaatgtctgttttattcatcctcgaattctcagtgcctagcagagtgcatagcacagggtagttatgcaatacatattggagtaaaggaatacaattcaaaaaaacagtctcattaacagatgcaaaccaactcctctcatgacgcagagaatctaagctcaaacaaattaccagagttggcagttgaagtactatatatagacagaacttaataaatgcttttctttgtcttaagcctttgatgacagtgatgtgtttttatgaacgtagataaccacaagcagatgtgtcaaagctcttttgtccaggaataaactgagtttcgtcatcatcttgacagtactttcctggatgagtgttcaggaaacatgaaaagtttttaaacaattcaacaaatgtgtaataaaagtttgttatcttg

SEQ ID NO: 714177 - DNA, 159 bp, Homo sapiens
  misc_feature (111)..(111): n is a, c, g, or t
ctggctggggaatgagggttgtgaacgctgagcattgaggaccatatttaaatgaggactataaaatgatggaccatgctgatggatctatatgaacatgtgtggggatcnctctacgatgtcgaccgtgcagtgcattgcaatgcttgtgcacgtggc

SEQ ID NO: 714178 - DNA, 365 bp, Homo sapiens
gagtccttgatgctctatcacagcttatctcgagaagctgacgcatggaggatcgtctgaacccgggaggcggaaattgcaatgagccgagatcaagccactgcactccatcctgggcaacaagagtgaaaattaggtgtcaaaaaaaaaaaaaaaaaaaaaaaaatttatagagggttgtggaattattccatcctttatccttttttctggaataaggctttataacctttttgatgccttttattatagtttccttttcagataaaaaaatttttttggagcccaccgcgccccgtgccgtgttttacccttttggaagagacgtgcctgccagttctgttttcccaaaaacagcttgcaca

SEQ ID NO: 714179 - DNA, 206 bp, Homo sapiens
ccccctcccccttttttttaccccctttgaaagccccggggcccttcccccccccgttttttcccttgggcccggggcggtttactttttcccccggggaaccgcttttcccctttgccctttccaaaaagcttttttgtgcgcccttttgagggtccccccccgggtcccgttccgggtttcccgggtctcccccccccttctga

SEQ ID NO: 714180 - DNA, 964 bp, Homo sapiens
ggtcctttgcatctggacgtgtacgcagtcgttgttccgcgatgctgcctctgctgctgtctgagtgcgcccgtgtgctgaggctcctcgcgtcggccgagcctccgagctggcgcgtagtccgcactctgcctttccggacaaggtgcctgcagaacggtaggacccgcgggttggttgcaccctggacccttctgtggctcgctcagtagtagctgcgcagtggttcctgagcggggagctggaacctccatgcggaccttcgtcgtggacccacgtgtcgtccatgtgggacatggtgagtcgtggcagagggtcgccgtagtaggactcgtacaggatgaaccaaaaggcttgtgtagtccagagtgtattcctggaggtgaatagtaagatgtaaagagcaggatagagacaaatatattccagatagggcattaatagaacactcaccctgaagcagtgtctgggagggtcaggcgagactggaaagtggaaatggggacagagatgcgaagattgatggtgcggaagagtgagacagtggggatgaagagaattcatgagtcgcttttcaatccattatagaaagagtcatcgaagcaagattagatggtgaggaaggaaaccttcgataggggtgaaggttgaaagagcagggagcgatgaacgtgacctgtccactcccaacttacgtgatcgacagttgtacaacagtgatgatggcaaaagggccgtgtggttggactgtcatcatccatcaggctgagcgtggccagaaacaacgctgaatgactctctctagcgggaactacctctagcccgggtcgacctaagcgacacacatatacccgacgagcacggaggcaataacacaaggtccccgcgaggaagcatcaccgcgggcgaaaccacgaaatatcacgtagcatgcttcgctggagtcatacatattaagggggaa

SEQ ID NO: 714181 - DNA, 1302 bp, Homo sapiens
  misc_feature (996)..(996): n is a, c, g, or t
cgctctagagatccccgtggccacgcaccgacagatattcccactctgccactgcccaaaggggctcttatctgaggaatactgctgacttcgtgtacctagttttacagagccatctttctgaagcataaattagattacattattctacagcttaaatccctccatgaacttcccatcacccaagagtggatctgaaactccttagagtgtcattcaagacccttctgtatgtggctgccatgcatttttttcaactttatttccagccttgcaatgtacatacatccatctctgtcccacgccctctgcagggctttttggttccagaacgtgccatgtgcttttctcctttggagctctttgaataggatgcccttcctcccttgtctgcctgtagatagaaacatcctgtgcattggtgagttggccctgaccaccattttcttagcatgctgaattacttctgttcccctctgtgtttgcacagctttgtttgtgcacagtagacttttggctgggccatgtagactgcctcctccatgagtttgccagctttttgaggacaatgtctgttttattcatcctcgaattctcagtgcctagcagagtgcatagcacagggtagttatgcaatacatattggagtaaaggaatacaattcaaaaaaacagtctcattaacagatgcaaaccaactcctctcatgacgcagagaatctaagctcaaacaaattaccagagttggcagttgaagtactatatatagacagaacttaataaatgcttttctttgtcttaagcctttgatgacagtgatgtgtttttatgaacgtagataaccacaagcagatgtgtcaaagctcttttgtccaggaataaactgagtttcgtcatcatcttgacagtactttcctggatgagtgttcaggaaacatgaaaagtttttaaacaattcaacaaatgtgtaataaaagtttgttatcttgttttattngttgttatattgtctcttggcttgagtttttatttgggaagctaatagagagacgggatattagaaaaccagaggcaaactgcttggtttattgaagcactaactgaatgaatgcaggtatacgagtaatccaggaatcccatgcattaaggaaaaatttatttctatcacctctgtattgttgttaccttgtgaacctggcttggttttttcagcagttggtaaactgataagcctgtttctcactctgtcattcatctcatcagtttaccagcccagaaatactcctttcagtctttacaaaaa

SEQ ID NO: 714182 - DNA, 1648 bp, Homo sapiens
  misc_feature (1342)..(1342): n is a, c, g, or t
aggtgcaagaaggcttataaagactccagcaaagctccagtctcttaattatgtcacctcagggtgatgcggtcgagttatgaaactttgggaaaagagagaacaaggaacgcgggcgatcagaggcccagccgcgagacctgccccgctggggcctccagccggcaccgcgacgccccgggacctggcaccgcctcgctccacccctgcgaatccggggcgaatccgggcggagagttcctgccggccgcgcagcgcagagccccctccggcccgccctctctccctccctcccgctgagctccagctgtgccagaggcacccgagccctgagagtccgccgccaacgcgcaggtgctagcggccccttcgccctgcagatattcccactctgccactgcccaaaggggctcttatctgaggaatactgctgacttcgtgtacctagttttacagagccatctttctgaagcataaattagattacattattctacagcttaaatccctccatgaacttcccatcacccaagagtggatctgaaactccttagagtgtcattcaagacccttctgtatgtggctgccatgcatttttttcaactttatttccagccttgcaatgtacatacatccatctctgtcccacgccctctgcagggctttttggttccagaacgtgccatgtgcttttctcctttggagctctttgaataggatgcccttcctcccttgtctgcctgtagatagaaacatcctgtgcattggtgagttggccctgaccaccattttcttagcatgctgaattacttctgttcccctctgtgtttgcacagctttgtttgtgcacagtagacttttggctgggccatgtagactgcctcctccatgagtttgccagctttttgaggacaatgtctgttttattcatcctcgaattctcagtgcctagcagagtgcatagcacagggtagttatgcaatacatattggagtaaaggaatacaattcaaaaaaacagtctcattaacagatgcaaaccaactcctctcatgacgcagagaatctaagctcaaacaaattaccagagttggcagttgaagtactatatatagacagaacttaataaatgcttttctttgtcttaagcctttgatgacagtgatgtgtttttatgaacgtagataaccacaagcagatgtgtcaaagctcttttgtccaggaataaactgagtttcgtcatcatcttgacagtactttcctggatgagtgttcaggaaacatgaaaagtttttaaacaattcaacaaatgtgtaataaaagtttgttatcttgttttattngttgttatattgtctcttggcttgagtttttatttgggaagctaatagagagacgggatattagaaaaccagaggcaaactgcttggtttattgaagcactaactgaatgaatgcaggtatacgagtaatccaggaatcccatgcattaaggaaaaatttatttctatcacctctgtattgttgttaccttgtgaacctggcttggttttttcagcagttggtaaactgataagcctgtttctcactctgtcattcatctcatcagtttaccagcccagaaatactcctttcagtctttacaaaaa

SEQ ID NO: 714183 - DNA, 439 bp, Homo sapiens
acctcaaagggtaccgccttttttttgccgcatccatttttgtttaagccttccactgttagggatttggggttacctgatatgctttatgctcataactgatgtggctggggaattggttttgaattttttgcctccgccgaaccgaaaatgtggtgtattttatgcatgtcaataaaggaatggccttttcttgttttaccgggaatggaaattggaagtcaaaccccctttgttttccaaaattgggtttcaaaccttttgtaattttcatttaaattgttagggggcttggggcttttagttaatttatcttccaataccctgtttaattttgcactgaataaatggtgcaagttgtcaatgggtgggtgatcaactaatagctctggttgtaattggtttatttttcttcaataaagttgccttaacccatgga

SEQ ID NO: 714184 - DNA, 170 bp, Homo sapiens
tgacgtctgggcacaattgagccaacttccgtcgtgaatctttataatgattgactgtggtgtatagtgcagtaaacaaatagtgctcgtagttaagtatgtgtcagcatccttttgtctctaacttgtttatattttgacagccacacaattcttggcatgtattaaga

SEQ ID NO: 714185 - DNA, 142 bp, Homo sapiens
tggggctagagggggcactacagtgctatgaaatgtggtgacaagaggggctgagaggggttggggtcctgaatgatcagctgccagcttgcgtggattgagcggctcagacagctgttgtggacggtgtgggggcagtgga

SEQ ID NO: 714186 - DNA, 643 bp, Homo sapiens
  misc_feature (519)..(519): n is a, c, g, or t
cgccaagagctcaggtcgccgtctcgccgtaatagctgtagaagaacgggatcaggccatcgaagatgccggtctcaaaccaggacggaccgaaacgccgacgatgtcccagacctgcaggtccccttcgaccatgccgatgaagtccaccaagggcaggcatactccaaagggatacagccccaccagcgattcgagctggttatgcgcctcagcctcgaactggccgctgatcagattcagtgcatagctgtcctgacgccccaaggcatgggcgacaaaactaaaaacgattcttttcggcccgagcttgcacccgttgtagtgagacatcgccaacaccttgcgtccggtgataaacaacatcaggcttttcgccaggcgttgcagctcggcttgcgcacgtcgcagcaactcttcatacgcctcggcgtcctgcacgtccgggcgtaccgatgcgaccacctcgacggtcttgcgggcatcgatgaactggtccagctcctccattagcaagtngtgctgcaccttatccacctgaacccagtcgataaccgcctgcggcctgggatcagggtccagggcaacggctcgcctggcacaggccgacatactgggtcaggctgagctgattgccagcgct

SEQ ID NO: 714187 - DNA, 419 bp, Homo sapiens
  misc_feature (26)..(26): n is a, c, g, or t
  misc_feature (128)..(128): n is a, c, g, or t
  misc_feature (159)..(160): n is a, c, g, or t
  misc_feature (191)..(191): n is a, c, g, or t
  misc_feature (202)..(202): n is a, c, g, or t
  misc_feature (232)..(232): n is a, c, g, or t
  misc_feature (322)..(322): n is a, c, g, or t
  misc_feature (354)..(354): n is a, c, g, or t
aaatgggaatgctcccatgaatcccnggccctggtcagggaaatggtgggacttgttccctttgaggcaaagctccagaggaaagcagggctgcttcttgttcatcccaaggcattcattctttcctnagtcctcagaggaaaaattatatgctgtgannaggtgcggtggctcatgcctgtaatcccaanactttgggaancccaggattgctggagcccaagagttcaanaccggtatggtcaacatagggagaccctgtctctgcaataaaagaaaaaaattagcctggtgtggtggcacatgcctgtggtctcagctncctgggaggctaaggtgagaggattgcttaancccgggagattgaggctgcagtgagctgtgatcacaccactgcactccagcctgagtgacagagc

SEQ ID NO: 714188 - DNA, 860 bp, Homo sapiens
ctaaaaaaaaaaaaaattttttttttttaaaagataagggtatggctatgtggcccaggctggtctgaaactccgggtctcaagcaatcctccgggcctcagcctcccaaagtgtgggggttgcacgcatgagccatcaggctcagcctcggtcatctttctacatggaggtttgggtttgggtttcttcatatgggtaaaatctcgtgaggacttatcttcaagctttacggagtccaaatcaaatccacgggtgggaggccatctcagtgaattttccatttaaggtaatgggggcttcttcactgggattccattggggtgcctttcaacatatgggctactttcataaatcaccattattataccttccttaaattttaaaacaggcttttcttaagtccttggaagatacttcaaatagtcatttggaacgtcttgggctactatgccaaagatagggggcccttcaaagataatttctattaccgtggcttttttctccgtgtgaagtgccaactttccgtgatgctgtgacgtggtctggactttaccatttcggagagactcttcgatgatttcttggggcacgccagggacggattctggctttgggggccacctgttgtggtgtggggctgggggaagacgggggcgaaaactggttcacctccccacagggcaccaaggtggggggggagccacaaggagctcaacccacggggggggggggagggaaaaacaccccagagggggcgcgtgcggtgttacacagaagaagtaggttgctctgtttttcacattaaaccacatccaacacacagcaacaacacccacccacaacgagacaaccagccgtg

SEQ ID NO: 714189 - DNA, 287 bp, Homo sapiens
gttatccccgtatcagtgagttcacctctaaatcaccatcagatcaaaaggcgacaagcatcaagcacgcagcaatgccagctcaaaaacggcttagcctagacacaacccccaacggggaaaaacagcagttggattaacctttagcaataacgaaagtttaactaagctatactaaccccaggtttggtcaatttacgtgccagccaccgcggtcacacgattaacccaagtcaatagaatgccggcgtaaagagtgttctagatcaccccctccctaagaccta

SEQ ID NO: 714190 - DNA, 240 bp, Homo sapiens
  misc_feature (68)..(68): n is a, c, g, or t
aatcgacagtgcagacagaaaaagatttgaagagacgggtcaggaactagcggaattactggaggtgntaaactaagttgtgtgccagtgctcatctttgctataagcaggatttgctcacagcagcccctcctctgtattgcagagggactaacctcataccatccgcgacctagtctgcagatccagtcttctcagctctcacaggagagggcgttcaggatggcatgtactgggtct

SEQ ID NO: 714191 - DNA, 129 bp, Homo sapiens
tgaggggatgggggaagggaagaaatgaggggaggaaatgcatggtttatagaatcaggtctctaaaggagtcaaagctgtttccttcccccgaggagctgtctctcaggggccggggctttttgcagg

SEQ ID NO: 714192 - DNA, 212 bp, Homo sapiens
tttccgtttccccaccaaactcacaaagggagattaaacccttccaggatggccatcaagcttcccgagagggccaggcccaagaaagaatcatctctcaacaggttaagaaagggcggccattcttaggctcgggggtggaagcagcagcattcccaggacccaggggccagagagaggaaaagaaaggacggtagggagacagcatatca

SEQ ID NO: 714193 - DNA, 273 bp, Homo sapiens
cgggtttttaaaaaaaagggggggaaacccctcccgggggggtggccccaaggtaagttttttttaaggggggggcccgggtttccccccaagggtttttttttttccccctgctttttcgggggggggggggggaaatggcaatttaaaagggcggcccccaaggttttttattttcccttttttgcgggccgggggggatttttaccccttttaaggccaattttggggatggtttttttttggggggtttaattaacccggtttttggga

SEQ ID NO: 714194 - DNA, 418 bp, Homo sapiens
  misc_feature (166)..(166): n is a, c, g, or t
  misc_feature (193)..(193): n is a, c, g, or t
  misc_feature (345)..(345): n is a, c, g, or t
  misc_feature (355)..(355): n is a, c, g, or t
gttgaactggggggggggggtcagcggggaggggtggggcggggagtggccgtggggcgggttgggagggatggcggtcgggtctgggggggctgggccgaggggagttacggcggggtgggggtctggggaggttgggggatggggttcacggcttgattggctntgggggaggggtgggggggggggcggncgttggggaggtcgggaggactaggctacagcgggggggctgcggactgtgggcgggcttttatccgctcgggatattaggcagggcccaagggggggggcgggcccaccacattaacagcataaaaccctcattcacggggggagacaccntgggggtganacacctatcccccatcttcctcctatccctcaaccccggcatcattgccggttttgcctttta

SEQ ID NO: 714195 - DNA, 359 bp, Homo sapiens
cattcgggaaacagctatacgttgctgagtgggaaacactttgggcgttttttctatcacagcaaaccaggtttatgttttgtgatggagaaacacgccgggactctttctaagcagaaaaccgactatgattcgagtggacgtgaaacctcctcccagtgtttacggaggaaaaacacaaaagtcgacgacactctagaactggagagaggtccagattgcgacaggagccacaccagagtgtgcaggcttcatggaggacagaagcgaggttttgtgccgggacttacaaagataaggaggccaggtgtggtggctaatgcctgcaatcccatcactgtagaaggcagaggccggca

SEQ ID NO: 714196 - DNA, 276 bp, Homo sapiens
cagggtggtgtgaagtggtgcaatcatagctcactgtggcctcaaactactgggctcaagctattctcctgccttagctgagactacatgtgcacactaccatgcctggctaattttaaaactttttgtagagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctc

SEQ ID NO: 714197 - DNA, 459 bp, Homo sapiens
  misc_feature (349)..(349): n is a, c, g, or t
ttttctagtttatggatgtgacgatggtcatagaagtcttgaataatcttttgtatttctgtggtggtatcagcggtaatatctcccatttcatttctaatagagcttatttggatcttctctcttcttttcttgattaatcttgctaatgcttatcaattttatttatcttttcaaagaaccagctttttgtttcatttatctgttggattttttgtttcaatttcatttagttttgttctgattttgttatttcttttcttctgctgggtttggatttggactgttctagtttctccaattctgtgaggtgtgaccttagattgtttatttgtgctctttcagactntttgatataggcatttaatgctatgaattttcttcttacctccacttttgctgtatcccagagtttttgataggctgtgtcactattatctgtcagttcaaagaattttt

SEQ ID NO: 714198 - DNA, 1058 bp, Homo sapiens
ttagtcgccaggaacatcaggtgtcgtgaaaactacccctaaaagccaaattatgggaacaggaacaacgactcatatcaacattgtcgtcattggacacgtagattccgggcaagtccaccactactggccatctgatctatacaatgcggtggcatcgacaaaagaaccattgataaacctttcgagaaggaggctgcctgagataggtgagaagggctccttctatacgtgattgcctggggtcttggatacaactggagaagctcgcaggcagtgaaccgtgtgtatcaaccattgatatctcacttgatcggaaattatgagcacccagccacacgctactcatgtgagtatctattcgcatgcccctaggtaccacagcagagctttatctaataaaccatgagttacagggcactatctctagtgctgactgtcgctggtccatgatttgtttgcttgctggtagttcgggggaagtgctgatatgctggtagtctccaaagaattgtggacatgacccggagagcatgcccgttcgtggtcttacacaccgtggtaatgtgaaagcaactaaattgtcggtgttgaacaaaaatggattccagcttgagtccaaccgtactagcaggaagagaatactgagggaaaatgtgtccaacggaaagtcaggtcttaccttaggagaatcggttacaaccgccgaccagtaagcatttgtgccaatatctggtatggaatggtgacactatgctgagagcccaagtgctaacatgcctgggtcacggatgggaaagtcacccgtaacgatggccactgccaggtggaacacgctgtagaggtcgggaatggattctaacaccaatcgtccactgaacaaaccttggctgctctacaggatgtttacacaatgggggattgcgatgtctgtaggcgatggacatggggtcctacaccgggtttgggcctcgccatcaataagagaaaattccagccaaactgagaccacgcgaaaggaaacatgtaaacgccgacgacacacaaagttgaaccca

SEQ ID NO: 714199 - DNA, 536 bp, Homo sapiens
  misc_feature (22)..(22): n is a, c, g, or t
tcggctcggtaccagatatttnctatggcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcatagaaaatatctcggggatcctcttgag

SEQ ID NO: 714200 - DNA, 205 bp, Homo sapiens
attgtggcgggtgctgtaatcccagctactcgggaggataggcacgagaatcgcttgaacccgggaggcagaggttggggtgagcgagatcatgccattccattgcactccagcctgggtgcgagactgtctcaaaaaacaaaacaaaaaacaaatttagctaaaaaggaaagctaggcattaactagggtggggataccagggg

SEQ ID NO: 714201 - DNA, 261 bp, Homo sapiens
gcacccgattcttatgcaattcggtcacgcatacgccaacttccgtgatgagcacctcatacaccacctatgaaaaaacttcctaccactcaccctagcattacttatatgatatgtctccatacccattacaatctcacaaaaaaaaaaaaaaaaaaagaaagaataatgtcccattcataaggagtgtggcctttttgttccctttgagagaagagtaaaggccagtaagaatcagtggggctgctctccctttcttct

SEQ ID NO: 714202 - DNA, 433 bp, Homo sapiens
ttactccttaaagtagggggcaaacatggtggttgttataatccatataaaactataccctggacccccacggtggttgttatggtccatataatactatagcctagagccccattcagtcccttacccaaagtcacaaagttattgaggacccgggcctcctgacccttagtccctcggcttctttggcttaagaaggatgttagggggaggtgtctgtggtgaaacctgcccaggcctccctggccttgttctgggttggtggtcatccttttccctctgccctccagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctc

SEQ ID NO: 714203 - DNA, 509 bp, Homo sapiens
  misc_feature (17)..(17): n is a, c, g, or t
  misc_feature (128)..(128): n is a, c, g, or t
  misc_feature (196)..(196): n is a, c, g, or t
  misc_feature (198)..(198): n is a, c, g, or t
  misc_feature (235)..(235): n is a, c, g, or t
  misc_feature (248)..(248): n is a, c, g, or t
  misc_feature (250)..(250): n is a, c, g, or t
  misc_feature (256)..(256): n is a, c, g, or t
  misc_feature (269)..(270): n is a, c, g, or t
  misc_feature (277)..(277): n is a, c, g, or t
  misc_feature (304)..(304): n is a, c, g, or t
  misc_feature (321)..(321): n is a, c, g, or t
  misc_feature (323)..(323): n is a, c, g, or t
  misc_feature (328)..(329): n is a, c, g, or t
  misc_feature (332)..(333): n is a, c, g, or t
  misc_feature (340)..(340): n is a, c, g, or t
  misc_feature (344)..(344): n is a, c, g, or t
  misc_feature (350)..(350): n is a, c, g, or t
  misc_feature (361)..(361): n is a, c, g, or t
  misc_feature (377)..(377): n is a, c, g, or t
  misc_feature (424)..(424): n is a, c, g, or t
  misc_feature (506)..(506): n is a, c, g, or t
gcaggagatcacttgancccaggagttcaaggctgcagtgagccatgatcatacaccaccacactccagactgcatgacagagtgaggccctgtctcaaaaaaaaaaaatagaggctgggggtgggtnttgggttcctacagtatcacttcttgggatattgcgggtggccctgttctgatggttctttccgtttngnctgttggtttgatcctatttgtcagtatatctgtggnctatgaggttttngngattgntgtttgtgattgnnctttgtntgctttgttgcttctcccatgtttgtncggtttggtgggttttngntctgnnggnnctgttgntgtncttttntttcgtttcgngggcctgatctgtggntcagggtgtgggggtggccgggccggggcagcccctgctgggctggngccctttcatagttgcctgtggggtgtgggccctgtgtggctggaccatgccttcaaagtctgattgagtttaaatgatggnaaa

SEQ ID NO: 714204 - DNA, 452 bp, Homo sapiens
tttttattgcccccactaacctcctcggactcctgcctcactcatttacccccacccccccacttttttattaacctagccctggccctccccttatgagcggggcccgtgattataggctttcgctctaagattaaaatgccctagcccaccttcttaccacccaggcacacctacaccccttatccccctactagttattatcgaaaccactcagcctactcattcaacccatagcctggccgtacgcctaaccgctaacatttctgcaggccacctactcatgcacctaattgggagcaccaccctagccatatcaacccttaaccttccctttacacttatcattttcacaattttaattttactgactatcctagaattctgtcgccttaatccaagcctacgttttcacacttttagtaagcctttacctgcccgacaacacatta

SEQ ID NO: 714205 - DNA, 3296 bp, Homo sapiens
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagaaaaaaaaaaaaaaaaaaaaaaaaaaaaaaaaaaaaaaaaaaaaaaaaaaaaagggggggggcgccaaaaaaaatcccccgggggggcccccaagatcatagcggaccacccgacgacttatttgacaacaaagggggcccccataatgagggacgccactaataaaacacgacagagaacgacggccgccgctggtataaccacgacaggcgaggagcacgaggagaaacagcggcaaacgaggggaactatgatggaaaagaccaccatacactacggagggggggagaacacaaataggcgcgcagcgaaacacactaccacaaacaaggaaagaatataaaagagccgccccagacagggaacatcatacatacacacaacaaagaaacaacgaccaaaagaggggggggacgtaaccaaaccgagaagtaaagaggataaggcagggcagaagaaaaaagacggcgcacaacaacgaggaggaccaccaccacagagcaacagatgctccaagcacgggaggg

SEQ ID NO: 714206 - DNA, 438 bp, Homo sapiens
tctagcggatcgcttagtaatatgtaaccaatagcactgaaatgttacgtttttggtgattatatcaacatcaaagaaatgcaatcaaaaccacaataagatgccatctcacaccaatcagaatggctattattacaaagtcaaaaaataacagatgttggcaaggctgcagagaaaagggaatacttatgtactgtttgtaggaatgtggactggttcagccactgtggagagcaatttggagatttctcaaagaatttaaaatggagctaccatttgacccggcaatctcatgactgggtatatacccaaaggacaataaataattttacacaaatgagacatgcacttgtatgctaatcacagcactgttcacaatagcaaagacgtggaatcaacctgggtgtccatcgatggtggattggataaagaaaatgt

SEQ ID NO: 714207 - DNA, 432 bp, Homo sapiens
atggagtgctgaacaatcttgtttccagaaggggcagtgttccaccttcccataccaggcagctgttttttccttgtatgttctgatccaggagaaggccctaatatatggtctccttgcttacaagtaggatcccatttaccttattgtggctttgggagcttggcaactaaagttggatcagagcatcacaggaaagcttccagttttgtatcattaacacaacagtgggagcaaaaggtagaatcattagtgcaacagagatatagacactcaacctcccaggtccaggtaatagtgattgtggatgtccaggtggaatccattaagtgggagagagtttcacttaacatgtaggggtttgggtatttcaggatttctatggtgagttatagggttgcgggggatggtcatatgattttctagcaagcc

SEQ ID NO: 714208 - DNA, 3062 bp, Homo sapiens
ataatttactttgtattcttgaataaaaaacatttgtacattcctgatactgggtttatagagccatgtaccagtgtactgctttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagaaaaaaaaaaaaaaaaaaaaaaaaaaaaaaaaaaaaaaaaaaaaaaaaaaaaagggggggggcgccaaaaaaaatcccccgggggggcccccaagatcatagcggaccacccgacgacttatttgacaacaaagggggcccccataatgagggacgccactaataaaacacgacagagaacgacggccgccgctggtataaccacgacaggcgaggagcacgaggagaaacagcggcaaacgaggggaactatgatggaaaagaccaccatacactacggagggggggagaacacaaataggcgcgcagcgaaacacactaccacaaacaaggaaagaatataaaagagccgccccagacagggaacatcatacatacacacaacaaagaaacaacgaccaaaagaggggggggacgtaaccaaaccgagaagtaaagaggataaggcagggcagaagaaaaaagacggcgcacaacaacgaggaggaccaccaccacagagcaacagatgctccaagcacgggaggg

SEQ ID NO: 714209 - DNA, 271 bp, Homo sapiens
agaaccacaatctggtataggttctaagaatgtaaatgatcattttaacctatgcagaaccaattagaacaggcagattatttatccaaaatgaggtccaaagcaaactaataaggtgtaactatcggtcatacctcaccagagaccggtcagtgcctttatagactgagaactaacgtggaagataacatgctgaagactatatagcctaagtcatttttggtctaatacgtcaataaagaggagcacctgaacccatataaataatcca

SEQ ID NO: 714210 - DNA, 322 bp, Homo sapiens
gttctagaggatcccagctcgcttagatgtcccgggctcaaagcattctcccgcctcagcctcccgagtagctggaaccacaggcgcctgccaccatgcccgactaacttttgtatccttagcagagatggggtttcgccatgttagtcaggctggtcttgaactcctgaccccaggtgatccacccaccttggcctcccaaagtgctgggattacaggtgcgagccactgtgcccggcctgagagcctttttctctgctgccgccccgtatgtagataagcccgatgtggtccctccaccccatagctcggttgagcccca

SEQ ID NO: 714211 - DNA, 3018 bp, Homo sapiens
  misc_feature (13)..(13): n is a, c, g, or t
ccgggacaccaancactttgtctaggtacgggctcggtgtaattttcgtgccgagggtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagaaaaaaaaaaaaaaaaaaaaaaaaaaaaaaaaaaaaaaaaaaaaaaaaaaaaagggggggggcgccaaaaaaaatcccccgggggggcccccaagatcatagcggaccacccgacgacttatttgacaacaaagggggcccccataatgagggacgccactaataaaacacgacagagaacgacggccgccgctggtataaccacgacaggcgaggagcacgaggagaaacagcggcaaacgaggggaactatgatggaaaagaccaccatacactacggagggggggagaacacaaataggcgcgcagcgaaacacactaccacaaacaaggaaagaatataaaagagccgccccagacagggaacatcatacatacacacaacaaagaaacaacgaccaaaagaggggggggacgtaaccaaaccgagaagtaaagaggataaggcagggcagaagaaaaaagacggcgcacaacaacgaggaggaccaccaccacagagcaacagatgctccaagcacgggaggg

SEQ ID NO: 714212 - DNA, 125 bp, Homo sapiens
aatcgagctcggtaccttgtgagtctgtaagtaggagagtgatattgatcaggagaacgtggttactagtcacagccctatactccctctacatatttaccacaacacaagggggctcactcacc

SEQ ID NO: 714213 - DNA, 2764 bp, Homo sapiens
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctc

SEQ ID NO: 714214 - DNA, 97 bp, Homo sapiens
taagctttgatcttccctctgtgtgtgaatagaagcaaagcagaagcagtatctcttgactggtcaggtcctcagtgatggaaaagtcttcatccat

SEQ ID NO: 714215 - DNA, 2793 bp, Homo sapiens
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcatagaaaatatctcggggatcctcttgag

SEQ ID NO: 714216 - DNA, 288 bp, Homo sapiens
  misc_feature (5)..(5): n is a, c, g, or t
acacnaacctaggtggtagagcctactgcacacctgggctagatggcaaagtctgtcgcttctgggctacagacctgtacagcatggtactgtattgaatactgtaggcaactgtaacacaatggtatctgtgtaatctaaacatagaacagataatacattgtgctacaatgtaacaatggctgtggcatcactaggtgataggaatttttcagttccattataatcttataggatctctgtcatatgtggtcaattgttgatcgatacatgactgtatgtcgtatt

SEQ ID NO: 714217 - DNA, 630 bp, Homo sapiens
ggcaaagggcccgtgtttctgttgcgggaagctcccgggggtcgcacgtgcgtccgagcccaagccccttcccactctcacttccccttcactgcgtgcccgcggtagtcgccaagtcggaatacgttcttctcggcccgccgagtatgggactcagaacccggtggaaccagcatcgtcagaacatgtggaaaaaagatgtgtggatccctgacagaatattgagatgcaaaatggcaaagagaggtgttctgaacaagttcaagattttacaaatgttgcaagaactctcgagttcttatggtagtaaaatgccggaaagacaattctgcattgaaagaatgtctaaactgcttactataatgatccagccttatatgaagaatgcaaaatggaatacctgcaggcaagggaagaattcagaaaaactggaattcctacaaagacaaggctacagaagcttccaacgaaggcatgtaggcagagtatgaaatgacatgcaggaactctaatatacatggaagatcatggactagtccttaaataatggcataaagacataatatgttgggtgtaccttaattatggaaatagtaactgatctgaaaataaatataaaataagaaagag

SEQ ID NO: 714218 - DNA, 2714 bp, Homo sapiens
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaggatgaggtaggttcagtgcttccagcctcgtgccgaattcgccaccaggc

SEQ ID NO: 714219 - DNA, 2692 bp, Homo sapiens
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctc

SEQ ID NO: 714220 - DNA, 852 bp, Homo sapiens
  misc_feature (247)..(247): n is a, c, g, or t
aatccagaaaagaagtctcgaactctcaccgattaagaacccaaagctaagattcataatttaaactattactctgtggctttcatggggaagcagagtggggataccacgcctaagtattgactcatgccatcgaacaagcagcatatgtatatcggtacagttactggcctagtgctagccattgaaatagtgggtacgggataccaatacaagtagttgaccaacctgtagtatgtaaaaaccncaagccactatccaaaaccccccgtcggtcagtgcttactaggctggtacaagctgattcaacccgtcgaacttaatcacactatcacatttgctaacatcgctaagagtctagccccgtcaacccagttaggtgatagccaaacaaataggctaggccagccttaactagtgacatatgtcacataaagtcatcttaccgtgagcagtagcacatgtacagatcaaatcgcttctcgtccccatggtagtgatcgccctcagataaggggtcccgttggtcgaacaatccttccggaagacaatcgaatagtcccgacaacaagagattgcaagtctcctcgctctggtggcccataacacttggtgggtaagctaaaagttgatactgtagtccggacatctggttcctacttcagggtcatacatgcctaaatagcccacacgttccccttaaataagacatcaccgatggatcacaggtctatcagcctattaacactcacgggagctctccatgcccttggaatattcgactgagggggtgtgcacgcgatagagattgcgagacgctggagccggaagcaccctatgtcaaaaaaaaaa

SEQ ID NO: 714221 - DNA, 105 bp, Homo sapiens
ggactggagtagaggaaggtcggctgatctttgataacttgaagaaattcattggttataacttaaacaataatctttccggaaatcacccggtcctggtattta

SEQ ID NO: 714222 - DNA, 119 bp, Homo sapiens
ggggggccccccccatgggggggccccggggtttttttcccccccccccccccccccccccgggggtttatttggggggggggggggggggggggaaaaaaaaagggggtttttggcca

SEQ ID NO: 714223 - DNA, 443 bp, Homo sapiens
  misc_feature (52)..(52): n is a, c, g, or t
  misc_feature (82)..(82): n is a, c, g, or t
  misc_feature (121)..(121): n is a, c, g, or t
  misc_feature (127)..(127): n is a, c, g, or t
  misc_feature (171)..(171): n is a, c, g, or t
  misc_feature (376)..(376): n is a, c, g, or t
  misc_feature (412)..(412): n is a, c, g, or t
ttactatggcatatgatcaattttaatcggcagggtgcaggcaggactaaancaaacccaacttcgaaaaatcatagcatantcatcaatcgcacacataggatgaatgacagcagtattnccatanaacacaaccataacaatcttaaacctactaatttacatcacaanaacactagcaatattcatactattaatccacagctcagcaaccacaactttatccctatcccatacatgaaacaagatacccatcatcacaagcctaataatagtaaccctactctcaataggaggcctgcctccactatcaggatttataccaaaatgaataatcattcaagaaataacaaaaaatgaaagcatcatcatgccnacactcatagcaataacagcactgctaacctctatntctacatacaactagcgtcggctaatttaaa

SEQ ID NO: 714224 - DNA, 217 bp, Homo sapiens
agggggggtccgtcactgtcttctagcggtataagaatatgcgagaacagtttacggaactacagagaaacagattataatctataaattctgagagagagggtcttattattgtatgcccaggcgaggtgtccaaataggtagcagtcataagcatcattgcagacctatgatatgtctagggtaccagatggtaactcccacctacagactccct

SEQ ID NO: 714225 - DNA, 381 bp, Homo sapiens
ccaaggctcgaaaaggggtctggagtggtaagagaaatccaaactctgcttcagtggatgcctacaccaagtctgacgcggtcactgtccctgccaggctctacttgaatcatggcgacaacctgaagacggagtcagtggtccactagaagctgatcatgcagctcatcccccagtcagtctgtctgaccaccctgggccctttgttcctggaactcaaggatggtccagttccatttcaccaacaaggacctggagtctctcagaggcctctaccgcatcatgggctacggcttcgcgggctgcgtgcacttctcccagtcggcgccctgtgaggtgcgcgtgctcatgctcctgtactcgtccacgaagacgatcttc

SEQ ID NO: 714226 - DNA, 458 bp, Homo sapiens
  misc_feature (375)..(375): n is a, c, g, or t
  misc_feature (419)..(419): n is a, c, g, or t
  misc_feature (449)..(449): n is a, c, g, or t
acacttttgagccattcagtcaaaatactgtaaacatgaaagaccaggcaactacaacaagcgtccataaggccaggtgcagcggctcacacctgcaatcccagcactttgggaggccaaggcaggaggatcgcttgtgcagtggctcacacctataatcccagcactttgggaggccaaggcaggaggatcgcttgtgcagtggctcacacctgtaatcccagcactttgggaggccaaggcaagaggatcgcttgtgcagcagctcgcacctgtaatcccagcactttgggaggccaaggcaggaggatcgattcgaggccagggagttccagaccagcctggggcaacataggcgagacccccaccttttancaaaaatttttaaaatttaggccagaggttgggggttgcacacntgttagttcccagttatttcaggaaggccnaaggcaggg

SEQ ID NO: 714227 - DNA, 1546 bp, Homo sapiens
  misc_feature (114)..(114): n is a, c, g, or t
  misc_feature (761)..(761): n is a, c, g, or t
  misc_feature (1030)..(1031): n is a, c, g, or t
ctacctatttatgctaccccccgtggtgtgtcgtagtcccccaggccggcgtgtttgcggtgcacccctgttttgtgaccccttctggcagagggggttcctcccgcaccacgnggtgtggtgacccccgcagtcaacgccccggcgcccttgtgtggtttagaccacgctcctgcgcgctcgcggtttatctgtatttttgcccgcggggtctctccttaatatggggttactctccgcggaggggccctccgctctgggggggtgtggggccggcagattattcctccggcccacatctagaagggggggaatgggcgtatatatcgtccccgcttgggttgacgctgtatgtgtatgccgcccatgtggggggtcgtgacgcacccccccccccccgcgcgggggttttcttgttgttgcgggcaccccaattgtgcgccctcgttctgtgtaagccggggccgagaagcggccgcctcctctttggtggagcccgccggccgtcgttgttgtcctccttgtttgggatgaccctgtttttttgcgcctcaaggcccacagggggtgtccccccacaaagactcaccgctcaccgagagatactttttttttcggctggcttctcgttgaggcccacctctcggcgaagaggagagataatacggggagaatttttttgggctgttattatataaagggggtgtttccctgcggctgtgttgcacacacgagaagtgtatatttttccacaccgcggntttatatatggtgggttatcacagcgcgttggtgtggacacttgttcacacacaccggccacttatatattggccccacttgggttggcccacaagatcccacatatctatgatcgcggggagagaaaaatgtttgagaagcaattgagagagacactttcaatatccctatataagccacttatcacgagagttctcctggacacatctttgggtccccagtgggcacacaatgtccctgggagacccacaaacacgccacaatgggnngtgtctccacaggtttgtgtcacagtctgtgcacgcctgtcacacacagagacgtgagaggtgtggtgtgtgagattgtgacacacagacacatggtgtgggtgttgttggcacacaaggtgagacaagagaaggcacatgagaatatattgttggagaggccacctggaggcccctttgtgggtccacggagaatgtgccacagagccacgcccacagaaagagatcacccccttgcttgagcctgtgtggacacacactcgagaataaatttgaacttgtgttttattcttataccacccacgagtcacttcctcttctgtagctccacaggaagacgcaccccctcccacccccactcttgcttcccacgtattcctataaattctttgtgcttctcgctgcagttccccttgggttccactgttttccctgttccctcccacatgcctagctggagttgcacgagttaagtttatgaattaatgaaaattaaaactaaataacccattgtc

SEQ ID NO: 714228 - DNA, 326 bp, Homo sapiens
gaagcagtttgaataaagtactgtctctaatgaaaagtactttaggctgggcatggctgctcatgcctgtaatcccagcactttgggaggctgaggcaggtggatcacaaaatcaggagttcgagaccagcctgaccaacatggtggaaccccatctctactaaaaatacaagaattagccaggcatagtggtgcatgactgtagtccaagctacttgggaggctaagacaggagaattgcttgaacccaagaggtggaggttgcagtgagccacgattgtgccattgcactccagcctgggtgacagagtgagactccatctcaa

SEQ ID NO: 714229 - DNA, 252 bp, Homo sapiens
  misc_feature (11)..(11): n is a, c, g, or t
  misc_feature (23)..(23): n is a, c, g, or t
  misc_feature (39)..(39): n is a, c, g, or t
  misc_feature (79)..(79): n is a, c, g, or t
  misc_feature (113)..(113): n is a, c, g, or t
cggggggcagnaccaatgtgggnaggcctgtctggactnaagctaaaggcccctctgtgcatgatgtgggaacctggtnattcccatgccccatccagacccagggctgtggntccaccactgagcatcccttgcccactgtcctcccctccttggcactcccagccctccactcctgcatcacagcagttttaaggcccattattgtactgatttatccttgtaataaatgtttctgtaagaaaaaaaaaa

SEQ ID NO: 714230 - DNA, 141 bp, Homo sapiens
ggatacagctaggatccgggtaggacgtggcgcggtacattgacgtacggcgtgacggaggcatccctgcgtgtaccccaacaacgtcttcctgtccacagtgggccagcgatgccatcgtgactgtgtgctgaagctgct

SEQ ID NO: 714231 - DNA, 755 bp, Homo sapiens
atttgtccttggataggggaccggggggggcttggaatgttgcaaaaaaaaaagttacccaagggatgtcagttttttatccctctgcatgggttggattttccaaaatcataatttgcagaaggaaggccagcatttatgatgcaatatgtaattatatatagggtggccccactagggcggggtccttcccccctcacagctttggcccctttcagagattagaaactgggttagaggattgcagaagacgagtggggggagggcagggaagatgcctgtcgggtttttagcacagttcatttcactgggattttgaagcatttctgtctgaacacaaagcctgttctagtcctgggggaacacactgagggtgaaggcgtgcgaagatgccgtaatgaaaccggttagtcaattttggcttaatattggcgacaattctgtaaagttcctttatatgaatacttctgattaagctatctcacctttcttttgaaatccttcccttttaggagaacatttgacacttgtgaaatagcttgtaaaaaagccccttccttcttcttttaaacctttaaatgacaaatctaggtcaataatgttttgaattcttatcttggctttcttttaaatgaccatttgtctttcccaatacgactcgtcgatactggtaaatggccaaaaccaaaatttattttgcgccaataacaaacgctctctcaggcaaactacagacactttttcgtgacaccata

SEQ ID NO: 714232 - DNA, 198 bp, Homo sapiens
gcaggacgctgcgcacaacatgggcaaccaccctgccgctcctgcctgcagagagttaggaggaagatgaatggaagttgaagacgagcatagtaaagagcaaaaaccaacatcataattttgacacagtctgccgacatcacatacatacctaggtgctgatatggagatttcatggcaggctttcacgatgacgac

SEQ ID NO: 714233 - DNA, 382 bp, Homo sapiens
gaacaacatacacgctagttccgcaggggagctgccctgtctccgtaggggggtggctcccggcgcaacacgacgacatgaacaatccacagatcatgcagtccccacaacacccatgtgaggtaggccgtaagttggcaacgatcttcacgcccacttcacagacaagcccgggacacagtcaagcgcgagcgcatggtaggctgagcccgccggtgcaggtcctgggccgctccccgcgttcccaccagtccctgccagagccgggccgcctgcaacacagtcacttggacacaggataaaagatcatggttttaaaaaataaatgattaaaaagaacaaaaaccaaaaaagtgatgctagagaaggggaataaatagac

SEQ ID NO: 714234 - DNA, 344 bp, Homo sapiens
aacgacggcagggaaagaccgactcatgaccaaggctgtgtccctgcgggaaaacaagggccctgggacccagaatcatcggcaggggcgtttcctgaagaagaaagctccagcagtgccctcagccccaccctcctatgaggaagccacctctgaagaggggatgaaggcagtggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaatgttct

SEQ ID NO: 714235 - DNA, 221 bp, Homo sapiens
ccacctccgccgtacagatcacagatacgtccgctcggcccggaatcggatgcaccccaaagcggatgcgcggatggtcgatgggcccgaacggctcgatgccgaaggcgtgcagggccgaggtcttggcgcccgtgtccaccttggcgcggatggccggcaggccgagctcgggtagggcgagccattcctcccagccgaacacgatcgggccggccggc

SEQ ID NO: 714236 - DNA, 805 bp, Homo sapiens
gcattttaataaactcttgccaccgcacactctttgggtctgtgtatttgtctaatcaagctgtaaccctcgccgctgtggtccacggtttcattccctgaagcccgtgagaccacgaacccttcgatcgagaaaagaccttcaatcgggagaagacttctcgtctcaaaaagcatccgggcatcgggccttatcctgttggaaacgactcctttttggatctctgctcctatactttccagcgcttactgctcttgacagatacgaaacggaccatgttattctaataacagactccggactgcagcatcaaataccaggggcacccggagcattcaaggcgcaagaataacctggttgtcggactggactcactggcttcatctcggttttatggaaacaagtctctaagttttgcctagaatctcgctatacggcagacctgtattacgtgattcaggtgactcagtatccacatatcgccaaaacactctactaatcagtcggtatacactgtgactaatatctttcttgtacgttccctaccttacctactttctgtgtacctggctgtgcggctatactagaattgctcatgacacgttctactgcgacggttacacactttccctcacaacgcatactttgacctacacataccaactcggtctctctaccggcctacctaacatccagtggacagtacgctctgatggatattccactgcccatcctcgagatatcgccatgaagcctacactccctctcatatgctgcctatcgccgtccacatttgcaacaacta

SEQ ID NO: 714237 - DNA, 445 bp, Homo sapiens
tcttgactagaagcctgagaaggagagcttggaaggaggtgagctcttcatgtgtcttacatctgggctctgagcccagctctgtggcaggaggctgactcaccccatcagtcgctctcccagcattgctgtgcatggatcccttcaggaagaagctctggagtggggccgaggccccatgatgctctgctgggggtctggggacttgagctgcctcctgtctctcccactctggagcccctgggctcttgcctccttgttgaatttgcccctttggcttgccccgggccccattttgtgccatagaggggttgcttcatttgccggaggggtggctgaaaacaccattcctgggcttgcatctatctcgcttaaagtcaatccttatatcactgcactactgcagtcagtgcccagcggcggatgccaccttcgctggccctct

SEQ ID NO: 714238 - DNA, 174 bp, Homo sapiens
gctcgacaggcggaggtggcagtgagctgagatcgtgccactgtattccagcctgggtgacagagtgagattccatctgaaagaaagaaataaaaggaaagaagaaagagagagagaaagaaagaaagaaagaaagaaagaaagaaagaaagaaagaaagaaagaaagaaagag

SEQ ID NO: 714239 - DNA, 235 bp, Homo sapiens
gttcttcacagatgacagctttgcagtcgggagtagctgtcaagccaggacaagcactacttcccaggttaatgaacttgcccattatcggcagcaaccacccgggcctacagccatgctctggtggctgaaattgaccgataacctcgcaaagtgacagctgccatgggccaagaagaagatcgccacagagatcaaagataaacatcttttgctgaaagttgtataactacaa

SEQ ID NO: 714240 - DNA, 412 bp, Homo sapiens
agccaaatctttgttatcataccttgaaatacattccccagttcaagattaaacatctattcatattttcttcttggacattcaagtttaatccttatggaatgaattttggcatatacagtggattagagaactaattttatttttttaatgattggccaattttagtaacattttctaactgattattgctggtatatgagaaagccaatgatttttatgtatttatcctaaaattggcaaccttcctcaaattcttattctaatattcacttgcttctaatttttctaggtagaaaattatatacctttctttctaatatttatacttcttgtcttatttttctatttatttggctctaatttctagaccaatgttagataccagtgtggatatcatggtattttcttt

SEQ ID NO: 714241 - DNA, 928 bp, Homo sapiens
tgctgcagccttcagctctccaccctggactacgccatgtttgggtgtttgttgtggtctgtgtgtgtgcctgctgctcctgtgcctcctgtgtggcccttgctgtgatgactcaccctcttcatgctgtctgctgcccccatgctcatgctcttacttgctgtgtgcctgctcctgactgtgctgtgtccatccctgtcatgtggactatgctggctgcaaatcatctccttctgccaaaatgcatgtgctgcctgccacctgggtgctgcatctgttgtgctgtgtcatttgtgctgcatgttgtgcttgtgactgtccattgttcttgacttgatgctgtgacttaacccaccatattatctacaacttgcccctgtgaaaagttgcaatggtgccatgtgtgagaccagaaccgttgtgtttcttgggacgtgttgtgcccatgccattttgctggttgacgatgcaccaacgctacatgtgacctactttgcctattgtgacttgtgtaccatgacatggtgctttgcgcttacccatgtgcccatgaaacatgtaccttgtgacttcttggttgcacccaattcaaaaatctccttgttctggtccccttgaagaactcttgcgcgcagaatcaatgaactgttcatttggacgaaacctattttcatgagcacgagtgtccccattccaaaaaccgaaaacaattttttgctccccatttcaatgccttgagtgcttcccagaactttcattgcaaattgaagttgttgacgccagtgtacattccttggctggacctggctattacgcggctgtccgatcttgctagctccccttatttcggctgctctgccaccgctttgggccttccgcggttgctgcctggaggttgcgcaagctgttcctgttccatgggggctac

SEQ ID NO: 714242 - DNA, 271 bp, Homo sapiens
gctgatatagaggatcccccgctaagcgcggtcttatagcagaacgggctgaccttgggattcccaaatcagcctttccattgaagacagtgtggggctcttctttaccccgctccatcctcttcttcttggctatcacctaaaaaatccaccaggttgggagttcccgtcatggcgccatggttaacgaatccgactaggaaccataaggttgcaggtttgatccccagccttgctcagtgggttaaggatctggcgttgccatgagctg

SEQ ID NO: 714243 - DNA, 116 bp, Homo sapiens
ctctacccaacgtatcccagagctgcactgtattagtaccatcttatttcttcttggggattatacatctcagaccgcctgagtactggggtcagctctttatacaaagggaaaca

SEQ ID NO: 714244 - DNA, 1146 bp, Homo sapiens
ggcctgacccctgtaattaaatgtcaaaagccccttgtcccctcccctagggctaccaggtaacatactctactgcatatgttctagtggaagagaaggccggggttctaggaaagaagagccaaattttggtgggctttggtgccccctctcagactccccatgacaagacaacggggctgcagacgactgtgtgttcagtctgcccaggggctggggctctttaagtgcttggtcagagtagacggtttccatgtgagccttcaaaggtgtccagcaggctgcatggggaacaggcaaagctccctccttgcaaggaaaggagatgtccagaccaatgatgcccggcttctgacggcccatgaggagcaagtgggatgggagccaggccctggggctgcgtgtcccggaacatgaaatcgaagggggctgcctatctcgagattaggatgtggcacggtgtaagcaagtggatgttgctaagaccaagccaatggaggtgagcatctctggagaatccacaagaagaggcgtcggagcatcagacatagctcagaccatggagatcgcacgtgtgatagggatacaaagagggctcatactccagacgaccaagagagaagtacacggatagctcctttggcagaacgtcatggaagatgctcaggcgcacaaaggtctgaaaggtacccctgtaattcgctacaagggatttcacaccggcataggtgaacgaaatgcactcgctagagatcaaagcttggagagcttaacaagacaagcgaagtgaccctccattggggatcgcgacggagagaccattaaatggatcgcctatcaccgatgtagggaccaccccactcgattgcgggcggcaactggggaaacaagggtttggcatgacacattaggaagccacaaggaattgacaagtgtcgttcaccacgaactggagcgaagacgagagacattggggtgacacaacagagcgacacgagtatcggccgtaatcggacaccccgtaagcggtcgcaggaagaagaggaacaaggagggcttagtcaaataccacgacatagcagaccaacgataagatacatagtcgagaccaataggcaagggacaaaaaaggctacatacaacaag

SEQ ID NO: 714245 - DNA, 722 bp, Homo sapiens
  misc_feature (622)..(622): n is a, c, g, or t
gaattcggcaccttgacgtgcccatttaacagatatgaaaactgtggccgcgagaagaggaactgtaacttccagtttccttccccttgcacccagaaacaggttctgtgagcccctctccccataccatggagggtggggatgggtcttactcacccagaccgtgttcctccagggagaatagtcctcctcggaccagaggttcttcaaaggcattggcaactatctgcgggcagagatcctgtaccagctgtagatacccccctttgagaaggaccagtcggacctggaggccctgcagcaacacatgccgagcccggagctgaccctgagccacaagataaggaccaagctgcagaatccagacctgctggagctatgtcactcagtgtccaaagaagtggtccagttgtgtgaggccaaagatggcagcaacctctgcttcagcaaaagattgtgtaaccctgtggcacttgtccctctctggacctgattcaccgatttgaaagttcgagccctagctgttactcaatagactaagacctcttactagtcaatagtggtttcaggctgggcgcaatggctcattgctgtaatccaacacttacgggaggcgagtggngtggcttaccttacgtcgggagactagaaccatctgtccacctgtgaaaccccactcttttgctccttccacagtgggggtgcgtggacttgacttcctg

SEQ ID NO: 714246 - DNA, 107 bp, Homo sapiens
tcccaagaatgagaaattgcggacaccccgagcgagcaccccaaagtgcacaaagcatgagtaaaaagctgcccccttcaaacagaactagactcagtttacaattc

SEQ ID NO: 714247 - DNA, 149 bp, Homo sapiens
cttaggacatagatacctgcaaaaaaaaaaagaaatgagttatggaataggaaccagttatgtgatgattctgaaactttaacttagagcttcattactttaagaattggaaaacaccctctgagttttgattccccaaagttttcatg

SEQ ID NO: 714248 - DNA, 4362 bp, Homo sapiens
acggcgagcgcgggcggcggcggtgacggaggcgccgctgccagggggcgtgcggcagcgcggcggcggcggcggcggcggcggcggcggaggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagagggtgttagtggcttcatcagttgtagcaggggaatcccagaaacctgaactcaaggcttggcagggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcaggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagatcagagttgactgcaataatgaaaggagtgtccacactaaaacattacagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagcttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctacccaactttcaagaaggttctttaataaagcgaaaactcaaccaaatggtacttttccacagtgtaccattaaaatatgcactagtctctttttacaaggctgtattcagcaagggcctaacttgcttaaagtgtaattactaacttctaaaactgtactttgattcacatgttttcaaatggagttggagttcattcatattacaatatttgtgtgctaaacgtgtatgtttttcagttcaaagtcatgatgtttttaaaatcttattaaagtttcaaaaatctgaagattgtttatctagatgtaaatttt

SEQ ID NO: 714249 - DNA, 195 bp, Homo sapiens
cacgaggggaggagaaccggctggacaagaatggtctcttcaacaatctccaagtcgccacagtcgccgatctcttgaggcagcacgcagaacaggtcgccgaggaccgaaagaaagcgcgtgtcgtcgttccgcgcagccatccaaaagattccttcctgcaggtcgtggcctcgcccgatgggaagtgggcgg

SEQ ID NO: 714250 - DNA, 4248 bp, Homo sapiens
acggcgagcgcgggcggcggcggtgacggaggcgccgctgccagggggcgtgcggcagcgcggcggcggcggcggcggcggcggcggcggaggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagaggggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcaggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagcttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctacccaactttcaagaaggttctttaataaagcgaaaactcaaccaaatggtacttttccacagtgtaccattaaaatatgcactagtctctttttacaaggctgtattcagcaagggcctaacttgcttaaagtgtaattactaacttctaaaactgtactttgattcacatgttttcaaatggagttggagttcattcatattacaatatttgtgtgctaaacgtgtatgtttttcagttcaaagtcatgatgtttttaaaatcttattaaagtttcaaaaatctgaagattgtttatctagatgtaaatttt

SEQ ID NO: 714251 - DNA, 112 bp, Homo sapiens
tctaaaggctcccccgaaacacacgcaggttcagattccacataacacattgtctttaagtgaaccaccattctgttcgagttttagctgtagtatcctagaagactatact

SEQ ID NO: 714252 - DNA, 637 bp, Homo sapiens
agccagcggcaggacagcgggcgggggcccacaacaaaagctggcagtgctgacagagtgcggcctcaggacggaccttctggctactgaccgttttgcttgtggttttccctggattgtgtgtagtgtgtgagatcaaccatgatgttcctgttgcatgtttatgacccaatgagagtttttgcttgaaacacctgaatgtgtggctgtgttcctgcagacaagactcagagagtttgcgcgactcataagatttcatgaaatgatgtgagatgtcgacaccatcacaaaccttcacaaaggatttgccgttcaccatcacacatttccatgcagaaaatgcatgcatttgccgttgggaaaggttgccacaatggagaccactgcatgggaggccatggtgggacacaaagaatccggaaccacaatcacaggcattcagtgtcaactcacgtctacgaggtgattaccaatgttacacccttgggaagggcagcatgaaaaaacgtaccatatggagtactgacatcccaagcatcttcggaacgaaacgcgatcgaaacacagtgacaatacacacgtactgtgccctttgaagagactcacgtgccgagacgcacagcctgtgatggacttc

SEQ ID NO: 714253 - DNA, 295 bp, Homo sapiens
tagcgttaggtatgagcctcggtgttaatcggcgagggttgggcaacgtgttgctagtctggtcgttggtgacagtgaggcttctgcgctcgctgctggtgagcagccccggcgtgccctggtggctggaaggaggcgtgtggcgtgatgcggccgtggacgcggactgagtgcgcgggagcccctgtgaggagccgggcagccgctgagcccctggtgccccgtgccgggctggagaacctggcctccctggagctggcgagcgcgcccggggcatggcgggcccgcaggaagc

SEQ ID NO: 714254 - DNA, 125 bp, Homo sapiens
agccagaccaagtgtttctagacttcactgctcccagatgctatgcatgaacttcttctccctcgtgtcatcgacggtcccttcatctttataatccatgtttcgacaatttataattatgtttc

SEQ ID NO: 714255 - DNA, 209 bp, Homo sapiens
gcactagcggatccccattatggacgttgacagctggtgattaatgatgctcgagttgctggacgtttgttctgccccaggggtgcttgaagatctcgaagggatgcattctgagccgagaatgtccactgtgctgcgggggggaaggacacattgtactccaccgccatgtagctcaggtagacaaccttctgctggaggtcctgcat

SEQ ID NO: 714256 - DNA, 889 bp, Homo sapiens
ggcactcttcaccaaggaagctggagaaagtgtacgacccaaagaatgaggaggacgacatgcgggagatggaggaggatgcgactgcgcatgcgtggagcatgtgatgaagaatgtggacaccaaccaggaccgcctcggtgaccctggtaggtagttcctcgcatccactcagaggaaggagtttggggacaccggggagggctgtgagacagtggagatgcatcctgcctacaccgaggaagagctgaggcgctttgaagaggagctgggctgcccggtgaggcagagctgaatgcctaaggcccagcgtcctcagccaggagagagatggctctagggcggtcccaggccgtctggaggcccatgaagagagagctggatgtaggctgtgctgcatcatggagcatgcggaagcagcgagctagtcagcagcgagcaaggccatgaggtcccggggtgcccaccctgaggggcagctcatgttccaaccaagaacacatgacgatgtaactgttccaggctccagccggtgaccagcacaggtaggtggacacttcagaacagaaattctcgagcggtacctgaggttgaggtgcccagcatctgtgatcctccggggacccccagcccctccggattcctgatgctccaaggcgactgactgggcgctggatgaagtggcaccgtcagcttccctggggggccggtgtcatgttggggctcctggggccggggcacggcctggcatttacacgcatttgttgcacccaggatggccgtttccatttcagcggtttcaagtttgtggttctccttctgttccacgagggtgccttatctcggtccggcgaggcagggtcggcttactttagagcgcgccctacct

SEQ ID NO: 714257 - DNA, 495 bp, Homo sapiens
  misc_feature (1)..(1): n is a, c, g, or t
  misc_feature (7)..(7): n is a, c, g, or t
  misc_feature (14)..(14): n is a, c, g, or t
  misc_feature (44)..(45): n is a, c, g, or t
  misc_feature (71)..(71): n is a, c, g, or t
  misc_feature (80)..(80): n is a, c, g, or t
  misc_feature (105)..(105): n is a, c, g, or t
  misc_feature (107)..(107): n is a, c, g, or t
  misc_feature (137)..(137): n is a, c, g, or t
  misc_feature (246)..(246): n is a, c, g, or t
  misc_feature (329)..(329): n is a, c, g, or t
  misc_feature (382)..(382): n is a, c, g, or t
  misc_feature (411)..(411): n is a, c, g, or t
  misc_feature (429)..(429): n is a, c, g, or t
  misc_feature (479)..(479): n is a, c, g, or t
ncccctnaagttanccgttgaactcgaagccggggcataggccnncggatgccaatgtcagaaatccgggntcctggttnaggttgaaccccgggggtcagcatngnggccccagacgcaggggccagcgcgggttngcccttcgctccgcgggcggtcccaccaagcaacttttttccaattttaccttttcaaaataaaagatgtttgggccaggcgcagtggctcacgcttgtaatcccagcnctttgggaagccgaggcgggtggatcctgacctgaggtcaggagttcaagatcagccccgccgacatggcgaaactccgtctntactaaaaatacaaacatcagccggacgtggtggtgggcgcctgtaatccccnctactcgggaggctgaggcaggagaatcncttgaacccgggaggcanaggttgcaatgagccgagatcatgcccctgtactccagcctgggtgacanagtgagactctgtctc

SEQ ID NO: 714258 - DNA, 376 bp, Homo sapiens
tactccgacacgtcagctattagaagtaaacatttaaacttgaacatgtaagatctctggttgctacacatctcaccagtattgaggttagcaatccttaagttttgcatgctctggtgggtgcattctatactttactattctttttttttgagatggagtttcactctagcctgggcaacaagattgaaactccgtctgaaaaaaagccctgccgcccccgccccccaaaaaaaactatgcagacaataaaacagtcagttacctggagtttggagcagggagggatgaatagttggagcacagggagggatgaatagttggagcacagggaaggatgaatagttggagcacagtgaaattattctgtatgtta

SEQ ID NO: 714259 - DNA, 317 bp, Homo sapiens
  misc_feature (137)..(137): n is a, c, g, or t
  misc_feature (150)..(150): n is a, c, g, or t
  misc_feature (296)..(296): n is a, c, g, or t
  misc_feature (305)..(306): n is a, c, g, or t
cagctttgatggaacaacgctttttttggaagttcaaaagggctgtcgggggggtggccctgattttcgcttgttttgtcatcatttgtcaacgacaattggacaaaaaggctttggaaaaggtccggaaacaaatngagtccaaatagntacattccccccttgtattgtgggttttaaagaccctatttcagacagtgaaagtgaaaaggactgatttgcccttttggttttttggaaccttgggggggaaaccccttttccccatttttttttttcagatcattaatgagcanaataaaaanngttaaatggga

SEQ ID NO: 714260 - DNA, 348 bp, Homo sapiens
gtcgacttcatatgtatgttgtatgtgtgtgtgtatctctgtgtgtttgttgtatgtgtatgtctttgtgtatctgtgtgtgtcatagatgtgtgtgtatctatgtgtgtgttgtctgtatgcttctgtctatgtgtgtcagtgtgtgttgtctatgtatatgtgtatgtgtatgtctctgtgtttgttttatgtgtgtgtacgttctcagctcatttctattcttaagtcccatagacctgctcatcctgggcttccattgatttcatcttcatcttggcctccttgagatcacccagtccccaggggaccatgggcagggtgatctccagagggattcaggtcgac

SEQ ID NO: 714261 - DNA, 425 bp, Homo sapiens
taaccgaccgaacatactccaggaaggcacggaccgccggagcgcgcaagaagatcacactagcaggatcggcaggccaagccaggccacggccattgcacccatggggggcccaggtgaacatagctcgcgaccaagcagagaagagaagatgagggacatcaccagaggccagaccagaagacctcgtgtgtgcccccgtccggtgtctgcctgtctgcagctgttgtccacaccaagggtggcctacagagggaagtgaggatccttgggacttcgctccaggacagaccctgcgactgtcgcaaatctgccagctctgcatggcagaggctgcctaccagtacaagcccttgtatccagctttctgtgcccgtagaataaacttctgctgggattgagccactcagcacttctgtggctgg

SEQ ID NO: 714262 - DNA, 608 bp, Homo sapiens
atcgatgagatagattgtcatcatatgattgttcgtcatatcctagtgcgctccctggtacagtcacggtgtgcctttcgagtctcctgagacccatacatgaccagttcggtccgtatcttatagcacctagactagcagcactaaaaataggtcgaatagggaccagtactggatctcgatgaagacttaaaagtgcctaccacgattcttgaacggataaataggccctacagatagtatgacctacaattaccttcatggattgacctcagattaccatgccgagttccatccgttaccatagcagggccactcactacaattacaggatatgcttgagttcatattcgctcttgactgtgaacctatcgtacatgcggcctcgaaaacaagggccactccatttgaatgtcatcctctttgcctgactagtccttctcatctttcagatgtcattttagtgatcgtttcctctgggaagccttctgtgacctaccaaatgtaagtcaataccctccctatgtgctccaataacactttgtacttttttttttacaattcgaagctgtcgggctttcggggctgtcgggctaatcggggctgtc

SEQ ID NO: 714263 - DNA, 145 bp, Homo sapiens
attcgcggccgaattgaccaaactctgatttccgtgggggaatgtcatggtcttgctattactaagttttgagactggcaggtaatgaaacttattaggctgagaaccctgtggaatgcatttgacccaactgataaaggaagtt

SEQ ID NO: 714264 - DNA, 864 bp, Homo sapiens
gtggtctgtcgggccgctacctgccggggcacaagtgctattgcgcgcccgccgctcgccgggcctgctgtggacgccagccttgcggagtacggcaaccttcgctcagtgcgctccagttcgtgcctggagactgcaggttagcctgctggacaacgtgcctgctgtggtggcctcctgagcagtcctctcagcccacattgcactggtgggaagtgtggatttgatgttggcagcctgtttttgagactgatgaagcaataatggggcaggctacttttttggagcatctggctttcaagggtgaacaaaaagaatcgggccttggcagtgccctggacgaattgatgcgtggaagagcatgggggcccatcttaattggcctacatgcacccgtggagcacacagtcttaactaccatcaatggctgcttgtccaagggatctgccgaaaggctgtggacgctcctgggtgacatatgtgcaggaacttgtaaggtcgtgggcagacctcacatgatttgagaagggcagcgttgatgtggaatccttgcgggagacttgcacggacacattggatgcatctattgcgagaatgtggcccttacactaacatgcattgccccaggcattacattggtgccaacacttctatgtcaccagtgcttcttgaggtgtgcccaattcagaactgtcaaggcagctgatatcgtcgcggacttgaccggaataatcttcaacaccattacaaggccctcgatgttgtggcagcagtggattgattgggcccagtagctgttactcgccagaagacctgtggctcgtgaaattcgggacgcgcccagatatcaagcgacggagggac

SEQ ID NO: 714265 - DNA, 449 bp, Homo sapiens
  misc_feature (6)..(6): n is a, c, g, or t
  misc_feature (403)..(403): n is a, c, g, or t
ctgaangcagcctgctgagcagagcagtggtacccagtgcttggccccctaaactattctttcctcctacggctgtggacctgtgaggctaggggctgtctccaagttctctgagattgcctttgaggccttttcccattgtcttggatactagcacttggctcccatttagtcatgctagtttctctagcaagtagttgctccataccctgctgggattctttctctgccacatggccaggctgcaaatttgctgaattttatgctctgcttcccttttgaatataagttccaactttaagtcattcctttgctcccatatctgatcacaggttgttacaaggagtcaggccacatcttgaatgctttgctgcttagaaatttcttctgccagagaccctanattaccactcttaaattcaaacttccacagatccttggtacatgaa

SEQ ID NO: 714266 - DNA, 279 bp, Homo sapiens
  misc_feature (2)..(2): n is a, c, g, or t
  misc_feature (17)..(17): n is a, c, g, or t
  misc_feature (26)..(26): n is a, c, g, or t
  misc_feature (30)..(30): n is a, c, g, or t
  misc_feature (69)..(70): n is a, c, g, or t
  misc_feature (88)..(88): n is a, c, g, or t
  misc_feature (91)..(91): n is a, c, g, or t
  misc_feature (109)..(109): n is a, c, g, or t
  misc_feature (111)..(111): n is a, c, g, or t
  misc_feature (129)..(129): n is a, c, g, or t
  misc_feature (132)..(132): n is a, c, g, or t
  misc_feature (137)..(137): n is a, c, g, or t
  misc_feature (162)..(162): n is a, c, g, or t
  misc_feature (184)..(184): n is a, c, g, or t
  misc_feature (188)..(188): n is a, c, g, or t
  misc_feature (220)..(220): n is a, c, g, or t
  misc_feature (231)..(231): n is a, c, g, or t
  misc_feature (233)..(233): n is a, c, g, or t
  misc_feature (259)..(259): n is a, c, g, or t
gnacgagccagcctggnaaacacggnaaanatgtacaaaaaaaaaaaaaaattagccaagtgtggtggnnggcacctgtaatcccagnaantcaggaggccgaggcggnanaattgcttgaacctgggnggnagagngcttgcagtgagccgagaccgcacnactgctttgtagcctgggcaanagantgagatgcatttcaataaaataataaactatnacatgtaaccncnaaatatgtacatcattgtgtatcaanaaaaataaataaatgtgaat

SEQ ID NO: 714267 - DNA, 292 bp, Homo sapiens
  misc_feature (227)..(227): n is a, c, g, or t
ccgttcaggcttgattgaggcagttgaggtggattaaccaaaccagctacgcaaaatcttagcatactcctcaattacccacataggatgaataatagcagttccagcgtacaatccgtaacataatccattcttaatttaacgtatttatattgatcctaatctactaccggcattccgtacatactcacacttaaatctccagtcaccacagaccctcactactnatctctgcgcgctgcaatcaatgcctggtaaggcggatccttctaggagtcgacctcgcagcgca

SEQ ID NO: 714268 - DNA, 410 bp, Homo sapiens
caggtggtgtgctagatttggcccatagtccaactgtactttctgtgatgatggaaatgttcaatatttcctcaattgtctaatatggtaaccactagccacatgtggctactgatcatttgaaaggtggttacatggactgagaaactgttttttttttttttttttgagatggagttttagtttgggaagaagaagtagttctggaaaagggtagtgatggttgcacaatcatgtgaatgtacttaatgctactgaactttacaaataaaatgatcaaaatggtcaggtgtggtggctcatgcctgtaatcctagcactttgggaggtaagattggacgattgcttgaggccaggagtttaagactggcctaggaaacatagccagtccccatctctaccaaaaaaaa

SEQ ID NO: 714269 - DNA, 485 bp, Homo sapiens
  misc_feature (19)..(19): n is a, c, g, or t
  misc_feature (38)..(38): n is a, c, g, or t
  misc_feature (236)..(236): n is a, c, g, or t
  misc_feature (248)..(248): n is a, c, g, or t
  misc_feature (318)..(318): n is a, c, g, or t
  misc_feature (368)..(368): n is a, c, g, or t
  misc_feature (398)..(398): n is a, c, g, or t
  misc_feature (439)..(439): n is a, c, g, or t
gactttgaacttgaaaatncaaggaaatgtagaaaatncaggaacttgtgaaagaaaccaaggatgttagtgactctgacaaaagacagactgattttgtgaaagacttttattctcggactttcaggatggaaggaatgacacttgaccctcatcaggttggaatgacctcttcctagaagtcttttgaaattacagatgttaaacccctaaaggggagaccatctatccagggncaatagggaagnaatcgctgggcaaaggagggaaaaaccaaattcaccatagaggaatgtgacacggacaaggatagttttnggctgatgtgaaagttcacatccttgggctccttccaaaatatcaagatngcaagaactgccatttgcaacctaatcttnggaaatctccttccaaggtttatggcaatattcgagctgtngctagcagatcagcagatcgattctgatttcaagtcagagactttt

SEQ ID NO: 714270 - DNA, 247 bp, Homo sapiens
aagactctcgagacccccggcacgagcacaggctcaaaatgcgtccagtactgctcagctcagcccaaaagtgaccaggcttgcttacagtaggcctcaaaatgtcgaccagcacttgctagctcaggctccaaaatgtgaccagcacttgcgcaggtggagctgaaaaccgcaccaggctcatgttcattccctactcaaaaactgaaactgcactctcagacgcgtaagtccttaaaaaggggcc

SEQ ID NO: 714271 - DNA, 751 bp, Homo sapiens
cgcagtggctcacgcctggaatcccagcactttgggaggccaaggcgggcgaatcgcaaggttaggagtttgagaccagcctggccaatatgttgaaaccccgtctctactaaaaatacaaaaattagccgggcgtggtggcgcgtgcctgtagtcccagctacttgggaggctgaggcaggagaatggcgtgaacccgggaggtggagcttgtagtgagccgagatcacgccactgcactccagcctgggcaacagagccatctcaaaaaaaaaaaaaaaaaaaggaaattaaaattgcaaggggtttccaaagttttccttgttttgtgccctttaattttggtgcccttccaaccccactttggggtctgcacttattttttccccagaatttactctctaaaattattgaagggccctaaggtggggatatccttcaggggtaagagcgtcctataaggagggatgtccgggctccttgcaggtacgggagaaaagctcgggcgggcactttccagtttgacaagtattcccttcggggaccagggcgctttcacacggttgggtcccctataacgacagaaattcgggtattcggatccagcaatacagcattgtctacaactccctgtttcaagtgggactgtttctcgaatcagactggtgtgggttttcccccaaattttggtggggtaattgacacaatttccctactttatcaccgtacctacggcgtggaccagaaatcc

SEQ ID NO: 714272 - DNA, 91 bp, Homo sapiens
aattcaagcttctaacgatgtacggggacatggactcacagggtcctgtgtggttacatcttggaaaaaatgcagatgtatttcactctca

SEQ ID NO: 714273 - DNA, 332 bp, Homo sapiens
ggggccccccgggccattttttttaaaaaaaaaagttttaccaggggggggtggggtccccgccccccccctggggccccctttgggccctggcccggggtggggccaaggggcttttccaagtccttaaaatccctttataaaaaaaaaaaggttttttttccattagccccccccaatggggttctaattgggccccccccgccccccggtgggtaggggaatttggccgggttttttgggtttccctttttgccggggggggaaaattggtattttttgaaaaaaagaattgaaaaccccccatggaaaaaagggttttttttagggga

SEQ ID NO: 714274 - DNA, 223 bp, Homo sapiens
  misc_feature (82)..(82): n is a, c, g, or t
tgtggtgtaccgtagcacatacgttttatgttggggagtgggcagcagcagccgaggggtatgtagagatgaaaaagacagnccccgcctccgtaatagaaaggaaatgaggacaggctacgttttgaatgtggaggggtctgaaaggaaaagcttcagatcgtgactcaaccgaatcacacaacatgccggagcaatgccgtgctcttggaaggtggaattc

SEQ ID NO: 714275 - DNA, 841 bp, Homo sapiens
tccgaaaaagagtttggctctgtgtcccccaggggggggtgcggggggtgatctgggttcagtggcaaccttctggcctcttcccgggttcaaggcgattctcctgtgccttcagccctcccagggtacgcggggattcacggggtgctcactattagtgcccagctaatttgggtttttcaatagagagggagttcgccgtgtggactcagggtgggccctcggactccgtgacctcgggtgactccacccgcctcggccttcccgggggtgcggggattacgggcttgagcctgcacgccgggccataaaggtcacttttcaacgggtgcctcaaagacaataattatactctggtgtacccagagggctttatttcactttacccggaatacaatcttataagcttggtccccacaacaaattattctccaagtcaaaatcatttttaaaggaccctcaggggggtcaaaaatttccctaacatatatgggcaggataggatgtttagaccctttaaatgggtgcagatatccaattcccggattccgtcccttttatccgaaaagtggaaacttttaccagaggggtatggccaagtgaactcaccctggttggtgggacccggtggaacgcactgacaatatggggtcattccaaagcgccagaggtatcgacggcaagggtggcatgtgtgtgccttggaacccagagaaaagaaaattgttgggcccggatataaattggcggccgagaagagatggcagcgaggataggtgaacagcggggcgctgttggtgcgcttccccgccggtaaaagagaggatagtactagtaggct

SEQ ID NO: 714276 - DNA, 270 bp, Homo sapiens
  misc_feature (15)..(15): n is a, c, g, or t
  misc_feature (33)..(33): n is a, c, g, or t
  misc_feature (58)..(58): n is a, c, g, or t
  misc_feature (99)..(99): n is a, c, g, or t
  misc_feature (162)..(162): n is a, c, g, or t
  misc_feature (201)..(201): n is a, c, g, or t
cggcacgagcggacngagacattgcagaagctntgcccaggggggcagctcccattcntgctgtatggcactgaagtcacacagacaccaacaagattnaggaatttttggaggcagtgctgtgccctcccaggtaccccaagctggcagctctgaaccctnattccaacacagctgggctggacatatttgccaaatttnttgcctacatcaagatttcaatcccagcactcaatgacaatctggtgaagggctcctgaaggcctgagg

SEQ ID NO: 714277 - DNA, 1047 bp, Homo sapiens
tgcttaagctcttcttggcacaagagctttagtaagaggggaatgcaaagggaagccctgttagaaattagagtcttgagcggacagcactcaactaggcctgttattatgtatgaggtagaattgctacataattatcatgggaacatgattggtctgctgtgtagttatgaagttcatgtagcaaagaacttgttacgatgggattctgctcattgtattaaaaagctactgacttgactgtcatcctgttcttggttaggccattgtgaataagattttagtgttgataattctgttatgttacatatctctaatttagttatgaaattcaaaggtgaaaataaccaaatgatgtgcctaagataaaaagtttaccaaaaccaaaataatataattcgtggagacaaagtccaaaaagtggggcgcgaggtggcaactgacgacttcttcgccccgaggggggcccaaagttaagcagttccgcggagccattgttgtgctaacccaaggagggctccccagagggggagaggggcagagacactaacacgcataccgccaggcgcgcgcgtggactcttaaaaaaccgggggtatggcggcgccaaataagctccagccggagggacaatttccgggaaaagagaggacgaaggcccactcggggagtggcgcgagaagatcacacggggacgaatgttaccaaaccccggcgaattacccgcatccccccgggtgcaacacttgaccaagtttcgacagggcagcaaacaagcggtgtccacgacacgcggcacacaattacagcgcacagttaaggacaaccttgggaggactcccgggaaagaaaagggagaccgggaaccactggtcactgacgcggagcgggaagacaacgaagaaacatagttgagacccaagaaaatcaagacgaagagaaaccccaaccagaacacccccgctgggggagcgagtaacaggtgaggacaaatggggggaaaaaccccgggggacaaaaaaacaacgggaaagggagacacgggac

SEQ ID NO: 714278 - DNA, 264 bp, Homo sapiens
  misc_feature (26)..(26): n is a, c, g, or t
tgatctagaggatcccagggggaacntcacttatgaatgatgggaagagtgaggaacgggagacgtgattacagataactcgtcagggagtttggctgtttaaagaaacaaatgccgtagtagttagaagtggatgtgaattgtttttgttaaggaagatatcatagcatgtgggtaagactaaggggaatgatccaatagaaagagacggctagagagagatgatgtggatgatgtaagagagagaagtgatggttccccgcg

SEQ ID NO: 714279 - DNA, 433 bp, Homo sapiens
  misc_feature (83)..(83): n is a, c, g, or t
  misc_feature (96)..(96): n is a, c, g, or t
taaatggaatgcttgttgccctgttcccaggcgagtggctccatgagactgaggccacacttgggggccaatcagtggtttcntccttctttctcntccaacaccccccaaccttggtgccttaaaatcgcccctggacaaagtttctgggcaaaggggaaaacagctcccaggccttactcaggcctcaggtccatgggttgggcagccagtttgggcccttttcaggatcctcatttccatcctcatcctcttccttcacagcatttacttggagctttttgtgacacaccatgtcagtcatgatgaatcggccaacagccagcccttgccagctgacgtcccagtttaaaatgggaaactgtggtacaaataaacatgaaaaaagcttagcagtgattgaggtggtgactaaatatacagtccttgaata

SEQ ID NO: 714280 - DNA, 188 bp, Homo sapiens
taaaagatggggtctccctcggttggcccaggtggaagtgcaggggcgtggtaagggctcacggcagcctcgaattcctccgggtctcgggcgatcctctggcttgggggtcccgagtagcggggactaagcgtctctgccaccacgcgcggttgtatctagaatattttctacccaaatatatgttt

SEQ ID NO: 714281 - DNA, 217 bp, Homo sapiens
ctcaaatggatcacaagacttaaatgtaaaaagtaaaactataaaagtccataaaaataaaaaaaataggaaaaaatcatgtcctttgagttaggcaaatttccttaaactcaaattattataaaatatcataaatcattataattattatcttggtttactgcaacccctgcctcctgggttcaagtgattctcctgcctcagcctcccgagtagc

SEQ ID NO: 714282 - DNA, 533 bp, Homo sapiens
  misc_feature (362)..(362): n is a, c, g, or t
  misc_feature (499)..(500): n is a, c, g, or t
ctctctcttgcccaggctctagtgtaatgacacgatatcggctcactgcaacctctgcctcttgggttcaggcgattctcctgcttcaccctcccgggtagctgggactacaggctaccgccaccacataggctaatttttgtatttttagtagagacggggtttcgccctgttggccaggctggtctcgaactcctgacctcaagtgatccgcccgcctctgactcatgaaatactgggattgcaggcatgaaccaccatgcctgacctgttctaccatctcttttataaatattggtctgcttctctttgaagggttcttattctagtagtagaataagatagaataagatcatgtttgntatctctgtattgacaggcttataagtggctgttgattgaatttaaagagaataaataaggtatcattcagatatttgaaatcaatttctaaagtgacagtaaattattttagttatctccctgacctttgactgcnncagagcagctttggaatacaaagaggtggagaa

SEQ ID NO: 714283 - DNA, 123 bp, Homo sapiens
cacatagctggttactgaggtctccatacggcagactgtattcctgcccatcatgtctggaagagcgtgggcccaaacacaattgccaggttgtgcacgttcatctggttcgtgtctgagaag

SEQ ID NO: 714284 - DNA, 607 bp, Homo sapiens
ctgctgctcttctctcccattgaattatagtgctaagtacatggtcacatctgtatcccgcacttggagccaaggacagagatcactgagcccagagttcaaggtgcagcgatctgtgattgtaccactgcactccagcctgagtgatagagacactctctaattttgagacagagtctcgctctgtcgccaggctgaagtgcagtggtgtgatctcggctcactgcagcctctgcctcccaggttcaagtgattctcctgcctcagcctcccgagtggctgggattataggcacccaccaccacgcccagctaatttttgtatttttagtagagacggggtttcaccatgttggccaggacggtctccatctcctgacctcaggtgatccgcctgccttagcctctcaaagtgctggaactacaggcataagccaccgcacctggccaaaaattttttagaaaaccaacaatttaatacaacctcatgagtcaaaagtgatacatggagctaggcaccgtggtgcacgcctgtggtcccagctgcttgggacctgaggcaggaggatggcttgagtcaaggagttcgaggccaccctgaacaacat

SEQ ID NO: 714285 - DNA, 642 bp, Homo sapiens
atggaggtgctgcggcgctcttcggtcttcgctgcggagatcatggacgcctttgatcgctggcccacagacaaggagctggtggcccaggctaaagcactaggccgggagtacgtgcacgcgcggcttttgcgcgccggcctctcctggagcgctccagagcgtgcctcgcctgcccctggaggacgcctggcagaggtgtgcaccgtgctgctgcgcttgggagatgagctggagcagatccgtcccagcgtatatcggaatgtggcccggcagctgcacatccctctgcagtctgagcctgtggtgactgatgccttcctcgctgtggccggccacatcttctcagcaggtatcacatggggcaaggtagtgtccctgtactcggcggctgcgggactagcggtggactgcgtccggcaagctcagccagccatggttcatgccctggttgactgcctgggggaatttgtacgcaagaccttggctacctggcttcggaggcgtggtggatggacggacgtcctcaagtgtgtggtcagcacaaaacctggcttccgctcccactggctcgtggccacactctgcagctttggccgcttcctgaaggctgcattcttcctcctgttgccagagagatga

SEQ ID NO: 714286 - DNA, 610 bp, Homo sapiens
gaaaatactcactgcgctggaaaaaatataaataataaatggccgcttcggcggcctgtttctctgtttgaacgatgactaaatagtgactgcgaaatgagataagccgttctcaaggcgtcctgcgccccaaattcgtgggaatttattttactaattcagatgatcaaatttactctaaaaggagtgaagggatgtctgatataaaccatgcaggttctgaccttatatttgaactggaggatcgccctccctttcatcaggctctcgttggtgccattacccatctgttggcaattttcgttccgatggtaacccccgcgttaatcgtgggtgcggccttacagctttccgctgaaacaactgcctatcttgtttctatggcgatgatcgcctctggtattggtacctggttacaagtaaaccgctacggcatcgtcggttctggcctactctcaattcagtcagtcaatttttcatttgttacggtcatgattgcgctgggcagcagcatgaaaagcgacggttttcacgaagagttaatcatgtcgtcgcttctcggcgtctccttcgttggcgcatttctggttgtcggatcttcatttatctt

SEQ ID NO: 714287 - DNA, 93 bp, Homo sapiens
aagacagcagcatatatctctgcagcgttgaaggggccgggacagggtcctcacgtgagcagtacttcgggccgggcaccaggctcacggtca

SEQ ID NO: 714288 - DNA, 280 bp, Homo sapiens
  misc_feature (10)..(10): n is a, c, g, or t
  misc_feature (92)..(92): n is a, c, g, or t
  misc_feature (128)..(128): n is a, c, g, or t
  misc_feature (147)..(147): n is a, c, g, or t
  misc_feature (201)..(201): n is a, c, g, or t
  misc_feature (203)..(203): n is a, c, g, or t
tttttttganacacggtcttgttctgtcacccaggctgtagtgcagtggtgctatttcagctcacttgcaggctcaacctcctgggctcaantgatcttcccagctactcgggaggctgaggcagganaattgcgtgggcctgggangaggaacttgcagtgagccacaatcgcgccactgcactccagcctgggtgacanantgagactctatctcaaaataaataaataaataaataccacttccataaacaaattgccaaaaatgatgctgagggaa

SEQ ID NO: 714289 - DNA, 1418 bp, Homo sapiens
  misc_feature (606)..(606): n is a, c, g, or t
caagcagacccgggagcagatgtatagcatcgagcgactctgtgtgttttctgcacgagaattaggtgcattgatgagcatattactctctccccccacccctgcccacctatcatgtcctgctaggcagggggagtggcctgggacaagtctagccttagagcacacttctaacggaccgtaggcctgcatcaaagtagttatgcaatgctgccaatgatctgatgaaagactgtgcaaaggcggtgacctgagacccgtaacttcatttgagtaggaaccacatggtagaacggatggtgaccatcgctatgtgaacaactacacgaaagcagtttcgggaggatgaagatggtaggtgcgacctgcactaccatgataggagatagctcgcagtgtgacctggactagcgcatgagggtggggatccgcgtacatctatacccagctgcctcgctctcctgggccgaattctacctaaggaaagcatcagctcaaggaaagtaaagtgttcgatactaacttctcatatggggcattgcaaatggtgaagctgagcagcgcttcgcccggtgatcgtggggaagctaaacttcccttcgcagncattttgcagcaatagctactgtatcaatggactgctgctccccgtaccgataagcgaaaggatcaagagttcccttcctgtcttcccctgaacaagggggtaagtcgctcgtcacgcatactattgctgggagggcccgaaaaaggacccccactagaggggccaccaagaacgcgctcaagaacctgttggggcaatagtactggtcctgaggcagaactctattgcgtaggtactcgaccttacccgagacccagttgcctaccggtccaagcgaaagggcatagaccgggagtagggggttcgcctagacctggaacatgcctccctattggaaacgtcttcgcgtatggggccgggactaggggtacactcgacgggcccgcctaggggagacccccctgatctgcctgttcgccttccccttggggaccccgctggtcgtaggcttcctatgtgcggcccttttccaatagatgccttttatcctctcgttcgcctgttggtaacttgggggtcgcgttgacggggtaagccttggcgtcccgtggccaacgcatggcccacttgcctggcttggacccgctccttgaggcatagactcctccattggggacgcgcgcgaggttttctccgggcccctcctgcccggaacttggtcccgcaattggggtgtcccgctctttcccacgctttgcgggacgctctcctttttccttggagcctttgttgacaccctcacgatttgggtccccgcccgtgcccttctccctggtggcctccacgaaggggctatgctgcccgttcacga

SEQ ID NO: 714290 - DNA, 545 bp, Homo sapiens
gaaaagagtaaccacagtcccactggtacttatcgtggggagcgggcaggtgtgaggtaggagggccggtatcgcctgatctgtccaggaacctcaatcttccagtgaggtgctcgaatttggggttcacaagaggagaagccagcgactgcagactggtccatggtgtcgatgaggttcttgtcgctgtaggagaggcgcgccttctcgtacaggaactcctggtcacagttactgtagtctctgcgtgacttcactttgggcctgacgggtggctccaacctccgcttttccagcagagtccagtaaatggtctagaagaaggggtggatagtgatgtatcccgtcactcccagcctcttggttggttccctttcaaagagcttctccaggatgtccttggactccttggtgaatccagcgggcataatgtggcgtgtccacccgggctggactccgaagagtacatcctcatcatcaaccatggaaggtggactggccaatgagcatctcgtacaaaaggacccggaagaccacagtccaca

SEQ ID NO: 714291 - DNA, 698 bp, Homo sapiens
ccacgcgtccgctcgctggcctactctctcctcccggtacggcgcctggaatcccagcgtccacttaccatggccgcggcataccccgaccgtcccccccgacatcccgaccacccctgctctctcatggctcttcagtgatccaatgtccgctccgccctattaagcgggtctacgttgcctgtttgcgacggccctgcggacttcgggtcccatgacacgcggggactccggatggcttcctgtgcggactccgcgaggccaaggacgggagactgtggcagatactcctgaggctgcattcggcgtgaacgacctgcaggccggacgctacgccgacattcgacaaaactctcgtgatcacggtgaacgatcacgtgacagaacgccactgagcagcagcactggctcaaggacgacaatacctatactactcacatgccaccgcgctagcagcaagattcttccgagcgcccggcgcgcctacgtggcggccctgcgctggcgggctatggcgatatactatcacatctaccgctacatggccaggcacgcaccattcatctggcaggatctctatgtgatgccggactatcgggccccaagcgactaggaaccaaaataatcacaaaggagcgcagagcgaggccatggcatagcggatgctcccacatcccgccaggcccgcctggacagca

SEQ ID NO: 714292 - DNA, 231 bp, Homo sapiens
tgactacattcttactatatatccagcatatacagtaatggatatgttaaccttaaaagaaactgccagttttccaaagtggttggagtagtttctgttccctccagcagggtttgagcattccagttgctccacatccctgccaacatttggtattttgactttttttttttttggaaaatggattctcgctttgtggccaagcctagcaacgggggaaaaccccttgtc

SEQ ID NO: 714293 - DNA, 520 bp, Homo sapiens
ccgccttttttttgtttttttaacaaaattaagtgtgcttagagtcattcctctacatgggctgtggttgtcagcccataggttggtcagttcacatcaaaactgtgggtataacctgttgaacccaatcacattaaaatattaaggtgggcacaggggtgtgcctctgtcgtcccagctactggggaggctgaggcaggaggatcgcttaagcacaggagtgggaatccagcctgagcaacagagcaaaaccccgtctctaaaatacaagataaaatattggtgtagcttttggatacaactggactacagcggtcagtataaaatacatgtcgcttttaaggaagtgcttcttcagtgtatctaacagagggaagttattggcatgggataagagcatttatatatgctctcgtatgcaggggttaattggatttcgtgtccatatctggtcaaactaggtttcatactcctaatttaactctctaagctacaaggcttaaacacttggcataccaaa

SEQ ID NO: 714294 - DNA, 347 bp, Homo sapiens
  misc_feature (40)..(40): n is a, c, g, or t
cgtataagcgcaggtcgtgtctgtctactgagcgagcttngtgagcatcaggaagagatggagaagatctctcactaaaatgcggtgatgtggtggtaaattgcagtccatccagcggggccttctgggctgcctcaagtacctgtacacgggggagctagatgagaacgagcgtgaactcatgcacattggccacattgctgagctgctcgaggtctttgatctgcgcatgatggtggccaacatttctcaacaattaggccttcatgaaccaggagatcaccaaggccttccacgtccgccggaacaaccgggttaaaggagtgcttggccaaaagggcaccttc

SEQ ID NO: 714295 - DNA, 106 bp, Homo sapiens
cggcattggggactcaaggcctccatctttccaccctagggtgtccagcagccatgagaatctggagcctgagacagaaaccgagtcagtagtgtcactgaggcgg

SEQ ID NO: 714296 - DNA, 560 bp, Homo sapiens
gacatcgaactgcgggcccatctgaggacggcgcagatgcgcgccgccggccacccgccgcacctggtctcgcgctcgtccagccgccacatgtattggagcgaggcgcagatggtcacccaccacaccatcaacgggtgtgacctacgcccgggcgacctgctcggcaccggcaccctgtccggacccaccccgggttccgaaggcactctgatggagctcagtcacggcggaaacgaccccatcacattgcccaacggcgaaattcggacgtttgtcgaagacggcgacgaagtcctgctgacggccagagctcgccgcccaggcgccgccagcatcggattcggtgaatgcgtggccgtggtccaaccggcgatcacctacccgtgacttcagcggcgtcatgcatcaggcggtgcgccatctcgtcgtccacgtcggcgaagaagccgccgatcacgtcttcgatctcagtgaatcctctggcgcagaaaagaactggttgatagtgcgtgatgtcgtaggtctgcacccccattcggccgatgtcgagcggccgc

SEQ ID NO: 714297 - DNA, 97 bp, Homo sapiens
  misc_feature (7)..(7): n is a, c, g, or t
  misc_feature (31)..(31): n is a, c, g, or t
tgggaangtcagttctgttttaagtaacagnctgtccccttaatccaagcctaggttttcacacttctagtaagcctctccctgcccgccaacacat

SEQ ID NO: 714298 - DNA, 358 bp, Homo sapiens
gtgtggtgttccagtagaggcaggttcaccaggtggtccatattcgtctcgaacaccggacctcaggtgatccacccacctgggcctcccaaagggcggggattataggtgtgagccacagcacccggctcactttaaggtttggacccttcattcacattttggtatgcagcaccattgtcagtgattttaatatacataggggaaatgggagtgtggtttactccccatgagcatgactgagtggatgtgctacagaatggtatgtatcccaccggcttattttagtctcttggtttctccccagttgtaaagccaatggcatctttcgaaaattccgatagttgtaaatggcggg

SEQ ID NO: 714299 - DNA, 195 bp, Homo sapiens
ctctcgcggatcccctcttctcccctgacaccaagtacctgtctcattagtgtcactagtaaatcagtccgtatcgagcccagatacagcagcctgtaacgtcgcgcaaaaactcataaatgttagttatgatcatagttaaaattgtgtcattctgatttcttataaacctgagacccatgggcaccagattgc

SEQ ID NO: 714300 - DNA, 233 bp, Homo sapiens
tcacacagcagctaacagtacagtacaagcacaatgaatgactatctcttaccagtaccatactgttttgtactactgtgtacgtgatacagacctcatagttgtgcactgcaactggtttatttacatagttaattcctgcggtctgatatgtaatgatttttgtgctttcaattcttctcttaatatagcatcctattaactcacacagctgagagggggacgagcccaaa

SEQ ID NO: 714301 - DNA, 758 bp, Homo sapiens
tcatggtgagtggacatcctgccataacaaggaccgaaaggttcggtgcgcacatggtagcccaagagccagagatatctacctgaggctgtatggtcaagttatacatggttatctgtgccagaagaaccaactccacattcacaccaggtattgatgtttgaaggaggtattggtttagtgatggtcagctaccaaacctggctctgcactacatgtccccgtttgccgctgggacttgatcctgtgagagggatgaatggcattccatggtccgtggacaaatcatagacgtggccgtgcgttatgatgtggagaccaataaatcgttgacttgacctgtagctgcgagatatcaagagacgagtacccccaaagaccttggaacgtgtactagcttgcaaccttgccagcggttgagcccatggcccctgtgtgcccctgccacggaccggctatccctcacgtggccagaggtagtgcaacgaaatcgctcatcttttctgaccaggctttggccactgagtacctcgcccccagtaaaagggggggccttggcttgtggccgagccgtgttcccttggctttccattccaggggtccagtcgctacacgggggcccagacagaatggatgataacctggtcacttatctgggcaataggaccaccagtgaaaccacccggcaacagagacaacaagcccaaaaccgcccgtaacagagtcccgggcatccccaaaggggcgcccgggaaaag

SEQ ID NO: 714302 - DNA, 159 bp, Homo sapiens
caatggatcctcgttttttatttattgtggactcattccaattacaggggctcgtgagagttctgtattgttaccccttcgtcactaccttcccgggtcggtagtgggtaatttgcgcgccggctaccacattcaaggaaggcagaagacgttacgtgt

SEQ ID NO: 714303 - DNA, 792 bp, Homo sapiens
  misc_feature (561)..(561): n is a, c, g, or t
gcaggtgggctccgaggtgcaaagtgggaagtgtgagtcctcagtcttgggctattcggacacgtgcctgccggacatgggacgactggagggtcagcgagtcgtggagtccgtggccttttgcgtccacgggtgggaaattggtcattgccactggcagggtaactggagactcaggcggccccccggccgtttctctatccgtccaccggactcgtgggacgctcgcagtggtgctgatgtagtttcctgatcctctgacccgtattgtctccagattaagaggtacgaccatttggaggcccgagcggagaaatcgtcaccgggagaaacgtcaccggggcgagagccgggcccgctgtgtgctcccccggaaggacagccagctatgtagggggggagtgtcacgctgaaagacaaatttcctacggtccccaaagggtgaacgtcttccggaggacagctggatcgaataccatgtgtggtgtgcacgaaaaattgcacctcgtgagtcctcaaagtgctgaccccggggtcagttccagagagaaggactccctncctgcttggaagagactcacaccgtcatccacgatgccaacggtctgaaggtggatggattcctggcgtggattcatcactcccgcattcaaaaaggccaacggagccaactagaaacatgggtcccaagggtgggtcaaggccctttaaatgacctaagttgggtgaagcccttacaattaattctttttctattttggaaaacaatgcttagttttggcaactttgttt

SEQ ID NO: 714304 - DNA, 271 bp, Homo sapiens
  misc_feature (1)..(1): n is a, c, g, or t
nctggccaggctctctacgggagacagcatcagatcccacaggtggaggcctcggtccccaggacggtcccacttctggaggtcaatcaaaagccccaggcggtaaccggggcttctgggcagaccagatatgaatgggggttcccacaacccactccgggggtttaatggattggttaggagggctcacaaaactcaaggaaacactttccttaggtgcacgggtttatagtaaaggatatggcaaaggatacagatgaagagcgggcaa

SEQ ID NO: 714305 - DNA, 220 bp, Homo sapiens
agcccaggagttcaagaccagactggacaacatagcaagatcccatcactacaaaaaaataatttaaaaataaattagccaggcatggtggcatgtgcctgtgatcccagccacacttgggaggctgaggtgggagaatcacttgagctcagtgagccatgatcatgccacatgacactctagcctgggtaacagagtgtgataccatctcttaaaaaaa

SEQ ID NO: 714306 - DNA, 825 bp, Homo sapiens
agaggccttagcaatgatttggtttttttcttaagagacgggagtcttggtgtgtgctcaggctggacttgaactcctgggctcaaatgttcttcctgccttagccttctaagtagctgggactacaggagtgcatccctgtacctgccttggttttttcttgtatgatacataataattgtacatattatgttatttttttttttggagacagcgtcttactctatcgtctaggctgagtgcaggggcccaatcatggctcacattcagcctcaacctccggggctcaagcaatcctcctgcctcagcctcctgagtagctgggaccataggcgcgtgccaccatgcccagctaatttttatattttttggtagagacgggatctgctatgtggcccacactagtctcaaactcctggtctcaagcgatcctcctgactgggcctcccaaagtgctgggattacaggcgtgagccacccagttaagtgagtataatttataaatagccctatgtgacaaggggctacttttatgggccaggcgtcagcatctaaggattcactccctccaaggttgggcactccacaaagacttacctccgaagtgggcacccacgcggggggcaataccgggccagggtggataccaactcacagactacggacaggaacacaatccatccagtaaccatcggcacggtctccgcagcccacatcaaaggtcaaagccgacataacgggcccccttcaaccacgacccaacacagacaacaccaccctcgacaccacacacacacagaaacaccgcggggcgccgaccgcgaa

SEQ ID NO: 714307 - DNA, 337 bp, Homo sapiens
tcttcacgaggcattttgtaaaacacacatacaatgcggtagattttggcaccacatcctataacgacacacaaattatgcttgatatgtacaaagctgatctcacgacgagctccccaggacctttcaaattcctggatacactgttccagatgtcaatgatgaagtgtgtacattcaccatagagatgtcggcattcggatatgtgttcccttcatacacattaattctgccatcattagagctgtcagtccttcatgtccctagtgtcaagctttctcttccagatttcaaggaattgcgtaccataagccatatttttattcctgcctgggct

SEQ ID NO: 714308 - DNA, 705 bp, Homo sapiens
  misc_feature (435)..(435): n is a, c, g, or t
gacattcatagataagaggtgcctgctatttcttcgaacgtcttatggagggcatatacaatgattaagacagtcgggcttatctagggctatcaacgttgggaagatgatgtactatatatcgctactcagaaagattggctcctaaccatgaatactacagacctgactactgtctagcagaggatgtaggcggtacatcggctccaaacatggtctgtcttgcttctagctcataggcgagacgcatcgattgtagaccatcttgctgtatagggagctttgtgcgacgagctcacgtattggatgaacactcgatttggagactgagccatatcttacatatcacatgtttatgaccacccccaattctgtggactgttctaccatagacttaagtactgctaaggttgtatatccaactgcagacacagngtttcataggtgctgtggacgcaggcgatctatgatcgctgagttccacaagcgggatgtactttttatcatgacaacgctctcgctgtgacataccactatactgcctgcagacgcgtgacctggctgactaacatatatctgacgttatggcgcgctgatatgtgcttaccatggttagacgatagaagtcattgtgacgcacgaatattgtggatacatcctctctctggtgagagatctggacattgcattactgtgcggacagac

SEQ ID NO: 714309 - DNA, 191 bp, Homo sapiens
ataggataagcggataaggggctggaccagagaatcagagcggcaggtatggaggcagggtggaggctatggtgatgggtaggtgagagggatgggaaggaaggagatatagaggagaagtccacctggtgtgactagagtagaggcccctgggggtcagcgcttgccatgtagaggggtggagtccccag

SEQ ID NO: 714310 - DNA, 110 bp, Homo sapiens
ccataaaatgcacttccctgtaattcagcatattgctgttccactgtagactctggaaagtggttaccaataccccacaggccccttcggtgttcttttgcaaccggata

SEQ ID NO: 714311 - DNA, 173 bp, Homo sapiens
agaaccttctgcgcacattctttctagttccactccatttagtttcttgcctttgtgtgatcctgatctatctcttcctttcaaacttttacaaagttcagctggtgacttcctttttctcgcggtattttcccctgtgcttctgttgacccttcttgaaggtttcctgtggt

SEQ ID NO: 714312 - DNA, 1078 bp, Homo sapiens
gtaaagctgaaaataaaaccagggtttctatttatcttttttttttttaatgttgcactgtgtagtttcattacaaaagatcagatcatgaaaggcagtaactctccaggacgggaatatctgattgctcaggtgttaatagtagtctcaggctggtggtgagatggttaaacaggggtgcaagacgtgtggcttctctttttttatagatatttttctatctctcacttctcagggatgacaattcttttccaaagtttggaagttccttgcaacttagccgtgatgtgagtggttatccctagataaaattaacaaggatttttaaaaaggtaattactggcacttaaaatgataaataggtaattggacatactttatttaaagctcctgggttaattatttggtctatggtctcagctataaattcaaatttatacatactatggagtattaatattctcggatttcaggcagaatctgtcagtcacatgatgattatgtctcggtcttaacattctttccatgcactggtcattccatcaattggctgaatgctgagaccagaccagggtctacagattctcatggtcagaaaatctaataaagttctggccctttttacacatggctgcctctacgaaaaacaacagcggtaaattattagccaaaaagagagcccaaaaaattcccaatttcacgtgtgtacccaagaaactggttctggggaggcattactcttcccaaatccttaattccatctggggggggcagccttggggcggggggccaaatcacggggttgccacacgctcatcgcgagcagcagctctcggtgtcttctcctaccccctggagcggcgcggctccacacacgccttcgtcacagcgggagactactgcgtgctgcgctgcaccacacaacaggacagggcggcttgccactacgtcggtcttctatctccaacaaaaacgcaatgaccgcatgcactgattgtcgttgtctcctatctcatagctctgctgcatgacctgacatcacacatccagacaaagcgcaccccagacgcgagacggt

SEQ ID NO: 714313 - DNA, 1030 bp, Homo sapiens
atttagctgttccccaagccattttccgtccgtccccctaacaacgcccccgtccataagtactaactaccatgactcactaccccgtcacgaagtcatggcaagccaacgccacttatccagtgaaccactatcacgaaaaaaactctaccatctcgtatactactctccctacacatctccttgaattataaccattcacagccacagaactaatcatatctatatcattcattcgaaaccacacattatccccaaccttggactatcatcaacccgatgaggacaaccagacagaacgcctgaacgccaggcacatacgtcctattgctacaccctagctaggctcccttcccctactcatcgcactgataacactcacaacaccctaggctcaataaccattctactactcactctcactgcccaaagacactatccccacatcctgacgccaaccaacctcactactgacccagcacacaccaacagccccaactcagaacacccacacccctcgacagggcaacccgcaaatgaccgcccaacagcccagccagaaagacccccacatcgcacgcgaccagatcagatacaccggccagcaagctacatcatacaacactacagacggactcaagaaatacactaagcgaacaaaactcaatcatcaaaacacccgccaacacacccatcaggacgagaccacacctggaaccaaccacaatgacgcacaaagacaacacatccaacagccacacacacaccgacacaaaccccacggacacacacacacgcacaaaacccaaacaccacaaacaaaccacacacgaaaacacggcaggcaccacccccacagacagacccaccacaaaccacaatgccgcaaccacgaagacgcgcaccaacgaccacccaacacaagaaagtccaccagccactgactcccagccagtcgcccacaaacagaaacgacgagcaacacaccagcaacaaacatcaacaaaccacagaaccaccgcagacgcac

SEQ ID NO: 714314 - DNA, 164 bp, Homo sapiens
cccccccccttttccccccccggtttttgaaccgggccaattcccccgttttttttccaaacttttaaaagggccccttgtttttgggcctccccccccccaaccccttttttttttttttggtttaacccccaaaggggccttaattttttttttttggccca

SEQ ID NO: 714315 - DNA, 190 bp, Homo sapiens
  misc_feature (126)..(126): n is a, c, g, or t
tgctatttatgttttgttttaattctgatgtacttcattggtgaactgtcttttcctctcatactctacacttggctacagatgacagagctttggtagttaaacaattgagttaaaggattattntagtgttggttagggctcaattagcttattatgtttgggaatcagtatgtatgatctaagcaca

SEQ ID NO: 714316 - DNA, 137 bp, Homo sapiens
  misc_feature (71)..(71): n is a, c, g, or t
atgtgtttcaccagagccacagcaacacgggatcgagccacgtctgcaacctacaccacagctcatggcantgccggatccttaacccactgagcaaggccaggatcgaacccgcacccacatagttcagcgtctga

SEQ ID NO: 714317 - DNA, 105 bp, Homo sapiens
ccccccccctttttccggccagttttttcagctttacagaacgggattaaaagtttctagggaaacctttttaccgggccaaaaaaaataccattttttcaaata

SEQ ID NO: 714318 - DNA, 119 bp, Homo sapiens
tacaatcgagctccctaccgtatcgaaacctcctgcggaaagcaatataagaggccccaaataaccccgtgtaaattggctgtagtggtctacttgtatacgggtttagggtttgatga

SEQ ID NO: 714319 - DNA, 142 bp, Homo sapiens
tcatgtccggaagagtatatagttagaagaggatagctattagaaggagttatggatgcggttgctatgcgtgaggaaatacttgatggcagcttctgtggaacgagggttcatttttctctggttagaactggcaataaaa

SEQ ID NO: 714320 - DNA, 182 bp, Homo sapiens
tttcctttcaattcattccacaggtagcatgcactatttcaggcacaccatagttttcatcactagtcatatttattcacattcacacagccacagtgccgttgcatagtcacattcccatagtaccatccatatgcttcacaccctctatatgggcatgcaggatgcagttcattcaatgc

SEQ ID NO: 714321 - DNA, 100 bp, Homo sapiens
taccgtgaatgatgccgcaccatccgctaccgacccctcatcaaggtgaatgataccattcagattgatttagagactggcaagattactgatttcatca

SEQ ID NO: 714322 - DNA, 322 bp, Homo sapiens
ccccccccgttttttttttgggggggaggattttttttttaaggggggaaggggtttttttttattttttgcggggaagattttttttcccccctttttttaaatttttttaaaaaaaattttttcccaggttttttttttttttttttttttttttaaagggccctttaagttttttttgggccccctgggttttgggaaaaaaaagaaaaaaaaatttttttttttggggcccccttttttttgggtttttttttttctttttttttttttttttttttgggattttaaaaaaacgtttttttttttttttttttttcca

SEQ ID NO: 714323 - DNA, 652 bp, Homo sapiens
  misc_feature (339)..(339): n is a, c, g, or t
  misc_feature (347)..(347): n is a, c, g, or t
gggattgtcctttgggtatatacccagtaatcggatggctgggtcaaatggtatttccagttctagatccctgaggaatcgccacactgacttccacactggttgaactagtttacagtcccaccaacagtgtcaaagtgtccctatttctccaaatcctctccagcacctgtggtttccggactttttaaataattgcaatcttactggtggtgaaagggtatctaatggtggttttgtttgcgattctctgatggcagtgatgtgagcatggttcatgtgtttttgggtgcataaatgtctcttttgagaagtgtctgtcataaaaaaaaaaaaaanacaaaaanaaaacaaaacaaaacaaaaaacaaaactttaaaaaaaaacccaaaaaaaaaaaaactgttggccgcttgcccaatcaatttaacttgagcaagcttatcattgggccgaatttggttaattggccaattcgcctaaggggggccttttccaataaatgcccggcttttaaacttcggaatggtaaaacttggggtccccaactaaacccttggaagaaaaccccttttcccagtgggctaattccaaaggcccccaccgaacggttttcattgccaacttaatggccaatgatttcctttttttt

SEQ ID NO: 714324 - DNA, 105 bp, Homo sapiens
gccaggtgaagttggtacctacaattgataaccccgtgaggaggacagaattgcccaggtagcatgctagcagcaagcaggatggatgacatacccaatctatga

SEQ ID NO: 714325 - DNA, 638 bp, Homo sapiens
  misc_feature (513)..(513): n is a, c, g, or t
  misc_feature (516)..(516): n is a, c, g, or t
  misc_feature (521)..(521): n is a, c, g, or t
  misc_feature (607)..(607): n is a, c, g, or t
gtcaagaaaagggggtaagaaggaactgaagaatgtggaatgagcataaaggagagaaaagtcaataaaataaggaagtgaaaaaaactgaaaagagggcagttatcagttactgaagttttaccagaaagagaaactcatggtggtgacattcaaagtgcggccacgggagtaagctgctggaatgtaataaagtcactgggcagaagtccaaggtatcagcaaggtatcagaaagatcatccaaagatgacaacaggagttgaggtagacagaaagaccatgagcaagatatcaagttaggctctctggcctttaacactcacccctattattaaaggccaaaaacactttaaaattcaagtaggttatgaaaagaattgcctccaaaaacatattgactaatgtgggactaacctagcttggtttttatcctcattactcacttgaaaagccatgcattggcttttaaacaaaatagaaaataatttttaaatttttataaaatgcctanggnaagtngaaattttttatacaattagaatacatgggcaaatatttaaccacatgaatccttggtgagacttcatatttaccttatgaaaagnaaccgaattagcttaaacttcatttgcctaa

SEQ ID NO: 714326 - DNA, 848 bp, Homo sapiens
gactccaatctctgccttctgctctgtcttcacacggccttccctctgtgtctctgtgtcctcttctcctcttataaggacaacagtgatgagatttgaggcctaccccgcatgcagataatctgatctcaagattatcaccttaattacatctgtaaaagaccttattcctaaataaagttgccctctgagttctgagtggacatgaatttgcagggcaggctactcttcaacccactatgcatgtacttccctgctctgaggcccataaaagccccaggctcagccagagcaggacagaggacagagagatgaccagaaaggatggatgactagctgcaaagaggagctaccatctctgctggatagcggcagacaacaggataaccagctgcagagaggaaccgcccactccagggcctcctctctgctgagaactgaacactcaacaggacgacctttcccacagagaggagctacccactgtgtgtctcctctgagctattctaacacttcaataaaactcctgcttcaatctgttaacctttctaaaaaaaaaaacaagcagcaacaacgtctcgacacggcccacaacgcatcacctcgcaccaccacaccgaaccaacggcggccacgccaaacgacacacaacaacaacgaaaagctgtggggggggcggccccccaggcaaaaatacacaacactggtgtgggcgcggccaccccaaagatgaattggaccacggttcgcacaacaggcgcagagaggggtggcttccacccaaaaaagcccgcggcgcggcgaccacacacaggggcggcacggtcttcaacgacagccatacggcc

SEQ ID NO: 714327 - DNA, 343 bp, Homo sapiens
  misc_feature (294)..(294): n is a, c, g, or t
ttgtacgtagaagatactgtcatcttttaggacaaagtattgtaaaattatctgttttagcccatgttctgatgacccacagctctgtcacctttgagcatcatctccccattctaagtttttttcccacttaattcctaaccctgcctctttgagggaagcccattgacggggcaattaaaaccttctcattgctcctgaggaccaggaacgggcaaggatgtttcctttcaggaagctgaggagccacaagggagggacaggcagtgaggcatctggcacaggaaacgaggntcaggaggacgcccgtgtttcagtggggaggcacgccgatgggggttgg

SEQ ID NO: 714328 - DNA, 153 bp, Homo sapiens
agtgcatggtatgcagatggcgtctcccagggagtcaagtggttgatgcatgtgatggcgttagcttgcatgatcatatcggatgctatgatgagtaattggttacttacattgtccacaatgtctcaagttagacgcaatgtgtctagtagg

SEQ ID NO: 714329 - DNA, 184 bp, Homo sapiens
agacgatcccttatagtgtgccgtaatatgtttagtgatgccatctaggaggtgaagtggagagcacaggatcagatatacatattgagaactagaatggactctggcagccaggtcggggcagacttccagggtgccacaggctgtgaggctatcgactagccatcctggacaggcagaagta

SEQ ID NO: 714330 - DNA, 139 bp, Homo sapiens
ttcaaatgttaagaacgggaagaatgggtggcaatggtggctcctgtgaaagctcacccagcacaggtgccctgagctcggagccttggtttcctgtccctgggggaggatttattatttacataacaattttttatat

SEQ ID NO: 714331 - DNA, 584 bp, Homo sapiens
  misc_feature (29)..(29): n is a, c, g, or t
  misc_feature (33)..(33): n is a, c, g, or t
cccggcggccgagtgattggcgagccacnagtnttatggacggttccccaccgtggtccggctggcgggcaacgaggtgccccaggacagagtgatttacggcaaagaccttctgcccttgcttctgggggcagcccaacactcagaccacgagttcctgatgcattattgtgagaggtttttgccgcagccaggtggcatcaacgggacagaaggaacaatgtggaaagtcccctttgtgacgcctgtgttccagccaaagggagccggtgcctgctatggaaaaaaggtttgcccgtgctttggggaaaaagtagtcccccccgatccccctttggtttttggcctttcaaaagacccttttgagacccacatcctccccccagcctcagaggccgtgttttatcaggtgatggaacgagtccagcaggcggtgtgggaacaccaacggacactcagcccagttcctttgcagctgggcagggtgggcaatatttggagaccgtgggtgcagccctgctgtgggccgttccccctttggtggggccttagggaagatgacccccaataaatgtttgcagtga

SEQ ID NO: 714332 - DNA, 533 bp, Homo sapiens
gttatgaagttctggtatcctgtcgagtcttcgcgtctctggcaaggatcttgtaccaaactacattctttcatattaccttgtataatcatgtgtgctatgtggccggaacaaagtgacaaatggcctacagctgatgagagcaaatggacatctcctccgtgaactctgagaagatgtcaaaatccacagggcaacttcctcactttgatcccaaagctattgacaaagttgttcagcagactggaatgcgttttggctctggcatgactgctggtgacactgttagaagatgccaacctttgtggaacgccaatggccagatgcatggtattctccgtttctgtacaccttgggttagacgtgggtgaacacgaaactggcttgccaaggctggggacagtccctaagaagctggttccgtgccaggcagctttcaactgactacgcagtttttggccacgtgaaatgggaattggcggtgaactttattagagataaccagaatcaacgagactacttgacaagagaca

SEQ ID NO: 714333 - DNA, 168 bp, Homo sapiens
tcgccgccagagacggttgatagcccggacaggctatgtctgatccccgggctggtactgtgcttcagcggaggtgaatgtagtcctccaggaagtactgcaggtactctataggtaggcctcatcctccgggtccacgacggccagagtctgctctccatggcctcc

SEQ ID NO: 714334 - DNA, 434 bp, Homo sapiens
tatagtcagtcagcatagcaacctctcctctggacactagtgtagagagcaggcacgtgttccatggtctcaggccttcctgaatacatccttattatgctatgattcctccatttctcttctattacagctactcctagtgtctaggcgtcagctctaggtccccgagtcgctgcgctgaactaaacgccgagcccagtctagccagcgcgtttccagccacaagatccagcccatgacccctaacaggggccctactcagacctcgtaatgacctccggcctagccatggtgatctcacttccactccataacgctcctcatactagggctcttaaccaacacactatccatataccaatgatggcgcgatgtcacacgagaaagcactataccaaggccaaacacacaacatctgtcgggctagtcggggt

SEQ ID NO: 714335 - DNA, 110 bp, Homo sapiens
  misc_feature (34)..(34): n is a, c, g, or t
ggggacgcgacgctgacgggaaagctgagtgctngtgtgggatctcgctgtatcctcagtcgggccgggaataaactttacagctcaggcacggggttctggttggtgta

SEQ ID NO: 714336 - DNA, 189 bp, Homo sapiens
ggcgactcctgtgggcggtacggcgaggtacgacggcttgctacaagtcatcaaaaagctattagtgggagtagagtttgacatcgtccttgacgagaggattatgatgcgactgtgagtgcgtccgtcagtttgagttatgctaggcagacatagtaatcgaggatgtaacgcccgtgggctgattat

SEQ ID NO: 714337 - DNA, 152 bp, Homo sapiens
gagcagaatgacagaaactgacttcagagcaacttccaaattgcatactgctgcctagaagttgctctgaagtcagtttctatcagtgctgctctttgattcaaagcactgcccctctcactgggcctccaaccatgttcccttcttcttag

SEQ ID NO: 714338 - DNA, 663 bp, Homo sapiens
  misc_feature (3)..(3): n is a, c, g, or t
  misc_feature (79)..(79): n is a, c, g, or t
  misc_feature (83)..(83): n is a, c, g, or t
  misc_feature (217)..(217): n is a, c, g, or t
  misc_feature (221)..(221): n is a, c, g, or t
  misc_feature (226)..(227): n is a, c, g, or t
  misc_feature (229)..(231): n is a, c, g, or t
  misc_feature (238)..(238): n is a, c, g, or t
  misc_feature (259)..(259): n is a, c, g, or t
  misc_feature (265)..(265): n is a, c, g, or t
  misc_feature (443)..(443): n is a, c, g, or t
  misc_feature (445)..(445): n is a, c, g, or t
  misc_feature (455)..(455): n is a, c, g, or t
  misc_feature (457)..(458): n is a, c, g, or t
  misc_feature (460)..(461): n is a, c, g, or t
  misc_feature (463)..(463): n is a, c, g, or t
  misc_feature (476)..(476): n is a, c, g, or t
  misc_feature (480)..(480): n is a, c, g, or t
  misc_feature (492)..(492): n is a, c, g, or t
  misc_feature (498)..(498): n is a, c, g, or t
  misc_feature (508)..(508): n is a, c, g, or t
  misc_feature (511)..(511): n is a, c, g, or t
  misc_feature (587)..(587): n is a, c, g, or t
  misc_feature (606)..(606): n is a, c, g, or t
gtngtactgggctgccacctcggagggtggatggtcttgaccagttagggtcttcacgaagatttgcatcccacctctnaganggagcaccaggtgcagggtggactctttctgagatgtccgtacgatcacgcagagggtgcgtgccatgcgttccagctgttcttctcatgcaaagatcaacctctgctggtcaggagggatgccttctttgttngganttttnntnnnattctcnatggtgttactgggctccacntcgagngtgatggtcttaccagttagggtcttcacgaagatctgcatcccacctctaagacggagcaccaggtgcagggtggactctttctggatgttgtggttagagagggtgcgtgccatgcttccagctgttttccagcaaagatcaacctctgctggtcaggagggatgccttccttgtntnggatctttgncnngnngntctcaatggtgtnactnggctccacttcnagagtnatggtcttancanttagggtcttcacgaagatctgcatcccacctctaagacggagcaccaggtgcagggtggactctttctggatgtngtagttagagagggtgcgnccatcttccagctgttttccagcaaagatcaacctctgctggtcaggagggatgcct

SEQ ID NO: 714339 - DNA, 858 bp, Homo sapiens
aaaatgtggaagtgaatttggaactgggtaacaggcagaggtgaacagttgcaggctgcggaagaagacagaaaaatgtgaggaagttggaacttcctagagacttgcagaatggtttagaggaaaatgctgatagtgacatggacaatgaagtccaggctgaggtggtctcatatggagatgaagaactcgtggggaactggagtaaaggtgactcttgctatgcaaagagactgatggcattttgcccctgccctagaaatctgtggaactttaaacttgagagacatagtttagggtatctggcagaagaaattcctaagtagcaaagtgttcaagaggaagcaaagcataaaagttttaagaaattttgcagcttgatgatgagatagaaaaggaaaacccattttctggagagaaattcaagccagctgcagaaatttgcataagtaaagaggagctgaatattaatcaccaagacaatgggaaaatgtcttcagggcatgtcagagaccttcaaggcaactcaaaccatcacaggccaggaggcctaggaggaaaaaaatggtttcatgggcccagtgcagggacttgctgctctgtgcagtctcaggacttggttccctgtgtcccaatcatggctaaagggccaatgtacagctcaggccatggcttcagagggtaaaggccccaagccttggcagcttacatgaggcgtcgggcctgcgggtgcacagaagtcaagaatcgaggtctgggaatctacgcctaaattcagaggatgcatggaaacgcgtgggtgttcaggcacaaatttgtgcacaggggaccggagcctcatggggaactctggtaagg

SEQ ID NO: 714340 - DNA, 1072 bp, Homo sapiens
agcttgccagtttctgatcaagtttcatgaaaggaggaatgacacagatcatcgtctttgcctgacaatgctgttcgccctaaaggcaatatgccacttcgactgcacacaacaccctactactctacggcacctacgctctcagccggcggcacacagcgcatgcccccccttctctcagcaactttccacgcccacccacacctcccacaaattcacaccctccatctctccatatcccaaggctcacgctgcaccccctctcgctcccgccaccctgcccgcgcaaccccacactgctccctccacttccaccactcctccacttccccacctgcgctgcgccttcccacgcgccgctcccgcgacaccgcccccacaccccgcgcctacccggccggccctcgccctctcccgacgccctccccccccccggcgacctcggtccgccccacccccacgctacccccgtcgccccctctcccctcctaccctccaccctgcgcctaactccccacggcaacaaccacccaccgcacacaccgcgccccctcccccatccaaccccaccccccggcccgccacgcacatcccaccgccctcacccactcccccggcctctcctaccgccgttccccccgcgctcgccctctcccccacccaccctccaccctcgccccctcgcccactcgccgcgcacccgcaccctcgccgcccctcccccctcccctcgctcctccctcctcaccccccacccctgcccccgccccccctccacctcagcccactgcctccctgcgccctgtcccctcccttgcaactccccgtcaccctgccccccccccgccgcgcccgcgctggccctgcccccctcgcgcgcgcaacccctcagccgcacaccaccgacccccctccccctcacgcccgcacctcccaccgggccggccctgcactgcgccctcctcctctccacccttaccctacctccgctcactccgcctcccccccgctctgtgccactcctgcccgccctccacttgccccgctctcctcccccttctcccccgcaccc

SEQ ID NO: 714341 - DNA, 361 bp, Homo sapiens
acctgggaatcattacgatccctaacagctcatcctgcccttttaaaaccctcccttttcagggctgggtcagaatttaacctatttattgactgtccttagggcctttaaaacaggccgaacctggagggcctggatttctttttggggtggaaaactgccctaagggggggggtggcttttactcaggaaaattttgtgcccaacccatggacagggccaactgggggccccatgttgacacaaactccctcaaagacccttagacactgggccaggcctcctttcagccttttttttgtccaaatttccaaagctggataagttggtcctttattaaaaaaggaaaagccctttggga

SEQ ID NO: 714342 - DNA, 868 bp, Homo sapiens
tggaagctgcagtgagccaagatcacaccactgcactccagcctgggcgacagagactccatctcaaaaaaaaaaaaaaagtgtttaatgaacttacagtcccactgggctggggtgggcttcaagaatcatggcggaaggcaaggaggagcaagtcacttcttacttggatggcagcaggcagagagagcttgtgcagccaaaactcccatttttaaacctatcagatctcatgagacttattcactatcatgagaacagcttgggaaagacctgcccctatggaacggggtcccttccatgacacgtgagattggtgggagttaccaattcaagatgagatctggggggggacacagcccaaccatatcagaggccttggaaggaaccaaccctgccaacacctttgatgtggctgtgacctgtgaggacgtaaataaatctctgtgtttaaggccacctagctggtgatatttgttacaggagccctagcaaagtagcacactaaggcttaacaatgctgcgcggctgaatttggtcatgtgcacttatgccttctgactgtgggctgaaatgagccaggtggccaggtctggtgcccaacattggttcaaagcaccttctcaggaggcttccttatccatccagagaattgggcccttctcggactcggacctgtggagattctagagggcttggtttgccagttataagggcggcccggacaattacgggccagggcgaaccgctcccgggtcctggggagaccccgcttgcctgcggcgagaccgggtgtccaggggaaccggactccggaccggggggactcgccacgggcttttaattggcggtttcttgtcttcgctgg

SEQ ID NO: 714343 - DNA, 379 bp, Homo sapiens
  misc_feature (14)..(14): n is a, c, g, or t
  misc_feature (308)..(308): n is a, c, g, or t
ttggtttttcctantgtcaggcaatgcagttaacctttagcaatatagagcacttaagagttttgcaagccttgttttgcatccatttttctcctgcatagaacatttgattgtttcatctggttttcattttatacaatgatgtaggtagaggcaaactctaagacctggtaattacagcctcatggcagcccaactgatgcataagagacgtttgctaattacagtgatatgaaggctctccctcctctgaaggctcactgtgtttctttaaggtgtctcttttgttccttaatctagttgcttantacaagagtacattgatcaaactgctttctagtaacaaagcatattctcaaagaaatgttaattttacaaa

SEQ ID NO: 714344 - DNA, 1015 bp, Homo sapiens
taacacctttattcagatgtaattcgcaccatacagttcacctaaagtgtacaattcagtgtttttagtatactcagttgtataacccatcaccacaaataaatctttgagaagatttatgtgtgccaccacctcccaagaaaatcccgtgaactttatcagctgctcctcctccttcaccccatgcccttctgccctaccctacctagtcaacaactgatctattttctgtctctatagattgcctgtttgggacatttcatgtaaataaaatcatacaatatgtggaaaaaaaaaaaaaaacaaaaaaaaaggggaaacaaaaaaaaaacaaaaaaaacaaacaacttgtgtcggggcgcccgcgcagccacacggaaaaaaagctttaacgaaaccaaatcggtggtgggggaccaggccgccacaagtagtagtagtcaaccgagtggcctatggagtggtgccaaaaaggaagccacgcgggggaaacaaaaaaggaggggtggggtattctcaccccaaaaaaaaaagacgtgcgcgggggacagcccgacggcgcgttctagaacaacaaacacgacgggcgattgcaggcggccaataagcgcgggacttaacaaagagcgggtccacgaggcgaggtggaataaaaaatagcgccccgggcgggggcgatgaaagcagacaacgaatgacgacgtactaactatgagaggcaagcaggaagtagaaagagcagagcgacaagggacgagagagagcggccgacgggagaggagcaaagaataagacagggaaccaaaacagggagagcgtgaagaggacgaacgcgactaggggacgagaagagcagagagacgagcagagagcagcgaaagagacgcgagaagaaaaaagaaacgaagcctacggaggggcagcagacaagagaaaagaagaaaagacaaaggaatcgagccagaaaaggagaacagaggaagacgacagaagagacgaaacagcagaaaacgaa

SEQ ID NO: 714345 - DNA, 525 bp, Homo sapiens
  misc_feature (80)..(80): n is a, c, g, or t
  misc_feature (101)..(101): n is a, c, g, or t
  misc_feature (232)..(232): n is a, c, g, or t
atggctttctacatctggaatgtgatgaccttgacccctccaaggtagcatctgacaggtacccgactccttttcttggncaaacctctggcagggtgccntttctgttcaagggtaacagaggcattacccctttcagttgtcagatacttgtggtctcatttcttgaggaaaaggcaaaagccatctccttcttaactgtttctccaagagctagacagctccagaaatnctatggcagacccaggaaggacagagtccacagtccaggcaagacaacacagaagatcggctccctcgtgtacctgagtctgtctgcatcactctgtcacaggctagcactgggcctgctcatgtgaccttctgcagctgactggccagcagacacaggtcctgtgcccagcccaggttgcctggctcccctccagccttgttgcctctgtatatttctctagacaccctgtggctaattttattacaactgcacaatgtctgttgccattttgtattaaatatactgcaagg

SEQ ID NO: 714346 - DNA, 154 bp, Homo sapiens
agtgggtcaacggtcctcactatctgcttcatccgccaactaatatctcacttcgcatccaaacatcactttggcttcgaagccgccgcctgatactggcatttcgtagatgtggttagactttccgtatggatgcaaaaaaaacaacaaaaag

SEQ ID NO: 714347 - DNA, 791 bp, Homo sapiens
gatgaatacctaactggaccctttggcctgattgcacagtattcactattgaaggaacatgaagtggaaaaaatgttcacacttaaaggaaatcgtttgccggcagctgatgtgaagaatataagtggaaaagatgtacacactgtaaaggaaatccgtatgccggcagctgatgtgaagcaacctataatttacttgatgtcagacccaggctagagttgatggatataatcgcgtgaaaacgtgctcaggtgagaggatagacgaggcccaacgagagagttttcatatgtctgtcctgtgccacgccgtaacctgttgtgcgaacagcggttgcaaggactctgggtgtcttgggatccttgtattcacagggaggagtacagcttatgatctcattccattcgatggggatctcttgatccatggcaatcagagggtgcgttcaacagagtgctacctggagggtgaccagacgagcctgtaccacgcaggccaggggctgatgaccctgccagctctgtgtggaacgatgcccccagaatctttgggaaacggcgaatgcgctcggcaacgtggccaattatgattgatcaggatggaagagagagttagcgcggaaagacaagaatccaattattcccctgatctttcgataatctcctggttgcttgatcgggaatggtggctctattaaacaactctttgccaaatcagcctgacatataacaggatcattgattcaccttgtggtcttcaaacgatatctaaatacccaaagaaattggccc

SEQ ID NO: 714348 - DNA, 495 bp, Homo sapiens
ctaccgtatatcttgcatgccacgtttcagtcagcaggatgtggctctctagatagctgtgtttagaaggaatctgaggcttcagccttcagacaggggaaagactactgcgattgatagcaatatccaacatctcactcaagcgagaagaaaccaatggcaccaaaagttggcagcacagttggcacctggctgtcccaccaggaccaataatgggaccggccaaggtctgcgggaacctctggagcgggccattctggtggtatctggcccagaaggtacatggcattctggacccagggatctccaaaatctccttcctcatcccaggtcagcagctctaaactccatgtcattcccagctccagtgcccagatacaaggctcatctccaattcccattgcggggttcttgcaatcagcccggggcttcgggctcagttgcagacgatccaagaggatccagggctcatcttgagccctccatgaacgtgtg

SEQ ID NO: 714349 - DNA, 667 bp, Homo sapiens
  misc_feature (241)..(241): n is a, c, g, or t
gcggaggcggccgcccagctcgttttaagttctacggtttttgggccctgggtctggcggggcagggacatttccctaaaacccgcggggggcgtgggttggggtttttctgcgccacatacccctcgcggactttggcgcgggcccaagtggagtccaagactgtgggtgcccctccgtttcatcttcccccatctatgagccgttgaattggacccgctctgtggtggcccgtgaaaanctctatccccaagaggcccaagtacagtggaaggtgggttacgcccctccatcggggtctccccggagagtgtcccaaagcagggcagcaagggcggccccttcagcctcagcagccccctggcggtgagcaaagccggtttcgggaaacccaaagttttcgcctgggaagtcccccctcagggcctggggtcgcccgtcccaaaaaggttcccccggggggggggtttaagggggaagggcccccccctggtcctcagttccagcctggcccccccccctcctttgggctttggccctttttccccagggggccccccccttttgggggcccccgggtctttttttccccccccccccccccccccccggggttttattttggtaatgttggggggggatggattaataaaggggttttttgcca

SEQ ID NO: 714350 - DNA, 480 bp, Homo sapiens
tcgctattcatcggcacactgcaactacgactcctgggctcaagtgatcctcctgcctcagcctcctgagtagctaagactacaggcacatgccgccatgctcagctttttctttttttttttccctgaaatggagcctcgtcctgttgcccaggatggggtacaggggcacgatctcagctcattgcctctgcctccggggttttcaagtgactctccggcctcagcctccggagtagctgggaccacaagcaccgtgccaccaagcccagctaattttggcattttacgtagagagtgggtatcaccatgtgtgggccaggcgtggtctgaacttctgacctcaagtgactcaccggcctgggcctcccaaagggcgggggtaatgggggtgagaccaccaggctggtacaacggctcccttttaactgacttcttcccattcatccggccagtaaaatttctcaggggtgccgatga

SEQ ID NO: 714351 - DNA, 284 bp, Homo sapiens
tggttttgttgtgtgtgtgtgtgtgtgtttgagacagggtcttgctctgtcccctaggctggaatgcagtggcatgatcatagctcactgcagccttgaactcctgggctcaagggatcctcctgcctcagcctttcgagtagctgggaccacagccatgcaccaccatgtctggctaattttttcaattttttggtagagatgggatcttgctacattgccttgttacattgctacattgcctggtctcaaactcctggcctcagtaagagcaatccttccgc

SEQ ID NO: 714352 - DNA, 1446 bp, Homo sapiens
  misc_feature (1442)..(1442): n is a, c, g, or t
cgagaaacaaatggaggtctgaatctgggattcaaacctcattctgtctaactcaagagtcaaattttcatgatactcttctctgtctaggtctctgatatgactgttctttatatattttttttaattctgaggctttctatgtaatttaactttcctaatgattttgagtatttcccattccagcatatggccagcatttcatgttcccattggcaatgacaccaacactaggagaagtgacccctgcaatgtacaaatttcaaaatgtttataaacacacttgaccagaagaatgttttatcttctgtgtaatgccagttatcaaaaattaaataatcacatgtgttctagaggaagtgaagattgaaaaagaatcgcaaatgaagacaatagaatgaaaagattatatggatctagatgtaaatgtgcaacttaagcaatccacatgacaggaacacttaatcctgtatcaggagagaaaatgagttaaatatgaatttaggaccataccctaatgaaattcaatgtcaagataaacctaatagtctgtcattggcatactttacatttgttctgtaaaaggcaaagcctgaaaaaaagcaagttgcttataatcccataaatagaacttgaaataaataagaaatttatttttatatgaagatttcagttgcttttaccataacttgcttcatgtcatttctgtatatgtgtgtatatatatatgtgtgtgtgtgtatgtgtgtgtgtatgtgtgtattatacactagatttttacattttcatatgtgcatctgtattttacatctatatatattaaatatgtatatgttttacacacacacatacaccaaattttcatgactcattagggagaggtggctaacctactagaaagagcagtaaagaaaaaaaaaacccttttttttccaaaaatctgtctgtagatttcttccttcctcccttcctcccttccttcttttcctccctaccccagacatttcttgcacaaatgtttcctcttgccttaggaaaatgtatgatttctctcttgatgacactccatcaagctccttcttaggtttgcatccttagatgctaagatgcattgtgagtgcagaagagtggaggaaagtagaggcactcaccagggagaaggggcgacaggagcacagagactgggctgttgccttcggaatagcatctaagggcttggcaaagggtccacttggtttacatatttctcaaagtacctggggaggagggatgttgtcaataaaaacacacggatgaaggacactgaagaggaacatggagagaatggaaaacagtcatttcctcttgcgcaactttgccccaatgtagaggagtcctgcctgagataacatagaactttccctactatattgcccaaggagacatagtgggttgacatgttncagt

SEQ ID NO: 714353 - DNA, 1702 bp, Homo sapiens
  misc_feature (425)..(425): n is a, c, g, or t
  misc_feature (577)..(577): n is a, c, g, or t
  misc_feature (908)..(908): n is a, c, g, or t
  misc_feature (1156)..(1156): n is a, c, g, or t
  misc_feature (1702)..(1702): n is a, c, g, or t
ggccattgccatgtatcccaggaagtaggaccgtttcgtcgcgtgagtgtccactcgtcttcaattccttgcaacggtggatgtgcatatatactcttagctcagctgagacgtagagcctaagaaagtactggacataacgtcgtggaacgttgaggagtgcgatcattatacccgaactgagcgacaggcatagactggattcattgctccactgcacctcaccaacagggacgcacattgtctcttcgcatcgaggcacatgtgcgactgagcagccagttgcccgtgaactagaaccttagatgataggtaccacgagagacgggctctggctattccgatgacgcgtgtcagtgtcataacgcgtttaaatcgcatcgaatatcatcgtcggtcccattattcgtaggttcattgttgtngcactatctctgcgcacggagggtcgagcgatccctctctccttggggttctcaccaaaaagaatctcataagtgcagtgggcttgtgctaactgtctcgctcgcccaaagggcccgctcgcctattcgcgcctcgcttcctagagtcgccntacactccaactcgcggtcgaaggatggcgcagccccccataagagacgtaggcataagcgtttttggtagtgattgctccttcgagagcaaacaacttccccgtaagcgtatcagggaggcgtggctcacataggtctcgactttggacacgatctatcgtttgcggaattgcgtccctttgcattcgcatttctccaaaccaagaacgcgttatcaatgctcggtgctttcaaaccagaacataaacccgtttgtgggaaagaacctagactttggtaaggcagcctcggattcgttccggtggaccgtgcgaccgaacatagggggtngtgggctccgccggtaagcgaaggcaactttgaagacgaagcatggagagcgcaacttctagtggggcattcagacgccggctcgagtggaagccccaagagtttggggctcaaacgttcctcaggggaaccccctcatagtggaaatttcctctcacattgttgcccttgtgaaccctaggccctttaagggaaattccgtttggggctattcacccaatttacggacctcggatttgaattgacantttgtggtcaattcgcaagccctctccagattttctttcaactgaccatcatctgagagagaggtgcggttgggctaaaaagggcccctattggaatgcccccaggccttctaagacgcacaatttgtgctcgcccacattttttctcatgtttgcaccccaccagacaaggcgaaacttatcacaccagcagggttggggtctcctctcccgaaatatggcgtccaacggtctgtggacaacattggcctgccggagtacggttccatgcggccacctagtattgctgcttgcatttaggattgaacccctttgttatctcaaactactttattttgtaggcaatggttacgccataaccacgaagggtacttccttatctccccacacttgggatcttcgggaggggaacaaaccccaatagcacagggtggggcttttcaccacggagttcaaagggcacatccccactttgtcccggttccccctttttaatccaatttcccgccagtgggcgaaacttggtcaacaacaggttttgacatn

SEQ ID NO: 714354 - DNA, 126 bp, Homo sapiens
accaaaataccatgggatttgggttttcttctggagattaaagctgttttcttgggataagtgcagcagcaaaacagaaaccagttgatcaaaaaagcatttctgccataattccaataatttcag

SEQ ID NO: 714355 - DNA, 177 bp, Homo sapiens
aaaactcgggagggagggggcagggccctccccacccaataaaacagtttttttgcccttcccttgcaaagggggaacccacccaagtgtgtccccccggcggtggggggggagaaggggactgtgtgtgcaaacctcagttggaaaggggggggggttgggaaataaaggtttgca

SEQ ID NO: 714356 - DNA, 1414 bp, Homo sapiens
  misc_feature (1414)..(1414): n is a, c, g, or t
gctggcacggaaaaaggcaaggctgtctttggtcatcaggagtcccagcctgcttcagagtggggccaagaagaaagcacaggtgaggaaggcagggaagccctgagcacaggtacgggcccccctcagcccctgcctccatctgcctgagacgcctatttttttttttttttttaaaaccatgattttaaatacgcaagcgtgtttcataaggcgcgtgccacgtggggaggggtggctgatggccgccgtgcccgggaattcgtggctcgtggcaagcacagccgtgagccattccgtgcaggggttcccagggtgtgcaaaaaccttcccaacacccgcggttatcgtgggcgtgggacccgtgggtctccaggggccagtgttccagggggcatcgtgggtgattgagcacgtggagatgtggtgtgcagagtatgaatggtgcgtgagctatgacaggcaaggtgtgttgaaccaaatctgtcctcggtgaccctgtgccaacacactcttttgtgcgccacacagggcatataataaggcatgagttgtagggagaaagccaccacaagggggggtgtgaatatcaagaatgagagataaaagttacacttgacgatatgtagaaaagagaggcaagtaataaattgtggggagtgtacatactatcttataaagaaacattcgtgaaagaattgtgcaacaaaaataccaggaaaggcattctataaaaaagtatacagagggaagacagattagggggatttcccggaaaaggaaacaagtggagcgccacaaaaaacaaaacaaaacaacagtaaaaacaagcacaacaaaaccaaccacaaccaacaaccccaacgaaccaggaagaaaaaaggaacaggaagaaaaccaccagaagacggcgagagcagacaagtcgctagaagaggccagagcagaacaacccaaacgacacggagagcaacaagacaacaaggcacagggagtaaacagcagacaggaacggaaggacaaacgaaaacgatgaatatgataaggacccaaacgcagggtgagcagaaacacatagaagcggaggatctcaccacgaacaagagggcagaggcagacaacacccaagcacaacacacagacgacggggaacaacaccgacctgataaacgtaacgcggagacgagagaaaaagaaaggagaaacgcaacagcagcgagcagaacgaccggagaacgagaaagagcggggagcacagccgaccaaacgaagagacgaacaaaaagcagggggaagacgacgcaacgaaaggacgcgacgggacgaaagatacatacaggacgcacaagaagagaaacaaagaaaaggactcgaactagtaaagcacgaaccagatagagaagccacaggagcn

SEQ ID NO: 714357 - DNA, 393 bp, Homo sapiens
ccgagcgttagctcactcccttttcacactcagatccaccctcagcagatgataatatcaagacacctgccgagcgtctgcggggagcgtctgcgggggccgctttcaccctcagcggatgataatctcaagacacctttcgagcgtcagctcacttccctttcacacctcagcttcacaccttagcagatgataatatcaagacacctgccgagcgtctgcgggggccggtttcacaccttagcggatgagaatctcaagacacctttcgagcgtgaggttacttccctttcacaccttagattcacaccttagcagatgataatatcaagacacctgccgagcgtgtgcgggggccgctttcacccttagaggatgataatctcgaccctt

SEQ ID NO: 714358 - DNA, 468 bp, Homo sapiens
gactcccaggttcttttcccctcaactctttgaaggtaagctatgagaattagagaagaaaaaagaataagtggcaaatggaaaaaaagtagcaagatggtagggacttaaagcgaatcacgttgatattacatgaaatgtaagtggtctaaatactctaattaaaagtcagagacctagatttctccccccctgaaaaaaaaacagcaagagccaactatttgttttctacaaagacacaccttacatcataagacacagataagtcaaaaggatggaaaaagatataacatgaatgagaaagctgccaattgaacaaaattaacttcagaacaaatcttagaaccaaagcgtccttgatacaatgctttcccattcaccctcacatctagtaaatcagcaactgtggtgactttgtacagcaaggccctaaaactctttgaggggaaaagaccctggggtaccgag

SEQ ID NO: 714359 - DNA, 124 bp, Homo sapiens
gggaaagcgaggtggacattcatctgggtccactgagtctgagtcttcaagggtttcacctccagctaacacagaattttaaaagcacgtgtgcccactattacgcataaacaacggggccccc

SEQ ID NO: 714360 - DNA, 838 bp, Homo sapiens
acagagtgaccctgggggtgctcttgaccagacagccgcacgccccgtgcgtctagagacctccgagacagggatgcatctggaggtctagggaagacacttccagcccctcctctcctcaatcctggcaggcatggtgagtagttaacatcccgtcccgaaagccccgacttgatacagggatcccacagagttccaagcagattgacgagaggagcatccagagagatcaaccctaccagcctgtaaggaccattgatactccaaaggacagctgacagcaacgtccatgtagcctgcattattagcacacatatacataccgcaacagctgacaccagacacttgccaacgaatacacatccatatgagctgattcatcacatattccaggacttatgacactctcaaaaattccacaatgagcgcaagaaccttgatacccgacatggagaggacagagcgtgacacggataaacgaaagaaacgatcccccaagccacactacttcactcacacagcgcgccgaggcagcacacgcactgcgcataacccaaaggaatagcatcgcaagcaactgatcacagatcaccggccccacagaaccccatggcaatagcatctcccaactggcagagtcaagccatacggccggcgcgcaatcaaacagggaacgtgagagagcacaaagacacatgaccccccacaatatcccgtcacccgagaagcaaagacgtcacaaaacatcacacagaacaacggaaacgccatcgaacacggccttcgcaaaccacaccaacaatagaaccaaccaccctggaacgagagcacgaagaag

SEQ ID NO: 714361 - DNA, 3799 bp, Homo sapiens
gaaaaagaaggaaagggagagggagacggctggagcccgaggacgagcgcggagccgcgggccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcacagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagccaaaaaaaaaa

SEQ ID NO: 714362 - DNA, 4482 bp, Homo sapiens
gaaaaagaaggaaagggagagggagacggctggagcccgaggacgagcgcggagccgcgggccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccgtgccctaccccctcccattttgatggtgtctgtgacatttcctgttgtgaagtaaaagagggacccctgcgtcctgctcctttctcttgcagtctgcttgtccatgtgtctatttttccacttgtccatctgtccagtaagcaggtaatggtgacccatgctggtccgctcggacccccatcctcctctccccacagctgggccctgctcagctggtcctgctggatgcagtgcccctttggacccccttgtcgcctggcctcccactcccggccacctggcctggccagctctgccagctgttgctctgtcccggtgggagaaagtccagccaggcctccacttcccctggggcatcccaacctcagccctgcacagacccagcgtctgcccttatttgctcccctgcagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagccaaaaaaaaaa

SEQ ID NO: 714363 - DNA, 4981 bp, Homo sapiens
gaaaaagaaggaaagggagagggagacggctggagcccgaggacgagcgcggagccgcgggccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggggtgttatgatctacaggttgggaaacccctgttgtgggacagacactgtttccgcctctccacgcatggtcccgagatgctggggacagcactccgaggctaatggctccagctcactaggccgatcctgctgtgcccccgagctgctccctttcctgcacctcccaggaccgcccctccctgaactgctttccctgagccccttattcccgctcactccctcttggaggaccttggcctgttcatttgcagagaagatagaaatggccacacttatgaccccttagctcccccactcctccctacaggcccacccctgaggacacccaggccaccctgcctcctcccgtccgccccagagggaccagacacaggtccctgagccttggggagtccacaggctccccatcttctccttactgcatcccagcccacatctcagcccttccccatggcaggggctccccgcagacgatgccaccttccttgtccccgcagctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccgtgccctaccccctcccattttgatggtgtctgtgacatttcctgttgtgaagtaaaagagggacccctgcgtcctgctcctttctcttgcagtctgcttgtccatgtgtctatttttccacttgtccatctgtccagtaagcaggtaatggtgacccatgctggtccgctcggacccccatcctcctctccccacagctgggccctgctcagctggtcctgctggatgcagtgcccctttggacccccttgtcgcctggcctcccactcccggccacctggcctggccagctctgccagctgttgctctgtcccggtgggagaaagtccagccaggcctccacttcccctggggcatcccaacctcagccctgcacagacccagcgtctgcccttatttgctcccctgcagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagccaaaaaaaaaa

SEQ ID NO: 714364 - DNA, 1472 bp, Homo sapiens
gctttaagacagactctgccggcgccgtccggagccttagaaaccggccccgtgatctgcgagcctggagcctggagccggagcctggggcctggcctgggctgctgaggccctgagctggcaggagcgcagacgcggagcgctgagccaggctgcccagtctgctgagaatgctgccgccgcctctgccctgcccggcagaccgcaagcccctggtgctggatccaatgagggcatgggcactggcagtcagacattgacaggcagccaggcaagacccctggaaggggcagaacagcgttaggcagctgaagcaatcttgatccccagacaaggatcagcaggaccatgggggctgtgcgggatggcagcatgccccatgccccccaggggccccccttgtggacgcgccacccggccagcagggatcacaccaaacacattccaattgtggacaggcgcatatcaaaaaggagggtgagcaattgacgccatggggatgcggtgaattgcacggggaaagggggggcctcgcgggtgcactggcactggaacaagacccgtggcacaaaccacgcaatgcacaattgtggagcaccgagaacgtttccccaacccgtggtgcccccgctgagccgctggtacctgaaggcacccacaggcaggaagaccccaggagtccggagtgaaaccatcactggcacgatgtcaggcaagattccgatcctgggaccgacccagggacaggcattgaccccaaggaggaacaaggggaaggacggcgagcgaaggagaggggaacaacaccgcaaaaaggggaggagcccccggaaggggaaacaaggaagggaatgccgggggaaagggacaaaccgtgtagccgtatgcggggctgagcctagccaggacacgaaacccagagacacaaagcaaagtgcacagggcaaacgccaagcaggggggaaggagccgacaacggtataccggccagcatatccagccaaaagacccatagcaaggaatgggcaacagacgcctaaaaagggcccacgggtaacccaagaacgggagacccgagtcacccccgaccatggaaggccttagcgggcaagagcagaacagacgaagagatgggaccaaagcgaacaccggaaacaggagcggtgaagaacactctggcaacagcaaaccaggaaaaaccaaagaggcgaaccgccgagagacgtacccggcacaacgaccactggacaaagggtgggcacaagcaccgaattacacagcacataatgaggccaaagaggacacgaatgacgacggagaccctaaaccagggagcgccacaacggtagcaccaaacacaaccacaaaagcaatcaaaacacacagagacaagacgaacacaggataaccagaaaaacgaaacaaggacatacaagacgacatacgacacgaacgaaaaccacatccaccag

SEQ ID NO: 714365 - DNA, 4519 bp, Homo sapiens
gaaaaagaaggaaagggagagggagacggctggagcccgaggacgagcgcggagccgcgggccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcggctcgggaccgcccccctgagctggccccgccctccaggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccgtgccctaccccctcccattttgatggtgtctgtgacatttcctgttgtgaagtaaaagagggacccctgcgtcctgctcctttctcttgcagtctgcttgtccatgtgtctatttttccacttgtccatctgtccagtaagcaggtaatggtgacccatgctggtccgctcggacccccatcctcctctccccacagctgggccctgctcagctggtcctgctggatgcagtgcccctttggacccccttgtcgcctggcctcccactcccggccacctggcctggccagctctgccagctgttgctctgtcccggtgggagaaagtccagccaggcctccacttcccctggggcatcccaacctcagccctgcacagacccagcgtctgcccttatttgctcccctgcagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagccaaaaaaaaaa

SEQ ID NO: 714366 - DNA, 793 bp, Homo sapiens
  misc_feature (365)..(365): n is a, c, g, or t
  misc_feature (622)..(622): n is a, c, g, or t
  misc_feature (624)..(624): n is a, c, g, or t
  misc_feature (677)..(677): n is a, c, g, or t
  misc_feature (792)..(792): n is a, c, g, or t
gagacgcgcgggcgggaagatggcggctgggttcaaaaccgtggaacctctggagtattacaggagatttctgaaagagaactgccgtcctgatggaagagaacttggtgaattcagaaccacaactgtcaacatcgggttcaattagtaccgcagatggttctgctttagtgaagtgggggaaatactacagtaatctgtggagttaaagcagaattttgcagcacccatcaacagatgccccctgataaaggatacgttgttcctaatgtggatctaccacgccctgtgttcatcgagattccggtctggacctcctggagaagaggcccaagtggctagccagttcatttgcagatgtcatntgaaaaattcacagataattcagaacagaggacttatgcatgttctccaggaaagcttgtctggggttctatactggtgatctcattttgcctcgactacgatggaaacatttgtggatgcctgcacattgtgcttgtgctaggcgggtttaaaaactgtacagtttgcctgaagttacctataaatgaagaaactgtttagcagaagttaatttaaagaagaaaagttatttgaatattagaactcatccagttgnancttcctttgtgtgttgatgacactttgcttatagttgaccctactggggaggnggaacatctggcaacaggaaccttaacaatagtaatggatgaggaaggcaaactctgttgtcttcacaaaccaggtggaagtgggctaactggagctaaacttcaggactgtatna

SEQ ID NO: 714367 - DNA, 183 bp, Homo sapiens
  misc_feature (104)..(105): n is a, c, g, or t
atggtcatggaagtggcaccttggacgctggaggctgcgggcgctgctgggggagcgagcggcgcaatgcctgctgctggatgccgctccttcttcgctttcannacggccacatcgccggtctgtcaacgtggcttcagaccatcgtgcggcgccggccaagggcgcatgggcctggagaca

SEQ ID NO: 714368 - DNA, 4608 bp, Homo sapiens
gaaaaagaaggaaagggagagggagacggctggagcccgaggacgagcgcggagccgcgggccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcacaggaggggagctatttggacttttgggacacccaccgaggagaccctaagccaagaaggagaagaaagagcctgaagaccttcagtctgacccctgccaccttccggggcatttgggcactgtaggaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccgtgccctaccccctcccattttgatggtgtctgtgacatttcctgttgtgaagtaaaagagggacccctgcgtcctgctcctttctcttgcagtctgcttgtccatgtgtctatttttccacttgtccatctgtccagtaagcaggtaatggtgacccatgctggtccgctcggacccccatcctcctctccccacagctgggccctgctcagctggtcctgctggatgcagtgcccctttggacccccttgtcgcctggcctcccactcccggccacctggcctggccagctctgccagctgttgctctgtcccggtgggagaaagtccagccaggcctccacttcccctggggcatcccaacctcagccctgcacagacccagcgtctgcccttatttgctcccctgcagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagccaaaaaaaaaa

SEQ ID NO: 714369 - DNA, 819 bp, Homo sapiens
  misc_feature (391)..(391): n is a, c, g, or t
  misc_feature (648)..(648): n is a, c, g, or t
  misc_feature (650)..(650): n is a, c, g, or t
  misc_feature (703)..(703): n is a, c, g, or t
  misc_feature (818)..(818): n is a, c, g, or t
gagacgcgcgggcgggaagatggcggctgggttcaaaaccgtggaacctctggagtattacaggagatttctgaaagagaactgccgtcctgatggaagagaacttggtgaattcagaaccacaactgtcaacatcgggttcaattagtaccgcagatggttctgctttagtgaagtgggggaaatactacagtaatctgtggagttaaagcaatgactttcagtaacctgtccaggaggaattttgcagcacccatcaacagatgccccctgataaaggatacgttgttcctaatgtggatctaccacgccctgtgttcatcgagattccggtctggacctcctggagaagaggcccaagtggctagccagttcatttgcagatgtcatntgaaaaattcacagataattcagaacagaggacttatgcatgttctccaggaaagcttgtctggggttctatactggtgatctcattttgcctcgactacgatggaaacatttgtggatgcctgcacattgtgcttgtgctaggcgggtttaaaaactgtacagtttgcctgaagttacctataaatgaagaaactgtttagcagaagttaatttaaagaagaaaagttatttgaatattagaactcatccagttgnancttcctttgtgtgttgatgacactttgcttatagttgaccctactggggaggnggaacatctggcaacaggaaccttaacaatagtaatggatgaggaaggcaaactctgttgtcttcacaaaccaggtggaagtgggctaactggagctaaacttcaggactgtatna

SEQ ID NO: 714370 - DNA, 185 bp, Homo sapiens
cagacgcagctacaaggtccatgaccgcaatgccaccgtatatcagttgagagagactatcatcaacaacatgtaacagtgtcttggagtcctatgtatattgatgataaagagaggagtcacggaagatgatgggagacccatttatgcgttggtgaatcttgctacaacttctagttcctcat

SEQ ID NO: 714371 - DNA, 4848 bp, Homo sapiens
gaaaaagaaggaaagggagagggagacggctggagcccgaggacgagcgcggagccgcgggccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagtcttggagggggcaggggaccgacactcacatctatcaggcctggagttactgctctgcccccatgccctggtcgacactgtgcccgccccaccctcagccctgcacggagacacacacgcccacacgcacacacatgtgcacacacattgccccatcgcacaagaaacctgcagaggacccccactgggggcatcgaggctcagccctcagggcccggggcatctgactctggccccccaggaggggagctatttggacttttgggacacccaccgaggagaccctaagccaagaaggagaagaaagagcctgaagaccttcagtctgacccctgccaccttccggggcatttgggcactgtaggaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccgtgccctaccccctcccattttgatggtgtctgtgacatttcctgttgtgaagtaaaagagggacccctgcgtcctgctcctttctcttgcagtctgcttgtccatgtgtctatttttccacttgtccatctgtccagtaagcaggtaatggtgacccatgctggtccgctcggacccccatcctcctctccccacagctgggccctgctcagctggtcctgctggatgcagtgcccctttggacccccttgtcgcctggcctcccactcccggccacctggcctggccagctctgccagctgttgctctgtcccggtgggagaaagtccagccaggcctccacttcccctggggcatcccaacctcagccctgcacagacccagcgtctgcccttatttgctcccctgcagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagccaaaaaaaaaa

SEQ ID NO: 714372 - DNA, 4648 bp, Homo sapiens
gaaaaagaaggaaagggagagggagacggctggagcccgaggacgagcgcggagccgcgggccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccaggcgttctccactcttcactgctccttctcagctgtggctctagaaatggtgcttccttcccatgttcccttgagtcctccactcaccaggccctctgctggacaggactcttcctcagaccctccccattccccaggctccccttggctgctccccggaccctcagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccgtgccctaccccctcccattttgatggtgtctgtgacatttcctgttgtgaagtaaaagagggacccctgcgtcctgctcctttctcttgcagtctgcttgtccatgtgtctatttttccacttgtccatctgtccagtaagcaggtaatggtgacccatgctggtccgctcggacccccatcctcctctccccacagctgggccctgctcagctggtcctgctggatgcagtgcccctttggacccccttgtcgcctggcctcccactcccggccacctggcctggccagctctgccagctgttgctctgtcccggtgggagaaagtccagccaggcctccacttcccctggggcatcccaacctcagccctgcacagacccagcgtctgcccttatttgctcccctgcagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagccaaaaaaaaaa

SEQ ID NO: 714373 - DNA, 4749 bp, Homo sapiens
gaaaaagaaggaaagggagagggagacggctggagcccgaggacgagcgcggagccgcgggccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccaggcgttctccactcttcactgctccttctcagctgtggctctagaaatggtgcttccttcccatgttcccttgagtcctccactcaccaggccctctgctggacaggactcttcctcagaccctccccattccccaggctccccttggctgctccccggaccctcagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgagggcccaacactggccagggatgacaacctggtatgggagccaggagtcctggcatcattagtcccagatagctgcattactcacttgctgcgagacttcaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccgtgccctaccccctcccattttgatggtgtctgtgacatttcctgttgtgaagtaaaagagggacccctgcgtcctgctcctttctcttgcagtctgcttgtccatgtgtctatttttccacttgtccatctgtccagtaagcaggtaatggtgacccatgctggtccgctcggacccccatcctcctctccccacagctgggccctgctcagctggtcctgctggatgcagtgcccctttggacccccttgtcgcctggcctcccactcccggccacctggcctggccagctctgccagctgttgctctgtcccggtgggagaaagtccagccaggcctccacttcccctggggcatcccaacctcagccctgcacagacccagcgtctgcccttatttgctcccctgcagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagccaaaaaaaaaa

SEQ ID NO: 714374 - DNA, 344 bp, Homo sapiens
  misc_feature (137)..(137): n is a, c, g, or t
attcaaagagaaaagtcagaaagcccttttaaatatatatatatatatatataaaacttggggccgggcatggtggctcacgcctgtaatcctagcactttgggaggccgaggcgggcagatcgcgaggtcaggagntcgaaaccagcctggccaacatggtgaaaccccgtctccactaaaaatacaaaaattagctgggcgtggtggtgcacccttgtaatcccagctactggggaggctgaggcaggagaatggcttcattgaacccagggaggcagaggttgcagtgagccgagatccgtgttactgcgctccagcctggggtgacaagcaagacttcag

SEQ ID NO: 714375 - DNA, 5347 bp, Homo sapiens
gaaaaagaaggaaagggagagggagacggctggagcccgaggacgagcgcggagccgcgggccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggggtgttatgatctacaggttgggaaacccctgttgtgggacagacactgtttccgcctctccacgcatggtcccgagatgctggggacagcactccgaggctaatggctccagctcactaggccgatcctgctgtgcccccgagctgctccctttcctgcacctcccaggaccgcccctccctgaactgctttccctgagccccttattcccgctcactccctcttggaggaccttggcctgttcatttgcagagaagatagaaatggccacacttatgaccccttagctcccccactcctccctacaggcccacccctgaggacacccaggccaccctgcctcctcccgtccgccccagagggaccagacacaggtccctgagccttggggagtccacaggctccccatcttctccttactgcatcccagcccacatctcagcccttccccatggcaggggctccccgcagacgatgccaccttccttgtccccgcagctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagtcttggagggggcaggggaccgacactcacatctatcaggcctggagttactgctctgcccccatgccctggtcgacactgtgcccgccccaccctcagccctgcacggagacacacacgcccacacgcacacacatgtgcacacacattgccccatcgcacaagaaacctgcagaggacccccactgggggcatcgaggctcagccctcagggcccggggcatctgactctggccccccaggaggggagctatttggacttttgggacacccaccgaggagaccctaagccaagaaggagaagaaagagcctgaagaccttcagtctgacccctgccaccttccggggcatttgggcactgtaggaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccgtgccctaccccctcccattttgatggtgtctgtgacatttcctgttgtgaagtaaaagagggacccctgcgtcctgctcctttctcttgcagtctgcttgtccatgtgtctatttttccacttgtccatctgtccagtaagcaggtaatggtgacccatgctggtccgctcggacccccatcctcctctccccacagctgggccctgctcagctggtcctgctggatgcagtgcccctttggacccccttgtcgcctggcctcccactcccggccacctggcctggccagctctgccagctgttgctctgtcccggtgggagaaagtccagccaggcctccacttcccctggggcatcccaacctcagccctgcacagacccagcgtctgcccttatttgctcccctgcagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagccaaaaaaaaaa

SEQ ID NO: 714376 - DNA, 730 bp, Homo sapiens
gacccacgccgtcctgcgcactgggtagcgtgggtcagtggcttgggctgccagctaccgccgtggcgcctcgagcttcccggtgcctccgccgtgcgcccagggatgtagctggagctgctgcgagatgcgacctggggcggagtgaggagtgcgccctgggcggcgacgtgagcgggaatgccgggccagtgctccgtgctgctcttcccgggccagtggcagccagtgtggttgggcatgtggcctgtggtctgctcaactaccctgctgcgtcctgcaaaacctctacgcctgcctggccctgcctgcggtgcttggtgctactgacctgcttggaaacttgagcctgcactgtgtgcctgcaaggagaccctgtgacctgcaccgttgcacttgtcagccctgagatcttcagtggcatcgcttgtcctgatgtcgagaaactacatcacctgcaggccctcggtgattgagaactgtgttgcttgctgctggattcaggtgtgggagagtttgcagccctagttgttttgccggagcccatggaaatttgctgaaggtttgtattgcagtgaaaatcctgagctgaggccatgcaggaagcttcagaagcttgtccccagtgggatgctgtcttgtcctcggccagcctcaagtccaagtttcaaattcgcctgttttggaagccctgggaaacactgaaagttttaggcatagaaaacccgta

SEQ ID NO: 714377 - DNA, 4229 bp, Homo sapiens
cgtgagctacggatggagcgcactgacgaggacagctatattgtgtcacctatcgaccttgcggtcgggtacgccccctgagctggcccgccctccaggtgctgctcctacgtgggtcgccgcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccgtgccctaccccctcccattttgatggtgtctgtgacatttcctgttgtgaagtaaaagagggacccctgcgtcctgctcctttctcttgcagtctgcttgtccatgtgtctatttttccacttgtccatctgtccagtaagcaggtaatggtgacccatgctggtccgctcggacccccatcctcctctccccacagctgggccctgctcagctggtcctgctggatgcagtgcccctttggacccccttgtcgcctggcctcccactcccggccacctggcctggccagctctgccagctgttgctctgtcccggtgggagaaagtccagccaggcctccacttcccctggggcatcccaacctcagccctgcacagacccagcgtctgcccttatttgctcccctgcagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagccaaaaaaaaaa

SEQ ID NO: 714378 - DNA, 464 bp, Homo sapiens
  misc_feature (242)..(242): n is a, c, g, or t
  misc_feature (315)..(315): n is a, c, g, or t
  misc_feature (320)..(320): n is a, c, g, or t
  misc_feature (418)..(418): n is a, c, g, or t
  misc_feature (449)..(449): n is a, c, g, or t
gaatctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgctttgtgttgtttgtgtccataagaganatggtagaagatgaagcatatgaagacactgttatgaggttagagaaaaaaacagcagggcttagtttcagcnagcgntcccagtttagagattaatttttaccccctaaggaatatccatccaaagacgctgggtgggagcgtccagcatagcactgggttgagtttctggctgnaaatggtgaagaatggacttttatgctaccngatctagactagtcc

SEQ ID NO: 714379 - DNA, 1228 bp, Homo sapiens
gtgggctgattcgtccgagggagatgcgttgtcggagatcggatctttgctcgcgagaaaaatggggggaacatgaaggattctgcttcatggagattacgcattaggtgtaatactatgtggagtgatgattttttcaggaggagcctaatgtcagaaaatcatagaagtgaatatactatttagtttaatatctaattttcattatcttgaatgctcaaaatctcgtttaaatgaactatccttgatagaacctataaatgtgagacataagtgtgtgttctgcaacaggtgggtgtgacgccttctgattttggacgctctcattcgttctacttatcctaacgtcctatatatcctcacacatcttctagaaaaccaaacatcgagtgtactcgatccataggatagatgtaacgaacagaagatacgagagtgctttttagacgggtaggccttgtaaaaaacggacgctcatggaaagaggtggtaaggagagagttgggctggagcagaggtggattaggtcgcggagggtggatgagctagggaggatgctgttgcatagattaactcggttgatcgaatcagctcgggttagcgatccgttgggctttgacaggtgagtgtggtgataaggtagcgtgtattggcataagcaaggggataccaccaagccatgtagcgagaagtaagcatttgtcgcgtgatggtgacactagcagcgtctatagtaagtaagagagcgtaatcttatctcgggaagggatcgacgcacataggaaggtgggaggatatcgaggaatggcgttgagttcactagagaatccttgagaataccaaaagtactgaaggtaacaaagttccgcgttagggaggcttctcgagagaaggagtctcttggggaagggatcccttcacgagggaagaataatgaggtggggtagaactcacttggggtagaaagagggttcttgatttggaaagccgcacaccgtagacgcaaggacaaacttcaaggaacgataggacggaaacagaggtaatgcaaggttagagggatacaagggagcggacctgagtcaaaaacgcctgcacatgatactgccggccccggagacatgccacaaagacagacacacacagggggggggaccgccccactagagggtacccacaagaggagacacaacaactagtagtgtcgccaacatcggggccacaagag

SEQ ID NO: 714380 - DNA, 1056 bp, Homo sapiens
  misc_feature (625)..(625): n is a, c, g, or t
  misc_feature (656)..(656): n is a, c, g, or t
  misc_feature (694)..(694): n is a, c, g, or t
  misc_feature (751)..(751): n is a, c, g, or t
  misc_feature (854)..(854): n is a, c, g, or t
ccattatggcccgggtgcctacactcgcacgaccaatttattcgtgccgaactcattttatacaaagctggtcttagtgttcccttgctctctgcttgactgagttgcactcacatttttagaacggctatcgatacgtagacgccattttagtaactcacaagccagctccaaacatgttcgtacgtagagtggcacctttagcacctggcatttacaacaatcggtacgtgacatcgctccggtagccacaggagcagtatcgtcttgtccatccgtgcgacgtatcagcgcattcttatgaagggatagtgcccatgcaacagctctaactagtgacgcactgtttcacttgacggtatacacagcggcgatgtcagtcgagactatctctggacatgtcctagatggcctcattagccacttactacgaagtcacttcgaagacagcttgactctagagtatcatatcacactatgtcggacaatgcgctgctgaaccgctgcaccatagcaatcggcacatctcatgtcacttattcgcaacaacgactcgagctctaaagtagcgtgcatccactagctgcatcagagcactctgcatgtcgacgatctacgtagcgcngtttttcggccacactatgagccaagtatcncttcatccgcatcgacgcaatgcatctaagtgagcgcntcacgaagtggcgcatacacactcgatgattggtctaccttagaactaactggctanatttataaactacctccttgtgtagtagcacctggtagtatacgttggatccatcccatgagcacgacctacagattcgttcgcacctctatctgtcacgagncactctactgaagccattcttcacccaatggtcgtaccggccgtatgcaagcctgcactgtatatcccgtccgaacgacaattctaacattcacggtcgcctaacgttccccttaccattcccccttcgttcttgcatcagtctttctattggtcccccatagctgctagtgcgcttgtcaccatcttagagttctggtccg

SEQ ID NO: 714381 - DNA, 960 bp, Homo sapiens
  misc_feature (414)..(414): n is a, c, g, or t
  misc_feature (560)..(560): n is a, c, g, or t
  misc_feature (576)..(576): n is a, c, g, or t
  misc_feature (814)..(814): n is a, c, g, or t
ggacaactgtattatgtatggttaagagcatgaacttcaaaatgaacagccctgggtgtgaattcgagctctgccactgactagcagtttaatgttaggcagattacttaaattctgtgaaataggattaataaaatcaactgaaaagattgtttcaaagacagtatatgacatagtcaaaatagcactgtgcctgacatgtgagtgtttaataaatggcaattgctattattatcctatatggtctgaattctgccttgtcatttcttttctctaaaacttagttctcatcctttattctattagaatgtgttttctaccctacttcaattaatctcttctaaaatttgagtggtccctaacttgatgggttcatttctagtaatttcttattatctctgctaattggaaatngtgatttagattttgttgttcagttgtaaatgcttaatctttttaaattgtttataagcttactgagggcagaagactccataatcaaggtttttgaactcagcatgagacccagtgtctttttctagtagaaacaatgaatagtngtttaagcttcagatngtcaattggaatctctaatcaaattttagaaaacacatttcactatttaaaaattttgtctagttctgattttacaatgacctttcaagcaatgcagtcttacttttattatttccattggatttatttacttctttttttccaaaatgaatttaatggcatgaattcatgaatttctggatatttcttcaaatagagtatcatgtagctgcagtggattgggctgaactttatccangtcttttcttcttaccttttcaaatgacattctgtcacctcattctatatttatatattttccctttctctatattgtgaaaatttagaatcatatatctatatttgatattaattccagacttgtttgggatttcctaagtatta

SEQ ID NO: 714382 - DNA, 349 bp, Homo sapiens
gaagagatcttcctaatgccttggatgagaaacagctaaattgaaaaacatgaatctgtctgctaattcaaggatagagaaaatttgctgcctattcaaatttcttgcaaaggaaaaggataatatagatatcacacttcagtggccttattcagcattcaaaatctagaggaggctgaagcatctcctgaagtcttccagtcctctggctatattctagattattgtccgtcctctgagtattccagaatacggtcttcctaacccagaattgcttttcagagttattctatgtcactgtgagatgatatcctatctcataagatagctggtgtatataagcagacaa

SEQ ID NO: 714383 - DNA, 611 bp, Homo sapiens
gcctggacggaccctcgccagtgctctgcgcaggattggaacatcagttaacatctgaccactgccagcccaaccccttcccacccatcgtcgattgcatctctgggctccaggtataaagcaggtcttggggtgcaccatgatttcaccattcttagtactggccattggctcctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagactggcgatgcggctgtctccacatgtgacggctgcccgcatcctcaagaggtcaagctccaccatcaatcccatggggaggacgaccagtgctggaccattggacaacgttccccattcgtggaccttctccaatgacgtacaacaccatatgcccaatgtccctgatcagcgccggcacctgcaccgcctacctgtgtggggtgaaggccaatgagggcaccgtggcgggtaagcgctgccactgatcgttcccgtgtgcaacacctacccaggggaactaggtcacctcca

SEQ ID NO: 714384 - DNA, 226 bp, Homo sapiens
tggggcaacaaaagctcggtagggctgcaaacattaaaagttcacataatcatctggtaagaacattatgttattttgggtggaaattactagaaattttttctccgtgattttggccatatatagtggattggcatatttttggatataagtgcaaaagttatattgacttggttttttagtggtgatacaccattaaaatatttacaaggggtgggattactat

SEQ ID NO: 714385 - DNA, 144 bp, Homo sapiens
atttctgttggaggttctggaaggggatgtatatgagacccgtgactccacggcgtctgggctgtcccggattagtttataagtggaccagcacctggccggttcaggcccagtgcctcacctagagggcacaggaagtcacag

SEQ ID NO: 714386 - DNA, 198 bp, Homo sapiens
tttttttgcctcaaaaagtgacatttatcaaagaaaaaaaatgacaagatgtcatccttggtcccttccctcccccctctcgtcactcagccagagattgacgctgcgtggctgtgcgagacagcctcagatgagtcacgcataggcattcctatgagttgagagtatgagtctgtttcaataacactccgcaccatc

SEQ ID NO: 714387 - DNA, 310 bp, Homo sapiens
ttaaccctcacctaaagaatcaacaacatacctggtagagggtactacgcacaacctctatctttccctaaggtcaaagacactatcatctgctgtgttagggatgggttctgattggcagaaattaaacagctcccaatgagagcccacggaaataaatagggtcccaagaaaaaaaacgggagctatataacagaaccgagctactgccaaaattcattacctcaaacctttaatgagggttactacgggccggggtaccgaactaaaattcgaaactcatggacaataacaatatacctgaaagaaa

SEQ ID NO: 714388 - DNA, 240 bp, Homo sapiens
ctcggatccgttatcgccccacatgcaacttcagcaaagtctcaggatacaaaatcaatgtaccaaaatcacaagcattcttatacaccaacaacagacaaacagagagccaaatcatgagtgaactcccattcacaattgcttcaaagagaataaaatacctaggaatccaacttacaagggatgtgaaggacctcttccaggagaactacaaaccacatttaccttctccagctgctc

SEQ ID NO: 714389 - DNA, 1009 bp, Homo sapiens
cgtgaccgcgtgggcggacgcgtgagctctctgggtgtggggtatggacgcaccaggagaggtacttaataatggcttcacctggaacatcataaagtacctctctgggtgtggggtaggacgcaccaggatagctattgattaatgttaagggtgtctacccacagaaagcacaccctcttaaaccaggcactgcctgggtcctggtccctgagagcgctaccaggatcaggttcctgcaagccgtcagaatgtgggagcccccagcccaactgattgtaactgtcccctgttacctgtgacatgaacctccaacagcacctggaaacggttcccctctggtccaagtggtctggtaacgggctgtgggagaagactctcagagttaccacatctcgctgtgttgtaggggaggttggggagtagaggttaggaatggcaagtgcccttggaacctcccacagtatggccgtcctgacctcatcgcaggaactctacggtgaccaggaaccaccctctgacgaggtctgtagcggccttctcagagtggaacagccacagtgctagttgtgcctggtcttactgtactccacggacctcggtgaagcaaaagcttcaggcagagggaatgaggcacccagttggtagccccgcggggcccccgtggcttcctgctctcctattgcacgtcgagggcggggagagaccttccctaattcaacatatctcatcacacgcaacggatgaaccctgctgctccgccgccgggcatggacgcccgacccacccggccatgtagctcaacctaacaattggcatggcttacaccacaggaagcacaactcaacccttcaagtgcaacacgccacacgccggacggcacacctctcgcggaccaccacactcgccccacactcgacacacgcaaggtcgcccgagcaaaccccgcgcgcacataccaccactcaaacgacgaacaccccagcaccgccactgtcacctccacgta

SEQ ID NO: 714390 - DNA, 955 bp, Homo sapiens
  misc_feature (467)..(467): n is a, c, g, or t
  misc_feature (472)..(474): n is a, c, g, or t
  misc_feature (477)..(477): n is a, c, g, or t
  misc_feature (479)..(479): n is a, c, g, or t
  misc_feature (483)..(487): n is a, c, g, or t
  misc_feature (564)..(564): n is a, c, g, or t
agcggagacacacctttgatcttgctgaaagatggactcagcatgtttgctctaatgactaagtgaaatgcggcattccaaaagaactcactgtcctgattgggatagcagagaaagctggggacatgaaagctatcgtggaagtcacaagcggaagaggagatctcatagtagcacacaagagaacaggcattgtaaaccacatcaccagtttaaagaatctgattgtcattatttagaagcaaggtccttgaatgagcgagattatcgggaccggagatacgttgacgaatacaggaatgactactgtgaaggatatgttcctagacattatcacagagacattgaaagcgggtatcgaatccactgcagtaaatcttcagtccgcagcaggagaagcagtcctaaaaggaagcgcaatagacactgttcaagtcatcagtcacgttcgatatgattggtttcgntttcnnnttnantggnnnnntatttgtgtgtactcttaacgagctgataagtttctaattttttatatatatatatataaaatactatttggatatnttataattgtatttatattacttaaatccttaaaggaaacctccaaattcttgtagctgatctgtatatttattagctagccctcatttgcccacatttcctcatattctgcagaccagataatgagtttattgattttaataataaaactatttttttatttgtaacatattcttatgaaaaaatcatgcacccatatcttttctttcatcttaagcattttttttttcttagaaaccctttatctggtacttgaaaataaatgtgaaatattgcactggtggacacctgaatgttactaacctgcatagagcatagttccatagtccagtgcatcattgtctgcaatgaattcttttgaagttgtgaaaatgggtgctgaatgggaaac

SEQ ID NO: 714391 - DNA, 603 bp, Homo sapiens
cccagaatttgaaggtggtcaaataatgttgctgaaactaagtgcaatatcaccgtatgtcgaaaatctaggaatcaattagcgtactgaaaggtttatatgtatggccgtgtgggatatggtacaacctcttcctcatccgtgtcttttactttactactagtctccccctacaccacagaaaggcacgtgctttaatgctatgcctggcacctaataggaagcactaatattatcttctccttagcaaaataatagaaaataaaaataaattttaataaaaatagaaataaaaaaatttaattaactgtacctctttagccctcccaaggaagctaaacaccatctactccagctctgctatcttcctagcttcaccagcctaacgttgccaaaccctttccctaccttaaagagtctatgaatcatcagaaaacccaatgctccagaaaggaggcaaaagtacgtgaaaaaggaagctactgtccttgtacagtcctataacgaatcaccagtattatgtgtttaattattgtgtttataaagtacttctgaactggcaagtgatgtccgttcagtttggaactatcctatcttatgctg

SEQ ID NO: 714392 - DNA, 541 bp, Homo sapiens
ggacggcgctgccgccattttgtggggtgttgtcgcagcggccgaggagggaagacggcagtttggcgacatttctcggccgaaggcagtttgcttttgcggagatgcggcattccaaaagaactcactgtcctgattgggatagcagagaaagctggggacatgaaagctatcgtggaagtcacaagcggaagaggagatctcatagtagcacacaagagaacaggcattgtaaaccacatcaccagtttaaagaatctgattgtcattatttagaagcaaggtccttgaatgagcgagattatcgggaccggagatacgttgacgaatacaggaatgactactgtgaaggatatgttcctagacattatcacagagacattgaaagcgggtatcgaatccactgcagtaaatcttcagtccgcagcaggagaagcagtcctaaaaggaagcgcaatagacactgttcaagtcatcagtcacgttcgaagagccaccgaaggaaaagatccaggagtatagaggatgatgaggagggtca

SEQ ID NO: 714393 - DNA, 397 bp, Homo sapiens
  misc_feature (349)..(349): n is a, c, g, or t
  misc_feature (389)..(389): n is a, c, g, or t
ggacggcgctgccgccattttgtggggtgttgtcgcagcggccgaggagggaagacggcagtttggcgacatttctcggccgaaggcagtttgcttttgcggagatgcggcattccaaaagaactcactgtcctgattgggatagcagagaaagctggggacatgaaagctatcgtggaagtcacaagcggaagaggagatctcatagtagcacacaagagaacaggcattgtaaaccacatcaccagtttaaagaatctgattgtgttccattgggactgtttaccagattgcctttctaaattagccagctggggttactttaaaaaacagacctgtgtgggatacnaaaacgaatgcccttaccctcaatccgtctttggctattngaaagggc

SEQ ID NO: 714394 - DNA, 1051 bp, Homo sapiens
  misc_feature (563)..(563): n is a, c, g, or t
  misc_feature (568)..(570): n is a, c, g, or t
  misc_feature (573)..(573): n is a, c, g, or t
  misc_feature (575)..(575): n is a, c, g, or t
  misc_feature (579)..(583): n is a, c, g, or t
  misc_feature (660)..(660): n is a, c, g, or t
ggacggcgctgccgccattttgtggggtgttgtcgcagcggccgaggagggaagacggcagtttggcgacatttctcggccgaaggcagtttgcttttgcggagatgcggcattccaaaagaactcactgtcctgattgggatagcagagaaagctggggacatgaaagctatcgtggaagtcacaagcggaagaggagatctcatagtagcacacaagagaacaggcattgtaaaccacatcaccagtttaaagaatctgattgtgctccatgtgcatccctcttgaagcttcgcactctgttgaagaggacactcatcccagtcattatttagaagcaaggtccttgaatgagcgagattatcgggaccggagatacgttgacgaatacaggaatgactactgtgaaggatatgttcctagacattatcacagagacattgaaagcgggtatcgaatccactgcagtaaatcttcagtccgcagcaggagaagcagtcctaaaaggaagcgcaatagacactgttcaagtcatcagtcacgttcgatatgattggtttcgntttcnnnttnantggnnnnntatttgtgtgtactcttaacgagctgataagtttctaattttttatatatatatatataaaatactatttggatatnttataattgtatttatattacttaaatccttaaaggaaacctccaaattcttgtagctgatctgtatatttattagctagccctcatttgcccacatttcctcatattctgcagaccagataatgagtttattgattttaataataaaactatttttttatttgtaacatattcttatgaaaaaatcatgcacccatatcttttctttcatcttaagcattttttttttcttagaaaccctttatctggtacttgaaaataaatgtgaaatattgcactggtggacacctgaatgttactaacctgcatagagcatagttccatagtccagtgcatcattgtctgcaatgaattcttttgaagttgtgaaaatgggtgctgaatgggaaac

SEQ ID NO: 714395 - DNA, 644 bp, Homo sapiens
ggacggcgctgccgccattttgtggggtgttgtcgcagcggccgaggagggaagacggcagtttggcgacatttctcggccgaaggcagtttgcttttgcggagatgcggcattccaaaagaactcactgtcctgattgggatagcagagaaagctggggacatgaaagctatcgtggaagtcacaagcggaagaggagatctcatagtagcacacaagagaacaggcattgtaaaccacatcaccagtttaaagaatctgattgtgctccatgtgcatccctcttgaagcttcgcactctgttgaagaggacactcatcccagtcattatttagaagcaaggtccttgaatgagcgagattatcgggaccggagatacgttgacgaatacaggaatgactactgtgaaggatatgttcctagacattatcacagagacattgaaagcgggtatcgaatccactgcagtaaatcttcagtccgcagcaggagaagcagtcctaaaaggaagcgcaatagacactgttcaagtcatcagtcacgttcgatgaaatcgtggacactttgggtgaaggagcctttggcaaagttgtagagtgcattgatcatggcatggatggcatgcatgtagcagtgaaaatcgt

SEQ ID NO: 714396 - DNA, 1142 bp, Homo sapiens
  misc_feature (654)..(654): n is a, c, g, or t
  misc_feature (659)..(661): n is a, c, g, or t
  misc_feature (664)..(664): n is a, c, g, or t
  misc_feature (666)..(666): n is a, c, g, or t
  misc_feature (670)..(674): n is a, c, g, or t
  misc_feature (751)..(751): n is a, c, g, or t
gaggaacccagtcagctgctatcaatcatgctcttacattacaagagaaaggaatcctttttgcctgcctctgattgtacctctgtgagagactaagacagcttagatacaggtgcagaaggtaaaggaacacttaatcaagtaaacactagacatgaattaatgatttgactcaagctttattccttggtgtgaagtgcttgacagcaaactctataatgggcccattggcttgtttgtaaaagtaaaattatttcttaagctttatgagataaatataaatgctaattcatctgtttgaatttttttcttatatggagttagctgtttaagaatttctgagaaaatgttttgtttgaaccacatttattgcagaatgaagagaataatttgaaatcttttaatgtgtttgcagtcattatttagaagcaaggtccttgaatgagcgagattatcgggaccggagatacgttgacgaatacaggaatgactactgtgaaggatatgttcctagacattatcacagagacattgaaagcgggtatcgaatccactgcagtaaatcttcagtccgcagcaggagaagcagtcctaaaaggaagcgcaatagacactgttcaagtcatcagtcacgttcgatatgattggtttcgntttcnnnttnantggnnnnntatttgtgtgtactcttaacgagctgataagtttctaattttttatatatatatatataaaatactatttggatatnttataattgtatttatattacttaaatccttaaaggaaacctccaaattcttgtagctgatctgtatatttattagctagccctcatttgcccacatttcctcatattctgcagaccagataatgagtttattgattttaataataaaactatttttttatttgtaacatattcttatgaaaaaatcatgcacccatatcttttctttcatcttaagcattttttttttcttagaaaccctttatctggtacttgaaaataaatgtgaaatattgcactggtggacacctgaatgttactaacctgcatagagcatagttccatagtccagtgcatcattgtctgcaatgaattcttttgaagttgtgaaaatgggtgctgaatgggaaac

SEQ ID NO: 714397 - DNA, 173 bp, Homo sapiens
ggcaggggacaaggagcatggtggttttgggtatttgcttaccttcccgtttttcctttgcccctggaagggaatgtgggggccccctttttttggacatgtaccccctccctttccttttactggacataaacctcagactttccccctttcaacaaagggttgatgcccca

SEQ ID NO: 714398 - DNA, 799 bp, Homo sapiens
ccgggcacgcaccgggaccgaacgcggaccagtcgcagcgcacgccaacgtctcccagggctcaattcctcgctaggcaacctcttacagccccagccacccacgagcagcggattctatcaacaaggccaaatacctcaccaagtccacaccaggcagccagcgttggagcctcgttaagatgctggatgagagtcctccggcagctgagcgcctcagtgacccagtggaacgtgatgaccaggcgagctcgagtcccagcgaagttacacgcctcccccagcagcccgcgtccaccccatgcaagttcccgctggccaactgcatactccacgctcaagctggtcaccaaccgcctaccaggccaccattgaatggagtcagatttttggggacatcaggacagaacgtgagtgacattttccgagtacagcagacatggaggatcacttggagatcctggagtggaccctgcgggtccgtcacatcagccccacagccctgacactctaggttgttaccccttctacaaaactgacccgttcatccttgcccagagtgcccgcatgtctacttttgtggctaacacccacagctttggctccaaaatcatctcgaggtcctgaggaccagacagtgctgttggtgactgtccctgacttcagtgccacgcagaccgcctgccttgtgaacctgcgcagcctggcctgccagccacatcagcttctcgggccttcggggcagaggacagatgacctgggaggccaggggcatgggcacctgactcaaaaaagtggtt

SEQ ID NO: 714399 - DNA, 1332 bp, Homo sapiens
gctttgaaataagtgaaaacagagacacaacataaccaaagtctctgggatgcagcaaaatcagtgtcaagaggaaagtttatagtgctaatcacctacatcaaaaagttagaaagatctcaaattaagggtctaaagtcacacccagaggaactagaaaagcaagaataaactaatcccaaagctagcagaacgaaaagaaacactaaaattagagcagaactgaaagaaattgagaacccaaaatccacacaaaagaatcaacaaaaccaaaaactggtcccccgcggaatggatcaacaagattggacaggcttctaactagatttaccaaggagaaacaagagaggaagctcaaaattaccctaggtaacggaaacggacaaagggttgcccttacagctggaacgcacaggacatttagaaagcattcccaggaagaattattactggacacacaggtatgtgaaacacaatcagaaaacatctatgaggggaccggggttcaaattccctagaaattatacgagactctcccaggagatgagatcccggaagaaaattctacactctgagacagaatatctaatttagatatccccagttttggaacccggaatatacagaaaaaccttcacgcagttaaacaaccccccggaggaaacaatgtggaccaacagagggcagcataaaacacaaaatagtaacgcgacacagggcggctgcaaacacctccctgacgacaaatgcccgacaaaaaaaatgagcagacagcgaaggagcaaccagcacacaaaaaagcacagcctcgcagagaacacagcgagatactgaccgcatagacaccaacaacaccgatcgcgacagaacaccactgcttagaacaacgagaagcccaccaggggcgcaacccgccgcgcacacaataactgcgccagaccgccgtccacgagacaaaaagtaagacaggagtcgacgagcgcagccgcaacagagcacacaccacacacaaacaccatcaacgaggacgcgcgaggagagacccaccaccacacccacggaggcgcctacgcaacgaccgagaccactaccgtcagctaaagtgcagagacagcgcagcgcacgccatgagcgacgacccagcgaaaacggcagcagacacgcgccaagcgcgcaccaaggcggccagaagccagagcaggaacgccaacagagcgacgaatcagcagcgcacgcaccctcggacgtttcgctccacgacagaggcgcgcccacgcgccccgccgagacgcgcacctgacccagcgacccacacgacgagcagcgcatagc

SEQ ID NO: 714400 - DNA, 1710 bp, Homo sapiens
  misc_feature (973)..(973): n is a, c, g, or t
tatattagaacgatctagtgaggaattttattattatatatcaacgtaattagtgtaacattgttcgtgtactagctccttagattcgcaattagtcttagcgctcaagatgtacgcttagagactagaccaaatcgtcacctgtctgctctctactctgccattgtctcgcactatcactagcagcgcgcgctggtggcatcgactcacgctttaacgtggagatcgggtaggatcatagctgagtagaagaacacatacttaggtgcggcgaggattacgctcaaagtaggagtggggaaggaagaagttcgatagaggtgagaagataataataacatatgttgtacataatgtgtgataaataccctaggtggctagagagagataagaacatgcttttatagtcctgggagaaggaagaatagtggaggacggtagaggcagtgtagctgcagggaaaagaattacctgagtttaatcatgagtcagtaacgttatctatgtgggagtgaggagtaagggtgcaaaaagtggcactcgatacagcacctaacttagtgtgggtagtgcactctgaaaggcaaggtgagaacaccaaagaggctgcgcagactgtgtctattatatccagggaatcgatgcacacatcatagcgctaacacaaagcgaaaggcatgaggagacgaaggcccgcacaggtcgcaccatggggtgatgcccgaaacccgctggatgatcagagggcaaaagatatgcgcaaaaactctgaagcacgcgccgtcgaagtgtcaaagatgtacgccgtatggagacgtgccaaacgaaatataaacagcagagacagtgaggacgtcccctaatcagccggactgtgacaaccgctgtgtggtcgtaacctccggttgacaaccgactggccacggcgataggcggacgcccgaacccgtttgcggattcacaacccctatanttcggagaggcgctcaccgaggaaacgtactagaaagttgtcagcacaggaaacacgttgtctgcacaaataaccagcaagcgagacaccaacgcggaggttacacccgtacaatagggaacacacatagggaggaacttcaataatggctgcgacacacacagagatacacaaaaacacatacggataggtcgaaaatatattggagggaggatttagcgaatcgccataatggatgagtctggaaaagtcaggataactattattgagcatgtgttcacaccgattgcaacgagaggggctgataacgatatgtgttgtctgggaagaaatattctttgagggtcattattgtatgatcgagatgaattacgcaagtagacactcctttaggtattgaaaataaactagggactgatatcaacatacaatctgatagttggctgcaagacacaactaagagtagcttggcgccactcctcaaaatttgatagacagaaaggtagcaaaaataagaaataggatcagcgagaggggtataagagatattagtgcacgtcaaaattaatggcggctgggctgtttatgaggcttaacatcaagtagtagtctgctgtgtatggttagcaagttgaacataatgaatgatgatgataagatgagtactagcacgcatgagtttgttgtggtcggactgtttggcttgttagtatgctatgattgattatgaaatagag

SEQ ID NO: 714401 - DNA, 1069 bp, Homo sapiens
gagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtaacacacacaaccacaaa

SEQ ID NO: 714402 - DNA, 526 bp, Homo sapiens
gagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggacgtggaacactaccgggagatcttcgacatcgccttcccggacgagcaggcagaggcgctggccgtggaacggtgacggccaccccgggactgcaggcggcggatgtcaggccctgtctgggccagaactggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtaacacacacaaccacaaa

SEQ ID NO: 714403 - DNA, 1641 bp, Homo sapiens
acttatctgagtctcgttacaaggacccagtatggaccaaggaaacctctatatagggtacagcgctgcaggtaggcagcttcatcctgcaccccaaaaacatcaccattgtgacagtgtgcccccacggccaccgcacatatgggcgcaggtgttcttgcgtgagccaggcaggccaggcggagcactgcaggcaggcaggccaggtgtcttggagggctcgacaggttgggctgcctcatcgtctggcaagcgccaatatgcccctggcaagaacacagcaacacatgcatcggcgtcggccagtgcacctccatgcgtcgtgtgctgcccacctaactcacttttgcagatggacaagcaggacagtagagcgggtgcacatcctatggtcttccaatgcaacccaagggccgcggaaccatccattcgcctgcttcaccccaatcgacataccatatctcatccatgtgcaccacagatggacatcatgcacctaatagcagactacaatcatcgatgagagccacgcaaatcgggcatggaccaattccaaacgcgaccgcgcacatgggacacttgacaccaagcggacatactacaggccttcgccgggagcacgccgcacccggaacacaggaccagggaccatctgccggaccagcaaacagatggctacagcaactccccaagtcccaccacaagcaccagaacatcccaccacagcagcgaggacatcaccgcatacacagagcaacacagacacagccacaaggcgcaaagggagtcaaaagtcaccacagatgggagaacgaaacgcacaacaggcagtcggagaggagcacagttgggcgcctctgggaggctatgatggcgccaccacacacccacaacaccgcacgcgctatcatacacccccagttccaacaaccaggagaggacaaagcaagtagagagccacaggagcgagcaacatgtaaagcagacacctctatccagtacacccaccaagcacgaccacaacacatcagagtatcggagaagaaacgaggaccacataggaaaccaggacacgacaacccaacacgagggcgaccctggcacgttggaggcagcgacacccacagggcgacgcacagcgactcaccaccaacaccacaaccgaaccggtacacgcaaacaacaaggcggacaccacctgcggagcagtcgaccaccaacagcggaccacacacaccgcgcgagcctgtgtgcaaacccccgcgtcgccacaccacgtcggacaaccgcggcacacaccaccccacccgagagaggtgacagacacacagacagaggacacgacgagtgcgacagcgcgcagaacacaacagcacagacagagggcacgagcgagacaccaccagcatcaacggggggccgcacgacgcacggcacaagaaagcgagaatgtgcgaaagcaaccgagaacacgccgcaacgacgcggaacagcgaggcaccgagtgcctgccacccagaccctacctgttcagcagcgaccacaccatccgactacacgaagcgaccagcgtaacgcccacacgccgcgcaacgctcaggcaagaccagccaacacaccacgcacgagaaccagcactca

SEQ ID NO: 714404 - DNA, 331 bp, Homo sapiens
ctgagcctccaggcgaggctggtgctcacatacagtgatctctccgtagcagaaattccccattcctactcccctatatgctggctctgaagggtcactgtactcaagcggatacaagccatgattcccaagggtgcgctagctgtggcagtggcccaggtgtgccgcgtggtacctctggtggcggacggcatctgccagtgcctggctgagctgctactccgtcaatcctgctcgacacgctgctgggccgcatgctgccccagctggtctgccgcctcgtcctccggtgctccatggataacagcgctggaccaagagaatggctgcc

SEQ ID NO: 714405 - DNA, 791 bp, Homo sapiens
  misc_feature (27)..(27): n is a, c, g, or t
  misc_feature (159)..(159): n is a, c, g, or t
  misc_feature (231)..(231): n is a, c, g, or t
ttgttgtctcacacaggtgcgctgcanaggcatgttcacaactctttgagctccccacccctactggaggttctgtgatctatcagcatggagtcagattgtggcctttggcatcaacaggcgtctactgctgggcgttacacatcaattggtgataanctagtttgctaatcagtagtgtagtctgtagagaatgtctttgtgggtcagctgagtggttcgtagaattanacttgtccctgtttgcagataggcacgatctgcaagccaccactatgggtcgttgggcagaatcagaattctggacagagatcgcagttcctcaagactccatcgcatctgttctccatctctgttgatccaccagaaggctggatgtgaaggtttctttccagccttttcgatatcagtccattggtccaggacatctttatcaaagttgaaataatgtggaatccccagtttaaagtcctgtttcatggattcatagttggagatattcagaggggtcgctgttctattatctttatgcagtgccctcacagaaccaagaattgctaggtgctgaacacacttggcatgacgtagcatcttcctggtgacacgagctagcatcagtcttgttgtcagcttcagcactcaggatttgcacagagaccagttcattagttggcagattccaacagcagatggagattatggcagacttgtttcttagaagagcagccctgggccttgagttctcacatctgctttttccctccgtgccgaattcggcaccagggctcgag

SEQ ID NO: 714406 - DNA, 1116 bp, Homo sapiens
gagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgccctgctattaggccgttacgaaccttctgcccctaaggaggcccttttcccttccaattggccaatgccaaaccgtggcccccccccccctgggcccaaaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtaacacacacaaccacaaa

SEQ ID NO: 714407 - DNA, 470 bp, Homo sapiens
  misc_feature (8)..(8): n is a, c, g, or t
  misc_feature (50)..(50): n is a, c, g, or t
tttcctantttaattaaaggtaaaaaaactgttaaacagttccattgtanatctccttaaaaatatccagcataatatctgtatcttttccgaaaatcctacacaatgttatttcaagatcctatagattattttgcccatgtctttaatatatcattctgttcaatatatctttcattagccgggcgcggtggctcacgtctgtaatcccagcactttgagaggctgaggtgggcagatcacttgagatcaggagttcaggaccagcctggctgacatggagaaacctcatctctgcgaaaaatacaaaaattagctggcatggtggtgggtacatgtaatcccagctacttgggaggctgaggcaggagaattgcttgaatttgggaggcagaggttgtggtgagctgagattgtgccactgcactccagcctgggcaacagagtgagactccatctcaaaaaaaaaa

SEQ ID NO: 714408 - DNA, 868 bp, Homo sapiens
ggaatggagaatggaatggtatggagaactggaatagagaatggaatggaatggagaactggaatgaaatgcggtggttgaatagaatgagatggtggaatgggatgtacactggaactggaggatggtgtggcagtaatgggactataactgcgagtagtggaatggtaccaaaggcactacgacctactgcgacactcgacatgcagcgtacgtgagatatacctggcactgggcagaactggcacactgctaactgcacactgcgacggctccggcacacgcgcacgacactgcgaactgcgtcgcgccacgcaactggcaaactggaccacatacgaactggacacggcgagaacttggacacacggcaccttcgcaacacactgcgccacaacccacactcggacactgcgcaacttggcacgggactgcgacccttggcacactgggcactacgctgcacactggacaactgcggcacatggcacggcactgggaacagggcacactgcgaccctcgcgacggctccgcgcacaccgacccacctggaacaactggcaccactcgacagaaactgcgacactcgcgcgccaacttgggaccatgtgcacatgcgccagcacctcgggcaactcggacacacactggcgcacagaagccaatgggcaattgggcatcaaattgcccacttggcaacttgcggcaccaactgctccctcggacacactgcccaatggtcgaaattacacactgccagttcggcacaaacatgtcaatcgtaacactgaacggactggcctcatggaaaccactcgggacaatggtcaccagcaaaacattgccaagaacaaaccagggacactg

SEQ ID NO: 714409 - DNA, 226 bp, Homo sapiens
tctgtggagacggggttcacatgttggcaggatggtcgatctcctgacctcctgatccgcctgcctcagcctcccatagtgctgggattacaggcatgagctaacgcacctgggctcaataattcatttttaaaacatgaaaaccaggtcccaagctttttgtccattagttaaactgtatattgcagtactttattttgttgcctggccccttgttctaaaagta

SEQ ID NO: 714410 - DNA, 127 bp, Homo sapiens
tgtgtgtcatcccctttgtgtgtcatccccttcgtgtgtcatccccttgtgtgtcatccccattcgaagtcacttgccgaagaaggggaatgtgacagtggaacgcgatggcgatggacacgcgacg

SEQ ID NO: 714411 - DNA, 357 bp, Homo sapiens
accaacatcaacaaagaaacaaaaatcagaatataagatagatatatgacagtacataatagagaaaattttctcatatcccaggtgatattggctgtcttcaggtcagtcagttgttagaattcagtgacaactacaacggttttcccttacacaaggctttgccttctgcaatttcagttacccacagtcaactacagtccacaaatattaaatggcaaataccagaaataatatggtaagtatgaaattgcatgctgtactgagtagtgatagaaatcttgtgccatcatgcaccatccagggacagatatgaattatccctttgtttaccatatctatttatgataccgcgaa

SEQ ID NO: 714412 - DNA, 426 bp, Homo sapiens
tcaacatctgcctctcatgaccagagtgcaagacaccgggaagccatgacagagacagcttggaagggatcctgggcccccagagctgctcttcaagacaaggtgtgaacccccacttcgggccagggccaggcctgcaggtgtggccactctccagaagggaccgaggccgggcggggactcacatctgtaatcccagcattttgggaggtgagacaggagaatgcaggagttcaagaccagcttgggcaatacagtgccaccccacctctactaaaaataaaaatacaaaaattagtcgggcatggtggcatgataattccagctacttggcaggctgaggcacgaggatcgctcgaacctgggaggccatgactgcgccactgcactctagcctgggtgacagagagagaccctgcttcaaaa

SEQ ID NO: 714413 - DNA, 168 bp, Homo sapiens
tcgaccggggatgcggggattgggggtgaaagagcttgaggaaggtaagtagagaacataaactgtattttaggtagcagaattctgctcaaagaggaacaatgaaggatatacctgtgtgtcagagggagaggctgcattattcctcttcgagcagaattctgctca

SEQ ID NO: 714414 - DNA, 620 bp, Homo sapiens
caattgcttcaactagaagaccggagactgggtccaggtacatcttcaatagctaagagacctggagcaaggcatggtctctctcttttgttgctgttgttcttattgttttgagacagagtctcgctctgttatccaggctagagtaaagtggcatgaccttggctcactgcaacctccacctcctgggttcaagccatcctcccaactcagactgttgtgtagctgggacagcaggtgtgtaccaccacacccagctaatttttgtattttttgtagagacggggttttgccctgtggcccaggcttgtctcgaactcatgggctcaggcgatccacataccttggcctcccaaaatgctgggattacaggcgtgagctcccatgcctggcctctgaaaatgtctttattcagtcataattgttttttgtttttcttgggatgggatctcgctgtgtcacccaggctggagtatagtagcgagatctcagctcactgcaaccttcacctcctgactcctggttccctctccagcctcataccttgccacagcctgcctcagattctataacaggtgtctctgccatgctatgtaaggctttgtccatgctctcttctg

SEQ ID NO: 714415 - DNA, 1843 bp, Homo sapiens
ggatgggccctgctcaccatgatgtgcctacatgatgccctgttggccactcatagctcacactagctgcagtgatgcacttgaacgtcactgaccccctagaacagtgaccttgcaaggtagccctatacctcgtttgctatcatcacgtgccacgaagcgccccctaatcttggagcatagtgccggcttgactacggctacaactctcacgctcaccttccctcactacctgcactgcttcgtgcaacccccgcatgcttctgccacgcacagtccacctattaacactaaaccgggcgccaacagcaccaggaaaaccatctcctcggcttctcactctactgcgcgcagactgcacccacacgcagtcgcgccctaacgcggacacacaccagcgtcttgccaacgaccaacgcctcctgcatacggcgccactcacggccccacctcacgcatggcctacccacgcgcccacggcgacaaacaacacacgaggcgcagacacacctacagcaacgccacccgcaagcgccaccgccggccctaacgcaacttacgcgccgaccccgcacgacctcgcgcccacgcccaacgcaacgacaccactaccagcccccccctctccaagcacggcgggcaccacaacctcacaacgtaaccgccccactgcggcgacaacccatcccccaacgcagccacaagcaggcacaccgcgccgtcggcgcccctaggcacgcgcaacccgcccagacggcatctcccagaaacacgaccacaccacaccctcgcccgagcactcaggggcgccccccataaacttcaccgctccccccccattaaagcccatcccctacccaacgcaaccttgcctggctcttaactcggccaatcgcacgccatgtctggacccgccttcttcagacatgcgacctcaacctgcccacctataccaaaccgctttgacacaagcatcccccattagctcaccgtgcttgccccccaattccatattccgccaggtccattcactgccagaccacctatgacagtccatataaaccacacttacttgcaacgatccgtgggcgaccctccaaacttacaaggccaaagacgaatctacagaccatacacacacttcgcgactcacccacttggcccacgtcggactccccccgttccggcgcccatcacccacacggagacttccccgccttggcgaaccccctacgggcgagccgacactccccgcccagaagacgcattaggtgcacacacaccccagggaccccaggatagtgacaagcacgaccaacgacgctaagaacacccttagcgcagctactgcgcgcctactcccccgactcgctgcacaccagcagcgacaccaacccactcgagtcctacagacgcacatgatgcgccaaccaacacaacagacccaagacactgcacaaacaccacgccccgacgctgtccctgcggcccggtcgacagaacctaccaccaccaccccaccagcaacgctcacgtgcggcacaccgcacgaaacaaataggcaccacaaacgagacccaacggcggacgaccaccccacccacacgcagccgcgagaccaccaaaccgacatcacacccaccccaagactgaaaggcacacaccaggcgagccaccacacgcaggcacgccaagccaccagagcgcacgccaccaccaccacttcctcagtgcagccgacacacgcacgccccgcacgacgacgcgataacacacacaccaggcacgcgccagacaccacagaaagcggaacataacaaaagacaggcacataatagaaaca

SEQ ID NO: 714416 - DNA, 382 bp, Homo sapiens
attagaggatccgctccagctggccccaagctacagcgtggacccacagaggagagtgtcgcttcttatacccattggccctagctatgggatgctgatgtgttttctcgagaaaacgattctctccctctcctcgtagtttcaccatgtctagatggacggacactgactggagatgataccacagccagctaataagttgagatcaggactgagtcggaggccctgacaatactctagtgctctgctagcacaggagagtgggatggagtgtccaacctgtgtactagaggttgtactacagaaaacttttaacaggtagttgtgggcagacagaggggaggacattttcaggtctcagtttacccttgggggccagctg

SEQ ID NO: 714417 - DNA, 136 bp, Homo sapiens
caaggtttttctgcagaacaaacactcctgatgcctgcttccaatcctccctgccaactgcattgcataattcagtgcttacttctcttgagcccagcagcacatgccagattcaatcaatctgctttcacttgct

SEQ ID NO: 714418 - DNA, 390 bp, Homo sapiens
tagtaagcgagtcagctcctacagtgatcagtgggcacctctagatctgtgtattagccggtctagacgttatcgtgatgcacttccttgaagtgcgccggttagcaagcgatcccagacgcgttgataacgtcgatctgatccctacagttgcgacctgtcttcctgtaacgcttccgaaatacagaggtccggtcgcaaaagagttgaacgatacgaaattaggtggtcgttggaatcctgatcgcagtacagtggtccttgtgtaactgctcgcgtagaacatgtctgcatcccgccaatagtccgctaatcgggagggctgtgcgattaaaaggggcttccatcgattgggtagtgtccttcaagtgggtatgcgaagagccacgt

SEQ ID NO: 714419 - DNA, 901 bp, Homo sapiens
ttatctctgcgacgcctctgttttgttgccctgtccggttgtgagaggatgtgaacctggctgggtatacaacctcccgggcggcgttggtataaggagctctttgtgacctactatccatggggccgtggtttctctcacagagcggcttggtcaatgctcgatgaaggaccgcctccacttgggggccacatcccacggcgccgcgcccccggccgcggtctagaaggagcaacatttcgtctcttcgaagaaataccgccggggaaaccctcggtgggtcgcctgcgaaataatatgttcctccacacgcgtggtgtgcgagaccccctccttcaagagggcggagcccctcgcgttatgatcatcacccaggccacctcatttggggcgggtaatatataggggttattacaggcaggcgcctcgtttctgctcacacttgtggagggctaccgcggagagagcccgcctcagatagcaagtaaggggggtacatagtcttttagatcatggatcatcctcgcggtgagagacgaactgctatcgccaacaggaaaggaaggattgtttttgcccacgaaattcgcgcgccacacagggtcttatccgctgtgtggggctccgtggggtgcggcgagggtcactcacacggggggaggcaggtggcgaccttgcgcggccctctcccagtgtgcgaggggagaagccggccagaccaccctatggcggagccacgacaccccccaacatcgacccagggtacgctcaatgtacccccccctcggagactccggggggtatatggcaacatggccacaagacaaagaagagaagcgcccgtacgagagcagcaacaaggtttaagaaaagcatctgccaccacagcggaaacaagaca

SEQ ID NO: 714420 - DNA, 394 bp, Homo sapiens
gtggacctgggacgggtctgggcggctctcgggggttggcacggtttcacgcacccattcaagcgggaggacccacttgtcttagcaattttggatgaccgcgctagctgcgggttatacgctccggctctctgagttcatcagcaaacgccttggcgtttgtcctcacaatgcctagcctttgggaccgcttctcgtcgtcatccacctcctgtgcgccctggtccttgccccgaactcccaccccagatcggccgccgcgctcagcctgggggtcggcgacccgggaggaggggttagacctctccactagcctggagagctcagactgtgagtccttagagagaagcaacaatggcttttgggccggtggaagacacggcttacctggaag

SEQ ID NO: 714421 - DNA, 123 bp, Homo sapiens
ccctaacccgcgatacagcagcccgcctggtccagcagcacttgcgatctgcgtctgggctctggatgacattgaatccaggaatagactccagcttatccaaggttgcctcctgatgtgccc

SEQ ID NO: 714422 - DNA, 129 bp, Homo sapiens
tcgatacgactctttctttctttcttttctttttttttctttctctttctttctttctttctctctctttctttcttcttttctttttctcttttctttctttttctcttctctcttctcttctctcct

SEQ ID NO: 714423 - DNA, 93 bp, Homo sapiens
tccccccaaggtcaatttttaacctgtgcatgtacgggagtataattcatctataaaatgtttatgtcctcaaaaaaaaagaacaaaaataag

SEQ ID NO: 714424 - DNA, 284 bp, Homo sapiens
  misc_feature (10)..(10): n is a, c, g, or t
  misc_feature (171)..(171): n is a, c, g, or t
  misc_feature (194)..(194): n is a, c, g, or t
  misc_feature (232)..(232): n is a, c, g, or t
atttacagcngttatggtaagtcaaggtcaatcttcacagcagtcctgtgaagtaggcggggctattgactttgtcctaatctgtatccaggagttggaaaggttgtgtgttacctagtgtctttcgggtgacactgggatttcatacaggatgggtttgtgtggttgtgnaggtctagtgcttgttataggtnggctataactgtcaataaaaatacctaggaagctgganctctaattctagttgaatacatgtctttaggattgagggatatactatgcta

SEQ ID NO: 714425 - DNA, 454 bp, Homo sapiens
  misc_feature (36)..(36): n is a, c, g, or t
  misc_feature (58)..(58): n is a, c, g, or t
  misc_feature (128)..(128): n is a, c, g, or t
  misc_feature (347)..(347): n is a, c, g, or t
  misc_feature (350)..(350): n is a, c, g, or t
  misc_feature (353)..(354): n is a, c, g, or t
  misc_feature (417)..(417): n is a, c, g, or t
  misc_feature (420)..(420): n is a, c, g, or t
aatggtcctggtcccccaaaaaggccgccttggaangggcaagcggaaaggaatcggncccctggaataggggccttgaccctaacccctccctccctccctccctccctccctccctccctccctcnaaagtgggccttgccttccttccggacgttcccaatgcaggcactgggcgaggctctcaaaccagtcgcctcacggggtcccgcacacagatggaggggagtgggtagcatgaggtagtgatgctgatgctgtctccatggcggatctcttgtctcttccgtccatcaaaggacacccatgctgtgttccttgcttcaggtgacagcatgatcttcagnctncgnnctgcggggaccacgatgggccggaaggacagcgagtgggggcagatgggcgtgatcatgatanttntatacgttggggtggatcatggcaggtcacgccc

SEQ ID NO: 714426 - DNA, 130 bp, Homo sapiens
tggacagcacaggaaggtggacagcacagaggaggtggcacagcacaggcaggtggacagcacttaggaggagttgagcctctgacacctccagtgattctgccgtgccacatggttcctcgtggtaccg

SEQ ID NO: 714427 - DNA, 683 bp, Homo sapiens
  misc_feature (79)..(79): n is a, c, g, or t
  misc_feature (145)..(145): n is a, c, g, or t
  misc_feature (218)..(218): n is a, c, g, or t
  misc_feature (477)..(477): n is a, c, g, or t
cccgagccccccttgttgtccaaccaggatcacagtatgccttgctcgctttaaggacaccccgggaccactctggccntgagacctctttaagactgtccctccgatgggtcgctttcacccctaagagatgaggcgttagacnccttgccacttggaaaagtttctgaaaactggttccccgaggaaagagctaagccactttttccttgagtganccctgcacccatatctgctgaggaaaattggagctgcacgaagcctcactgtcaccacccgcccttctgcttatttgtctgcccactttgatataacctcctccccacctattgttgcccaaagagggagaatttcaccacgccaaagtccacccttatgtgcacgctgttctcatattgagagctctgctatgccacctcgttgaattttttccccagagttcctcgtccctagccctccagcttccaactctgcttncctctggacagatttggccatagctttgtaagtgatgtggacataattgcctaccataatgaaacctaccgggatttttttatttttcattttccccttaggcatatttagtatttttccccccggccagatccttctgagtgtgcgagtgtgtgtgcacatgttaccaaggccactaccctgttaattaaatattccaatttgga

SEQ ID NO: 714428 - DNA, 979 bp, Homo sapiens
gagctgcccccagtgagtccctcccccgccgcagcagcccatttggagggaggaagtaatggtgaagagggagaggaatgggggagcctggaccgactacccagaacagagccggtgaatgggtttgtgtgtgacccactgagagagaggtggaggacacagacaggaggagtcgcacacaagagagcaagaggcagagattaaaagctcaagcagaaggcgaggtaacaaaggaggagaaagaagcagaggaggctaagtaggacagacagacaagacagagtgagagcgagaggagtagaagagcatgcgcgaacctcacaacgagacacataaaagagtagacagagaatgaagagcgaggatcaaggacaacaaccaccatcaggacacaagaaggaggaaagaaaaaaaacaaagaaaagagagcaaacaaagaagagcagggaaacgacagtgaatatagacgccacaacagctcatcaagcgagataagatgaggagtagagaaaatataaagagatgaggtagaatggatgagacagaggtcggagcgtccgcagtggaggaaacacaggtaccgatcgcataacggaaggaacacagaactaaccaggcacgcacaaggacagacaagacagagtagacagcgagtaaccaagtagggagacactaacgtgatcaggagaaggagatagcagaagagaagctatctgagagaccacagcagcgatagataagtagagaaaggacagcgccaagaagaggagagccaggggcgagatacaaagcaaggagcacaatgccccagacgctaggatgagacaacatacacaccgacctcccaccgcacaggactcagcggcgatacaagggagacgcacagagctaaaatcgcgagcgacacgcgtggggtaagacgcaccagcagagaaccagttcacatgcgtgagaatgtatatgactagaaggtaccaag

SEQ ID NO: 714429 - DNA, 521 bp, Homo sapiens
  misc_feature (44)..(44): n is a, c, g, or t
  misc_feature (47)..(47): n is a, c, g, or t
  misc_feature (103)..(103): n is a, c, g, or t
  misc_feature (209)..(209): n is a, c, g, or t
  misc_feature (213)..(213): n is a, c, g, or t
  misc_feature (261)..(261): n is a, c, g, or t
gcgcgccgtctatgacatcaaatgaacgtagtgcttcaaactgngtnatcaaatggtattagccatgtcccaccctctcactgaactgtggctacgcacctgnaactaatttcttaacccagagagccaactcctcttagtgctcactgaaccttttccgctaggacagtgtgcttttttaaaaatacacttctaaaacaaccgtgatnttgntacaaatacttacaaatgcttttagtaaaagacataggaaggaatgantctcagaaattggtaggatgtccaatcttttggcttccctaggccacagtgaagtataattatcttgggccacacataaaacacactaacataacgatagctgatgagctaaaaaaaagaaaaaaaactcgcaaaacaatctcataatgctttaagaaaatttaccaatttgtgttgggccgtattcaaagctgtcctggaccacatgcagcccatgtgtgcaggctggacaagcttgaatagagtcttttttatctatt

SEQ ID NO: 714430 - DNA, 581 bp, Homo sapiens
gtttgcggccgcccgtgcgcctgaaccctggtgccctgggtgagcacatgcagcgagcgtgacgggacgcggacgggacatagttatgccggacgcggctggaagccagtacgactgacaagaaagagttggcgcaagcgatgcgaggggaaccctctgcacgggagagcgtagactcgaaggaggcatataacggtcctgtagcccatgtcataatgcaggacgacaggttgggccctgacggaagaatgctggtaccacagcaatgaaccaacacgggattgtaccctgcaatggcccactgcgaggtacatctatgtgacaaaaaaacttttaacattgtatacctatgtacaatgttttccccttagacatgagcgcctattatcacaatggctcgcacccttggtgtagccaatacttacacactagaagagtctatacactcacctcatcgctagtggaacaatgggattcactatatgaaaggtagagacgaaccaaacctgtggacttgcaataggggacaattaacgagagccccaaagccagcttacgctacaggtacctacaatgcccac

SEQ ID NO: 714431 - DNA, 512 bp, Homo sapiens
acgagaccaaagcatttaacagtcaagtaacatgcttgtgagtacggaactgactccaggagagtcaagatacaagaggttcttctgacttctaatgcaccgccccctttcgactaccataggcttcttttagacctacagccacagagctggcatgttggttactttcatgcttaagagaccagcagcatacaaatgtgagggactggcaggattacaccaaaggaggattctgagcattatttgaatcagtgttttactactttccttgggcagcttagctcttcaaagaattttaatactcaacctgtagaaatatgatagacaactattggttttattttcaagattgagaaagaggtctaaggaaacccttgttctcccaactcattagagatgacagggcggcttcctctactgtgaccttacatcaaccacagtggattttatcatgaagggctgctcacactggatcacgcaatcaggataaggggacaggactttttcctggg

SEQ ID NO: 714432 - DNA, 435 bp, Homo sapiens
tagtacccggtcacctgctcacgcaaggcaacatccgttgttcacaggtaactacaatcagtcttatctacaagtgcctttaaacagcaagatactaggtgccgtgtagcccgatagtgtgacatgtttactgacgggagtatgtaccacaaacagtactaccatgattctgacgcacagtgtacttcagaaccgactaccgggaacccaacgtgcagtatgtaacggactgaaacgaagacagacgactaccaaagaaattccagagtaaagtgccttgttctttgcaaactgtttttactacttacactcataacggacacggaacctaccttggccttaaactgttcacatatccaaacacgcagttttctacacaccaaggttgacatcaccttcagtttcttacaacattttatttttctattagtgtgt

SEQ ID NO: 714433 - DNA, 1779 bp, Homo sapiens
  misc_feature (1285)..(1285): n is a, c, g, or t
  misc_feature (1429)..(1429): n is a, c, g, or t
  misc_feature (1672)..(1672): n is a, c, g, or t
  misc_feature (1716)..(1717): n is a, c, g, or t
  misc_feature (1734)..(1734): n is a, c, g, or t
  misc_feature (1758)..(1758): n is a, c, g, or t
tctcttttgtctttttctctttctcttttgtcttttcttgtcctctcgctttttttgtttgtcttttctcttttcggtcttgtttcgttcttcttttctcttcttctgctttcgtttccttgtctgtcctttcgtcgctctcttttttttcttctttttctcttttgtctgctctcttttctcttgtttgctttttttctttcttttctcttctgctttctcgtgttttcctcctcttgtttgtcttgtcctttttctctcttgctgtttcttttttttggcttccttcttcgattctgtactctcctccttgtttgctctttcactttgctttggttgacgtcttcttttatgtctttgctattttttcctgcttcggtgtttagctctcgccgtctgcctctgttcttgttctttttcctttccttctctttgcctgggtcgctgttgtctgctcttccctctcctcctctcttcttcgtgtccgtctcatttcgttcctctctcttcgcgttttctctcttttctttcctctttccttttgtatctctctctcctcttttctctgtctctcttctcgtttctctccgtcttctctttgttctcgtctgtgtactcgttctctttcgcctctctcttcttcttctctttctatcaccttcctttctctttctctctgtattctttctgtttctttgtcttttcatcttcgactactcgttattttgtttctgttctgttgagcctagacgacggcgagactgtatgataacgcgatggttgtcgacccatataggtacactcgtagatccggttttggttatacgttaacaaaacgtgatttttacccccgggttagcgccagatgtcgttttttcctcgggtgagtccctacatctcttcgcagggcaaagaatctgggcaattggcaatactgtcgaggccctacgccactttgttcaaatgctgcccagatagggcctgcgctattgccctctatggatggcaccctttgtggtccatgtagagtctactatggacgaatctgggtatatcttctgggcccccggagtttgcgccccttaatgagcataattgattatgccagctccaaggacgccttctagtagaagtctgtacagggtatcaagcatgaattgcaagctaactgctttcgtaggaggtcaaggaccgctgcaccctggctagtagaagctttgggggcagtgccgttcatctccctggagggcaagcctttgtgagccctttggccccctgctggagnatttggcagccccacacctgccttgggggttgcaggctgcccccttcctgccagaccggaggggttggggggatcccagcagggggagggcaatcccttcaccccagttgccaaacagaccccccaccccctggattttccttntccctccatcccttgagggttctggccttcccaaactgcttttgatcttttgattccttttggggtgaagcagaccaagttccccccaggcaccccagttgtgggggagcctgtattttttttaacaacatccccattccccccctggtcctcccccttcccatggtgccaatttttaaccgcaatagtgactctgggcttgtctgtttagttttgtgtataaatggaatgttgtggagatgncccctccctgggccgggtggttcctttcccttttcccctggtcnnggctattcatggaagcnggcccagtaagggccctttgtttnaaaaaaaaaaagccaatatta

SEQ ID NO: 714434 - DNA, 207 bp, Homo sapiens
ctgtgggcggccagtacggggcggcggcacagccagcggtgagggccagtctgggtagcccctggggccctgcagctccacgcagcacttggtgcgctgccgcggcgcccaaccagtgcactcaagccccgtgttccccccatcgcagtatctcccatatgccgtccgccctagcagcctcatgctccccgcagtatggcgtgtcgc

SEQ ID NO: 714435 - DNA, 620 bp, Homo sapiens
  misc_feature (126)..(126): n is a, c, g, or t
  misc_feature (270)..(270): n is a, c, g, or t
  misc_feature (513)..(513): n is a, c, g, or t
  misc_feature (557)..(558): n is a, c, g, or t
  misc_feature (575)..(575): n is a, c, g, or t
  misc_feature (599)..(599): n is a, c, g, or t
acagactgctacagtgagatagcatatcagcactgtgagagtcagcctacctgaaagagctggggcagtgccgttcatctccctggagggcaagcctttgtgagccctttggccccctgctggagnatttggcagccccacacctgccttgggggttgcaggctgcccccttcctgccagaccggaggggttggggggatcccagcagggggagggcaatcccttcaccccagttgccaaacagaccccccaccccctggattttccttntccctccatcccttgagggttctggccttcccaaactgcttttgatcttttgattccttttggggtgaagcagaccaagttccccccaggcaccccagttgtgggggagcctgtattttttttaacaacatccccattccccccctggtcctcccccttcccatggtgccaatttttaaccgcaatagtgactctgggcttgtctgtttagttttgtgtataaatggaatgttgtggagatgncccctccctgggccgggtggttcctttcccttttcccctggtcnnggctattcatggaagcnggcccagtaagggccctttgtttnaaaaaaaaaaagccaatatta

SEQ ID NO: 714436 - DNA, 127 bp, Homo sapiens
  misc_feature (60)..(60): n is a, c, g, or t
tgtttcgactccagttgccaaaactcaacagaatattgtcgatgcctgtctggaaatggngcctgaactggctcaatttcccatcgtcaaacaatgggcgggactacgaccaagctctccaacaggt

SEQ ID NO: 714437 - DNA, 1191 bp, Homo sapiens
gtgcccctcacgttacataacagtagtgactacctatagcagtaaagtcatcttaggttctaggaagtactctgatatatcgcttcaggacctcataatgctgctctgaactatttgcctacagaataggaactaactgacctagtgctggctgttcagttgactgttgctacactcataccatacaaccacttcaaagatcctcgacgtgccctactatatgggcatactaattgtagccgtgatgttgccatgacgtaagctctgtatgactccgacctgcagcacgcacgctggttgcggccatagacccatacactcagtcttcagatcttccgaagcacattattggccctagcactcacgtaaccataacactctcaaagcctcactcccaatgcctccacaacgtacattcgtacccaaagacactgtatcattactaaccacgtgaccatgcacttatccgaaaaagacacccataagtctcgacagtcaagagcaaagcacaccaacagccctcactctacttcagccatccactccgcttcctacctaactctctcacacacccaaaagtcagacaagcaatcatatctcacgcttgttcgcccaaacgcctttgtcctatcaggcccccccatacaacaaaggcctccactcactacactcactcacactcaaccttgcaccttcctaccgccttccagcacactccatgggccaagccccaaagcggcgcacattaactccgcaagcttgacacgccaacgtaactccaacgacaagacacacactctctaaccgcttcctactaatagctacactcgctccacctcacagacagatactttccctataacgcataattacaccgactccacccagcccacacgcgcaaccgcataaacctgccacataacttgtgccaagcaactcgatgcacgtacagggaagtcaacacacaacaacacactataagttacccgcccaacgacgcggtagggggacaatgactcgcacgaccacacaccacgggaagtggcaaggcgcacaccacgcaaagcaccaacggacaaagagccgcctgcgacaacgccgcacacgtgacccacgactgtacgctcactacccagcatgacacagaagagccgacatagcctacaggggatgccactgtaccgccgacta

SEQ ID NO: 714438 - DNA, 519 bp, Homo sapiens
acgcagcaggaaagactatttatttacttcaagagtttagagtagcagttaggaggatagcaccaggagatatcagcatgtgaatggtttgagagaaacagtgtaaagcggcagtgtaaacaaggagcagggcatgtgtagaggtagttgagaatggtgaataggagtatgactagagagaagatagtagggatgacaagtttgtttggggggtacagtctaagttggtctggtgtctggaatgacgacgggggcctaataagaaaggagtgtcgatacacgcagatcaaatgggctgtacctgggaggatactggagggacaggtctgacttctgagaagggaaagtggtaaaggtattgtccagtcctttttaagttggtggctgagcttggtgaggtgtgtttttaatagaccattagtctgtcactgaatactaagaacctgagaaaatgcttggctgatttgactaataaaggctggtctgttatcagactgtatagaggtgggaaggctaaac

SEQ ID NO: 714439 - DNA, 162 bp, Homo sapiens
tctagaggatcaccctttgggggtctatgctttggattattatcctcatccttatcctaatcttcctattcaatagaaaataggagaggccaggcacaatggctcacacctgtaatcccagcactttgagaggccgaggcaggcagattacttgagcccagg

SEQ ID NO: 714440 - DNA, 186 bp, Homo sapiens
  misc_feature (1)..(1): n is a, c, g, or t
nagagctagcaccatgagcttcaataccctgtctctactaaaaaacaaaaattaatcaggcatggtggtgaacacttgtaatcccagctacttgggaggctgaggcagcaggatcacttgaacccaggaggcagaggttgcagtaagctgagatggtgccacagcctgggaaacagagtgagactc

SEQ ID NO: 714441 - DNA, 112 bp, Homo sapiens
aatacacagcgtgtgtactgatatgtctaacataacactgaagctgggcttgccacaatgacgcctgtgcatccacagcttgcgatcaccactggaatacgtaaggtgagct

SEQ ID NO: 714442 - DNA, 586 bp, Homo sapiens
gctcgtgtggtcttttctggcatcgtaggaggtgcctgtgatgccctgcagcatttgtcttcatggggctgaacaggatgactgctgtggttgctgtgcccatgaaaactgtggcaaacgatgtgcgatcgttcttctgtatagggctgctctcatggaatggcaggatcgggctactgtgtcattgtggcagcccttggttagcagaaggaccatctatgtcttgattccctcgggcagtgaactacaccttttgccagcaccgagggccagtaccttctgatacctccacatggtccgagtgcattgaacccaagcacattgtggactgcactgtatctctgttccaatcctctgtggctctgggtgaactgaattcatctggtgtcttatccacgtcactaacatggcggtgcttggaggcatatgtggctttgtgctctcaccaacagcaatatgattgctaaaagaacaaacccaggacagagccacaatcttcctctatttcatgtccatttataatatttcacttgtattcctttgtaaaccttcgttcttagtgtaccaatatccccaagtctattta

SEQ ID NO: 714443 - DNA, 260 bp, Homo sapiens
  misc_feature (243)..(244): n is a, c, g, or t
agtcggtcctccgtggacttgttccggcctcctcggacccgacagaaatgcgatggtctgggccaccttcttgtgaatgccggccaccctgtagctcctccaggctgaagccgcggccggtcgcgcaccttcgtgtggtaccgacaccgtggggcagcgcacgagttggccggagtgggacccgacgcgggtgcgcggggcgcatgcggcgctgccttggcttgccaggagccttacgctctnngcggatacttacgggc

SEQ ID NO: 714444 - DNA, 223 bp, Homo sapiens
  misc_feature (163)..(163): n is a, c, g, or t
  misc_feature (189)..(189): n is a, c, g, or t
actactaccctgggagagggatttggtaattctagctgtgtatttggtgaattggttaatttggtggtttttctgtgaaacacatacatgggatatgggaggtaaaggagtgtcccagttgctccgggtcactccctttatagccattactgtctggtttctngtaactcaggttaggtttgggtctcnctggctccactacaaaaaaaaaaaggggtaccga

SEQ ID NO: 714445 - DNA, 359 bp, Homo sapiens
  misc_feature (270)..(270): n is a, c, g, or t
tagacgatccttataggcgagtcgggtactggaccggagtatgagggctcatcagcttcgaggaggagcgggccaggtgtcttcaacacggatcacgctctggtggagcaccagagctgggccagggagtgacacgctcccactgaaccacccagagctgggccagggactcaacaattgggggacagaagtccccccagtgcctgccagggcctggatgtgcaggttcaggaccaaggggcttctggtcctccagcccctgtactcggncatgccctggggtcactgcggtttgcgcccctaattgtgccaaaggttgaccgggcctgggctggggtacaccctttgcccttgtttat

SEQ ID NO: 714446 - DNA, 876 bp, Homo sapiens
tgaaacctggagcctggagcagaaagtgaaaccctgtgtgcgtccagacaaagatcttagtccgggactagccggccaaggatgaagcctcacttcagaaacacagtggagcgaatgtatcgagacacattctcctacaactttcataatagacccatcctttctcgtcggaataccggtctggcgtgtgctacggaaggtgtaacacacaaagggttccctcaagggccccgttttggacgcgaaggatctttcgaggccaggtgtattcccagacctgagcaccacgcacgaaactgtgcttcctcgtcttggcttcatgtggtcaacccagctgcctgccttacaaggtgatttccaagatcacctgggtgttgtattccatggacgcccctggcccggaactgtgtgtgcgacagctggaccgaatttcctgtctgagtcaccccaagtgtcaaccctgaaccatctccggacgccccggctctactacgtactgggaacacgagatttaaccgaagggcgctctgcaggcatgagtcaccgcaggggcccgtgtgaagattcatgggacgatgaacgaatttgcatactgctgtgcaccaacttggtgtacagtgaaggtcagccattcatgcctgtggtgcaaaattcggatgacaattatgcgattcctgcgaccgcatcgctaacaggagatgctcagaaacccgatggaggcaatgtatccacacatattctacttccactttaaaaaccgtacgcaaagcctatggtcggaacgaaagctggctgtgcttcaccatggaagttgtaagcaccattcacctatctcctggaagaggggcgtcttccgaaccaggtggatcctgagac

SEQ ID NO: 714447 - DNA, 286 bp, Homo sapiens
gagccacatattatgctgtacctctttgggtgaatcacgttagcatctccaaccttcagttacttcatcgtgggatgactcgcaaaatcatacctggtcccaagattcacgtgtagttgagctaataagcatggcattacctagatcagttcctgagtcacctaaaaattgttagttttctcttcatcgaatctccccattcccacccctcatgctaagtctcccctcccacacacacacacgcacgcacgctgtcctgtacctccctacacacacgcacgctgtc

SEQ ID NO: 714448 - DNA, 383 bp, Homo sapiens
tacttcacagggagtgtttcagattggaagtttccatcagttagtgtctatatcatgcatgtgcgcaagtagagaggtctctaagactacaactgagaaatgtattcttgtggcgttggcctaggtacaagttcactggtgacataggaaagaacagtttcagccaagagctggaaggaatgataccaacattgtctttgtctttggtggatttctaagtccccaaatggaagttgatgataatctacggttctcctttgtgaaatgtctcagcaacttgaaagaaagaatctctacataaatctagcactctgttgttgcttagtcactgtcaacctgttttattttgttggtttgagttaccttaatgtttcctcgttata

SEQ ID NO: 714449 - DNA, 333 bp, Homo sapiens
acagccgctgcctgctcttcttcagacctgttctgacgtctagactctagagggggtcggatgacgtggcatactttgcctaaagcattgagtatactgcaaggtcagaaaagcatgcaaagccctcagaatggctgctaagagctccaacaaaacaatatagaactttattacggaatagggggcagctaggaagacactcacaacatcaagattttacctacgcttcttggtctccttgctataattatctgggatacgcatgctgttatctgtctgtcccttacatgccctgtgattatccgcaaacaacacacccaagggcagcacttt

SEQ ID NO: 714450 - DNA, 266 bp, Homo sapiens
  misc_feature (2)..(2): n is a, c, g, or t
  misc_feature (48)..(48): n is a, c, g, or t
  misc_feature (76)..(76): n is a, c, g, or t
  misc_feature (93)..(94): n is a, c, g, or t
  misc_feature (151)..(151): n is a, c, g, or t
  misc_feature (170)..(170): n is a, c, g, or t
  misc_feature (177)..(177): n is a, c, g, or t
  misc_feature (181)..(181): n is a, c, g, or t
  misc_feature (188)..(188): n is a, c, g, or t
  misc_feature (203)..(203): n is a, c, g, or t
  misc_feature (208)..(208): n is a, c, g, or t
  misc_feature (214)..(214): n is a, c, g, or t
  misc_feature (216)..(216): n is a, c, g, or t
  misc_feature (226)..(227): n is a, c, g, or t
tngccacgaggacttgcaggctatagttatggtggtgacatgcatgangtgggctggtagagcaggaagctctgtnatgtcagagcatctacnnggactacaggtgcactgtagtccccactactgggggtggcaatgaagacactctgtntgttgggccctagaatttnatgtggntttnctccttncttccaagttctganattcntaaatnanagctggctgnnttctagaggtaagacctggtatggagtccagttggtact

SEQ ID NO: 714451 - DNA, 408 bp, Homo sapiens
cgtcgactgcaggccctgggtcctccctgcaggctgactacgtgactctttcagctctgagtgtttgaaggtatttcttggatgactgtgtatgggaggagtgagtgcactggtgtcttctgctgagagtttattaggtttgctgaaaaggacaagtgaattcaaatactcaacctctgctcttatccaaaccatcatgttgtgagtgagctgaaatctaggccgatcgttatctctgaaagcaactcatagctgaccctgtagcatttgaatgtaatctattgttctgttccacaaatgtctgaaaagatgaacttggatttaggcttttataagaaaggtgacaataaatgtgtgattatggcctctgaataagcctcaactagaaattggattctgagtcgacgc

SEQ ID NO: 714452 - DNA, 402 bp, Homo sapiens
  misc_feature (4)..(4): n is a, c, g, or t
  misc_feature (63)..(63): n is a, c, g, or t
  misc_feature (109)..(109): n is a, c, g, or t
  misc_feature (117)..(117): n is a, c, g, or t
  misc_feature (126)..(127): n is a, c, g, or t
  misc_feature (135)..(135): n is a, c, g, or t
  misc_feature (184)..(184): n is a, c, g, or t
aggnccccaacggcatcaccccgctaatccctagagtccatcctaaacacctccgtaaccgcntcggagtatcatcactgagctcacctagtctattgaaaacaacganaccaaatnattcagcannctatacanatgggtctctaacctcctacagcttcgagtattcgagtctccttcaccnttccgacggcatttacggctcaacattttttgtagccacaggcttccacggacttcacgtcattatggctcaactttcctcactatctgcttcatccgccaactaatatttcactttacatccaaacatcactttggcttcgaagccgccgcctgatactggcattttgtagatgtggtttgactatttctgtatgtctccatctattgatgagggtc

SEQ ID NO: 714453 - DNA, 403 bp, Homo sapiens
cactttcattttccctcccctttgtttctactttcaccgtattgctttttatccatttttataatatgattttttacagtggaaccgcctacgggaaaggtgcttttaattaatacgaaagaatggaaggaatttcagctaggcctctctaagagggtaaagctttgtgaaagaaaggttttttagctgaagttttaatgagaataagagtagttggcagatgtgaaatcagaagttttttcagacaagaaaataatacgactcgagtgaaagggaatggactagaaatcagaaacagttttattccttaattaccgtaagaaccaaagactggaggaaagtttttcctattctataaagaaaaatgggggcccccctccaccagccagaccttcaaaaaaaa

SEQ ID NO: 714454 - DNA, 183 bp, Homo sapiens
caagagcccatctctaaaaaaacaaaaccaaaccaaattagccaggtgtggtggctggcacctgtgttccaactacttgggagactcatgtgacaggaggatcgcttgagcccgggagttagaggctgcagtgagccgtgatcttgccactgcgctccagtctgggcaacacagcaagatact

SEQ ID NO: 714455 - DNA, 791 bp, Homo sapiens
tcggccgcgggagccccgggagtgggggcagcggtacttctggtgctgctgttgggtggctgctccgggcgcatccaccggctgtcgctgacggggagaagcgagcggaatccagctgaacagcttcggtttctacaccaagtggctctctggagtgtggcagttgagcgtcctgcgggctgggccctccgtggagggccagaacgagcacagtcccatgctggttgggcgtacagatctcacgccggagttcggttctggcagagcttcggctcctagttacaacgccggcgatatccagtgactgccctcatccaagaaaagaacagtcagcacgtttatcctgagtcccgtgttctctcgatcaagcacgcacaggatcatgccaggatccagcgtgcgagaagcctactggcagagcacgaagaccgatagttgtactctattccccgggagctccttccccgtgaaagacaccccttccaaaaccagggtcattccgcgaagccccaacacggcacacacagttcccccccgacaaggatgacattggccggagcggacccctctgacagcacaggacaaagccccaacgttcaaaccacaccctgcagagtgatcacaagtggatcctagatggcgacacgcgacacagggaccctgcacttgtcgcggccttgcagccactctgcaaccaactcctacgcaatcttcagtttcccccgtggttgatcggcgctctcagggcggaaacaacgggcaagtacacagcctgaacttccaacaacctg

SEQ ID NO: 714456 - DNA, 313 bp, Homo sapiens
ctagagaagttggtgcaaaagggaaacaagaagaggagcttagattacctcacgtacaaaaagccaaagaagaacacaagggaaacaggtaatacaggaaatggacaaaatagatataaggaatatataaaataaatggcaaaatgacaaaagtaaatccttcccttatcagtatttactttaaatgtaactagattaagctctccaattaaaagacaagattagcagaatgtatttttcttctatttttaattatactttaagttctaggatacatgtgcactagggtacatgtgcacaatttgtcgagatt

SEQ ID NO: 714457 - DNA, 1193 bp, Homo sapiens
cggacgcgtgggtcgcccacgcgtccgcttaaatactaaaaatattaatattcccgtttgaattcgatgggaagcccttgtgcccttgtcttcaagaagttccaaatcacctgttttccaaaggtccagcattttgtggggacaaggccttgcctttggctcatcagaagacctgtctttccatcctactgagtggcaaaggtttggcaaaggacaaggtggttttcaaacagctgaagattttcttttgatgctatgaggatgaagtgtacctccgcgactgcacatcatgtccaactggaagactcatgtcttgaattacatactgcggacataagtttggtgggacggttttttcctacttttgagttactggtgatgtaaccagcccatgggtctgacttgatcattatgacaggtcgctgccctccagtggtaccactgacctacagaaggacatcatggcagagcaggaggctgtttaaaaattgagccaggagggaacttttttccatctgccttcaataatgtgaatgagtttaatgctaagagccctgaaacaggcctggtttacctggtatggttgcagaattccttcatcaactgggcagtcagacctctgctgtgctgattgagactgtctccaccttctctgccctcacaaacagcagttcatcacttggtcctcagaacctccttccagcaggggctgtatatttcttgatggaaagttggaggcagggttagaagtaaaggggaagtgagtggcatatcaaaactggtctgtttcagtccctaaaatggggggttatggagggtgggagtcctgaggtgagcagaaaagaaaggtgctgctttatttgaaatgttttcttacctcattctgtgccccagtaaagggtccagcctcatctgtctggcttggccatgttcctgtcactgctccactgcctctctggtgcagctcatgattccaggtgctgcttgccacactaggttttctctcgaccaatttcagctcatcttccagtgctgctcctccgaagcctacacaagtttcctttttccttttgttgtcgttttcgttttctaactttaaatttttatgttgttttgttttacctgtttttatggaagccttagaggagaatctctcatggctccctctgtttggattggaatgggaaaataac

SEQ ID NO: 714458 - DNA, 502 bp, Homo sapiens
gatgtgagaagagacgagatgacctctggagcttaaagtttattaatgcaagacagtacctaacaaagccacaggtcctaaactacgcaaagctgcattaaaaatttcggtaggggcgacctcggagcagaacccaagcctccgagcagtacatgctaagacttcaccagtcaaagcgaactactatactcaattgatccaataacttgaccaacggaacaagttaccctagggataacagcgcaatcctagttctagagtccatatcaacaatagggtttacgacctcgatgttggatcaggacatcccaatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcgtctcttctcttg

SEQ ID NO: 714459 - DNA, 127 bp, Homo sapiens
cagcggatgtcttctcagcgaaagtatcaggcatataaggtatcatgagcagcaatgcagggaaacggtgaagttggggttcacatcagcatagagatggaaagtgaacttaactgagatggggaaa

SEQ ID NO: 714460 - DNA, 692 bp, Homo sapiens
gaagggagttccagtgtgtatcctctgatgggactacatcaaagataattaaaggttgccatataaaataaccacttaaatgattgtatgagtcttacacaggttgcattcttaaccgggtagagtgagtactcgatgaaaccagggttgttgctctagccgtcgttgggacagcaatctgctatgaacgaagagaactgtcatgtaacaccacactatgatagctaacatgcagagaagtaaaattgagatgggcgcctcctccggaataaagatacttgctcgcagcgagcatacctgtactagaaccgagttctcgcaggcaatcatggggtgggctgctcctgttatacgaacctccacgcttactggggatcgcagttgacgggataagtacctaagaaaatggatccaggcagacacattcctttgctagcggaagaattggtgcctatgatacctgtcgaactcacctgcaggaccctgcggactgaagatagggccctgcggctagaacccctctggttgacgaggtgaagtgaggcgtatcaacaaattatcatggagtgtctaaaccttggagaaattccttgattaattggagacgcccttggcttagttgagggactggcgacttagttgtcagtggcagaaagcctctggttaacttccctggtctgaataatgtgatg

SEQ ID NO: 714461 - DNA, 190 bp, Homo sapiens
cccaagggggtttttttttttagcaatgaaatccccgtttggggccctttttaaggttggaaccgcccccccagacttataatttttaaaggattttcctttgtttaaactgctgcttcctttgttttattggattgggccagttatcagtgggttttgggtttaaagtaataaaaaatttccaaactta

SEQ ID NO: 714462 - DNA, 461 bp, Homo sapiens
  misc_feature (45)..(45): n is a, c, g, or t
  misc_feature (206)..(206): n is a, c, g, or t
  misc_feature (371)..(371): n is a, c, g, or t
  misc_feature (387)..(387): n is a, c, g, or t
  misc_feature (402)..(402): n is a, c, g, or t
  misc_feature (426)..(426): n is a, c, g, or t
  misc_feature (455)..(455): n is a, c, g, or t
caagacagagcctcactctattgcccaggctggagtgcagtggcnaattctcagctcacctccacctcccaggctcaagcaatccttccacctcagcctcctgagtagctgggaatacaggtgcacaccaccatgcccagctatcctttccttgttctctacagtcatttcaaacctgcttgagaggattgccctgctctcctggnacctcaattatgttaataaaccttttcataccctcttgttatgcatgtaacacgaatagtcttaacatccaaaccaaattttaagtgggggtctataaatgcccttgcagggtgaccattaacagggaactgtttcccaatttaaatggaggattaaaggataanaggacaattggaatgncagttacaggatccngggtttttttttctattaaggggncattttttgtggacaattggggaaaattnggtagg

SEQ ID NO: 714463 - DNA, 331 bp, Homo sapiens
  misc_feature (27)..(27): n is a, c, g, or t
  misc_feature (40)..(40): n is a, c, g, or t
  misc_feature (49)..(49): n is a, c, g, or t
  misc_feature (52)..(52): n is a, c, g, or t
  misc_feature (55)..(56): n is a, c, g, or t
  misc_feature (61)..(61): n is a, c, g, or t
  misc_feature (63)..(63): n is a, c, g, or t
  misc_feature (77)..(77): n is a, c, g, or t
  misc_feature (88)..(88): n is a, c, g, or t
  misc_feature (91)..(91): n is a, c, g, or t
  misc_feature (97)..(97): n is a, c, g, or t
  misc_feature (110)..(110): n is a, c, g, or t
  misc_feature (126)..(127): n is a, c, g, or t
  misc_feature (139)..(139): n is a, c, g, or t
  misc_feature (150)..(151): n is a, c, g, or t
  misc_feature (178)..(178): n is a, c, g, or t
  misc_feature (186)..(186): n is a, c, g, or t
  misc_feature (190)..(190): n is a, c, g, or t
  misc_feature (195)..(195): n is a, c, g, or t
  misc_feature (210)..(210): n is a, c, g, or t
  misc_feature (212)..(212): n is a, c, g, or t
  misc_feature (225)..(225): n is a, c, g, or t
  misc_feature (240)..(240): n is a, c, g, or t
  misc_feature (252)..(252): n is a, c, g, or t
  misc_feature (256)..(256): n is a, c, g, or t
  misc_feature (268)..(268): n is a, c, g, or t
  misc_feature (276)..(276): n is a, c, g, or t
  misc_feature (315)..(315): n is a, c, g, or t
tatttctgaaaaacagccttttaaacnagttgaacccaangaggggggnaanaannaaaananttttttcccttcanaatttgattanaanaaaaanggggcagaggggnctcttccaaaggaaanngacaacccccangtccccagagnngtttttttttttttcttcaaaaaaaanaaaaaaanaaantcaanacaagggcatgccananaattccaaccccnccccaccccgccccnccccccacaggnacanaaaaacacacancaaagggnccccttcctggaacggggggagagaaaggaaaaaaaaanaaccaagggggcaccg

SEQ ID NO: 714464 - DNA, 414 bp, Homo sapiens
gtttgacctgtaactataacgagtcatatactatcaggccataatatttcctgtgttaacttcaacattatttttggggctcatacctcgtatgttttgtgctatacaattcacagtattggctgacttataacattagaatacatcgagtgtcttttcttaacagattagtgcctttttattttagtattccgttttacgttactggtccgagcggaccgctccgctcgtacgaggcaggaggactggcccgcgagacacattcgggcaggaggactggtcagggaggagacttagggtaggaggaccggtcagggaggagacttagggcaggaggaccggacagggaggagacttagggcaggaggactggtcagggaggagacttagggcaagaggactggtccgcgcgga

SEQ ID NO: 714465 - DNA, 210 bp, Homo sapiens
agaagggttgggagaaaatcactgttgttttaaaagcaatcttctgtaacagataaagttctctcctttcctttcctcaccctgacatgtacccctttccttctggctgttccctgctctgtgcctctctaggtaacattatagagagatggaatgaatctccaggctttaggactgtctgaaattgggctgggtgagttaaacacttct

SEQ ID NO: 714466 - DNA, 978 bp, Homo sapiens
  misc_feature (691)..(691): n is a, c, g, or t
acctttccctgcatttgagagttagttgcagtaatcagtgacactttacctctaaatactttaattagtatgcatctcttgttgttgttgttgttgttgtttgagacagggatcttgctttgtcacccaggctgaagtgcactggcatgatcatagcttagtgtaaccttgaactcctgggctccagcaggtcctcccacctcagcctccctagtagctaggactgcaagcactcaccaccacacccagctaattttaattttaattttgtagtgatgggggtcttgctatgttgcccaagctggtctcaaactcttgacctcaagagatcttctcgtctggctccccaagtgctggaattgagccactgagcttgatcagtgtgtatctcttaagaacaagatcattctcctacaaaattgtaacaccattattatactcaagaaatttaacattaatgccaatactattatctagtatacaatccacattcacatttcctcagttgttccagtagtatcctttgtatctcttttttggcgtaaaggatccaattaagcatcatacgttgcatctagtcatatctctttattcatctttaatttagagggtttccccagtctttttccctccgttattttattatgaaaattttgaatacacaacaaagttagaagaatcttattacttngattccattaatatcttactatgttttattacaaatctatgtatctctctagccatcctttaatccatgttatgtttttgatgctttgcaaagtaagttgcgaatattggttcattttccctgaaatacttaagcatgcaaatcatgaaccaagttccaatatttgtgtgaaatgcacaaataagtgtaaatttgcagagtttgggcatatgcgtatacctatcaagacacggagcatttatatcaccctggaagattcctcatatctcttcttcacccttccccta

SEQ ID NO: 714467 - DNA, 176 bp, Homo sapiens
tcagacacacttgatcttgatggtacatcttgtttttatataaaatttcaagctggcgatgacatgtgtaaaaggaaaagtgctgcaagcagtaaatgctgctcagtttgcagtccattacatcaacctatctaaatgatcctctttagcccagtacttcaataggatgttggaaa

SEQ ID NO: 714468 - DNA, 218 bp, Homo sapiens
tttttttttaaaaagggggggggcccccccaaaaacccccttttccctttttgtgggggggggggggttttttttaaaaggggcccttttttaaagtttttttccccccggcccaggggtttccccctttttttcggggggggggcccttttttttttgtttttggggtttccccaaaccttttttttttaaaaaaaaggccccccccccccccttta

SEQ ID NO: 714469 - DNA, 884 bp, Homo sapiens
caacagagtgtaccgggactcagtgcctctgatcaagttacccccagaggatcagagatggggttgacgaatgtgagaagctattcatgatggtgcactggcttctggacagcaactgatgtgccctgggccacgcggcccgaagccggcgaggtgaggcatgctccaccctgggtgaacttgtgatccctgtggctgagatgttcagacggaggtcgatgtgcagccagtgggagctccaagcccagcttatggccccacctccggtgagctccgggctggatgcagctggtgccccatggaggaggtcagtggccaaggcctaggaagcaggtaagacccgcttggtctgtgcccttcactccagtccagacgcatctttgccatccacagatctgctgatgtgcctgctctgctcacacacctaaccataggctccctatagccttcagcctgactttcttgagggaacggaagtctaggctgatgacaccgcaaggcttgtaagtggcatgtgcaagtgggcacgaacctcggctcaaagcaagaccgctggcaacccaggagtacaacaaggaacgccagcgacaaccatgacgaagacatcgggaaatgtcccgtctgacagccaaccgccacaaacaaagggcgaaaccggacacagccgcgaaagagagacggggggccgccgaagcggcgcccagggcgcggcaagagcgagcgccgcgagacgccgcgaccccgacacgcgacagcagcccgaaaaaccgcggagggacccagagccgagcacacagagccccggagcgagggtacgacgcagagagaacggagggggccgcgcgagccacggagagcgaagacgccgagggagagccgagggg

SEQ ID NO: 714470 - DNA, 505 bp, Homo sapiens
actgtaatgtttctgtgaccctttttttggccccaaacagacgagcaattcaacaccgtttggcacattgcagaatttaaaatgtgttggaaagacggacgctactcaaactacttgtagtgcaaatactgagtccgtcttgacctgtagatattcatgttgggtgttgagcaacatgcatcacatgtacgtatgtgtgtgtgtgtgtggcagactgtgccgtgccttcatcctcaagcacgtacagatactggtctgaaagcgctgtaggtttaccatccttttgtttcttaattttagttgactgtagagctgtctttgtttcgcataacctcttgatggctatattatgttttattctcatcccgccctccccaacagcattccttgtttgcaaatatgtagtttcagaagaagaaaaaaatagatggtatacctatcctgttggacatagactacaggctctgtacctattcaaataaatattcaaatgtgaaaaaaaaaa

SEQ ID NO: 714471 - DNA, 396 bp, Homo sapiens
  misc_feature (396)..(396): n is a, c, g, or t
ggtcgtacgaacctggtatgagggaatacgcctcttagtccgtatagaacacgggacccttattcaacaccgcggaactagtagtagcaaaatacggctaagtcccatagttccccctcgaaacatgacgtatttacgacagaaacaaacttaacggcggaagacctagacggagtcgcaccgagcacggacgtaaagactaaccccgatctcaacctagttcactgttaaaagaaaactcccgactcataggatcggatttaggaagacgaaagggataaagacgtcgtcaaggtaaactctaatcataccggttctgacggaaacacaggtcgttcagccggcgtcggacaggtcacggttataacggacacctcctacggagggatcttgttn

SEQ ID NO: 714472 - DNA, 227 bp, Homo sapiens
  misc_feature (14)..(14): n is a, c, g, or t
  misc_feature (30)..(30): n is a, c, g, or t
  misc_feature (148)..(148): n is a, c, g, or t
ttccttttccccanttgtcaacccctcttnaaaggaggaacagataagactgggtcagcctagtcatgcctcccaacttgtggtggtattatgtgtacacacattacacagggtggatggagaagaggttgctgattaaaattacacntcccctataaaggggaagggggagtgtgacactttttttccatgttcaagtgaaaataaataatgtccctcaaaaaaaa

SEQ ID NO: 714473 - DNA, 327 bp, Homo sapiens
  misc_feature (266)..(266): n is a, c, g, or t
  misc_feature (305)..(306): n is a, c, g, or t
ctcactttgtcacccaggctggagtgcaatggcacaatcttgactcactgcaacctccgcctcccaggtacaagcaattctcctgcctcagcctcctaagtagctggaattacaggcatgcaccaccacacccggctaatttttgtacctttatcggagacagggtttcgccatgttggccaggctagtctcaaactcctggccttaagtgatccacctgcctcggcctcccaaagtgctgggattacagatgtgagacaccatgncccagctgagatctttttcttcttttgcagcaggagagnncaaaatagaatacatttaatg

SEQ ID NO: 714474 - DNA, 873 bp, Homo sapiens
  misc_feature (69)..(69): n is a, c, g, or t
  misc_feature (76)..(76): n is a, c, g, or t
  misc_feature (229)..(229): n is a, c, g, or t
  misc_feature (303)..(303): n is a, c, g, or t
  misc_feature (349)..(349): n is a, c, g, or t
  misc_feature (397)..(397): n is a, c, g, or t
  misc_feature (433)..(433): n is a, c, g, or t
  misc_feature (439)..(439): n is a, c, g, or t
  misc_feature (442)..(442): n is a, c, g, or t
  misc_feature (456)..(456): n is a, c, g, or t
  misc_feature (497)..(497): n is a, c, g, or t
  misc_feature (510)..(511): n is a, c, g, or t
  misc_feature (514)..(515): n is a, c, g, or t
  misc_feature (517)..(517): n is a, c, g, or t
  misc_feature (520)..(520): n is a, c, g, or t
  misc_feature (522)..(524): n is a, c, g, or t
  misc_feature (530)..(531): n is a, c, g, or t
  misc_feature (535)..(535): n is a, c, g, or t
  misc_feature (538)..(539): n is a, c, g, or t
  misc_feature (545)..(545): n is a, c, g, or t
ccctctcccttctgttcagtaaacaaactgaagcccaaaaatgaagccgtggccaagcgtgacccaganatggggngtcctggcccttagtgacacagctcctctctggggcaccctatctgcttgtctcgtccaggaagcgttagggctgatgggtgactcagcaaggcagtgtcagagctgggactgggcgtaggcctttgtcctcatccccagcactggcctcccngtggaagatgaacatatcccagccacctgtgtacaggggctcactttgtgtgctccttgttgcctgagaagaanccttggggtgccagggtgggggcagaagcatgcgctccgcccccgnccaccccccccccccctcccgtgtgtgtggtcacaagaggacccctanccacctgccccctcgacgaccccccccccggtcccngacccnccncccaaccccccccncgaggaccccacccccccccctcacccttgccaagtgagcngctcacagtgtgnncanncngcncnnnctgganncccnccnncctggnccttgtggggcaaatattgggtccccaggctggaaagatggacagaggccaatgggtgaaggctttgaagagcacacagaagccctggcccccacgagagctggagaccatgtatatgcttcaaagccactacggcagggacacactctgagcatgtgtgctgcagttcaggtgatacatttaccagtgttcttgtttgtgtgtgccaggaattgatttggaaaagtgaatacattaaaggtgaatgtgaggttacttttataaaaggagctatattagtaggctgtttgatatccaatcattggtttaacaataaaggcaatttgtt

SEQ ID NO: 714475 - DNA, 399 bp, Homo sapiens
aaatttatttggcttattccggaaaaaccccccccttatttcacctaccaaaaaaaactgcttcagggcgtgtaaaatgaaaggcttccaggcagttttttgtttaaaaaaccctaaaaaagggacagggtttaaacccccaggctgtttacactttagcaggccctttttgggttggctggaggacctgtgaaaaacatggaaaaattggggctggaaacccccatggcttttcctcattgttattacaaagggaggttctttgtgtgcccactggtttgaaaccctttttccaataatgatagaatagtccccccttgaaacctgaattggcccaaccccaaaaagaaagcccaacttgatcctcaaaaaacccttttagggacaatacccgatgag

SEQ ID NO: 714476 - DNA, 81 bp, Homo sapiens
ctcctcagtgactctggcttctatctctgtgcctggagtctcacctacggacagacatccagcggaaacaccatatatttt

SEQ ID NO: 714477 - DNA, 247 bp, Homo sapiens
aaaaaaaaaaacgcattccagccactcagtggagagagatgggagggctaaggagcagatgatagggtataatttaagggagctactacagaaagcttgggccagagatgatggtggctcccacaggatggcagtgagtgccctcactctgctttcttctttgaatccttgcaggtggacaggtagacagcagcccagcccagtgccttgaagagcccaagcataagataatgtgatagcggggtca

SEQ ID NO: 714478 - DNA, 496 bp, Homo sapiens
atactcaaggggctataaacccgtatcatataaagtggccattggaaaagtcatgataatttactgcatattagttatgctggaaacagaaaatggggctttgcattggtgtcttgggtattattgaacacaaggggtcaaatatgatagtccataaaagctaaactatatactagtcacattttcaataatctaaaaaagttcaggtcagaaatagatgaaatctcaaagaatttcacaatcttaaaacacagtgctcaggctccttagatagaagacagctggctcctgccacagaattgccctttaacacacccaactgcattgtgagctttatggctttgaaaattacgacacaattcttttacgactcctccccttcaccatttgtgtccacattaccattgctactgtctggcatagcagtcctttttataaatctaccctaaggctccttccatcttgtactgtttcctttctccctcccatctgctcc

SEQ ID NO: 714479 - DNA, 106 bp, Homo sapiens
cggaaggaaaaagaagaaaacggaagccatgagatgatatgagtgcaaacggttctacagggggacaggacccagggagcatagcactggtacaaaaacggacaca

SEQ ID NO: 714480 - DNA, 819 bp, Homo sapiens
gagcggggtgctgtgcgtggatcgtggaggtggggccgaggcagctggccgcctgagccccgctcgtgccttgtgtgaacactggtggtgctggtggctgtgcctgctggctctgtggctgaccctgctgggtgcactagtgctctgggtcccacctgccctgagtgctctgctgctcgagctgtggtcatgtctggtccggctgtgggccttgctgctgtgtggccctgggccctatggctggctgtacggactgtgctcttgtcttgcagctgtgctggcatgcggcgggccctgtcttggccttgtgcgtgttgcgtgctgtctgcgctcagcttgcggcccgaggctcggtacggcgccttctgcaagggggctcacgctgcacagctgctcaccttcttcgacctggcctggcggctgcgcatgaacttcccctacttctacatcgttgggctcggtgatgcttaacgtcctgctgcaggtgcggatcgagtgagcgccggcgtgcggcgagcggctgaaggcccttgctgaagcgggctgccagtgtcccctgccagaacccggcctgggtcgccggcatgaaggaagctgggccagcggcgagggaggcggaggctggggcggatcggacccctggactctagacctacgccgacagggcacaaacgtgcgcagccctgagcccggctgcggacatcagcccgggggcccatggaatcgcgcagaaacgcactgaatgggcccatgccatcggagctccagaaactaccatgggatcggacgaacctggtgcctcataattggccaaagagg

SEQ ID NO: 714481 - DNA, 224 bp, Homo sapiens
  misc_feature (8)..(8): n is a, c, g, or t
  misc_feature (12)..(12): n is a, c, g, or t
  misc_feature (18)..(18): n is a, c, g, or t
  misc_feature (50)..(50): n is a, c, g, or t
  misc_feature (52)..(54): n is a, c, g, or t
  misc_feature (56)..(56): n is a, c, g, or t
  misc_feature (69)..(72): n is a, c, g, or t
  misc_feature (100)..(100): n is a, c, g, or t
  misc_feature (117)..(117): n is a, c, g, or t
  misc_feature (120)..(120): n is a, c, g, or t
  misc_feature (125)..(125): n is a, c, g, or t
  misc_feature (168)..(168): n is a, c, g, or t
  misc_feature (206)..(206): n is a, c, g, or t
  misc_feature (211)..(211): n is a, c, g, or t
ctcgtgcnaatncggcanagaattgtctctaaaatacataagtaaatttnannnanaaagaataataannnnaacagtgaatgttgatgtaacatcttanataatagagcaccaganaantttcnaccaaatgagacaacaactttagggtaagttcatcctctaggngctttctaatgtgcactcagttcctgtatactgtgtgntttgntctgatcaagggg

SEQ ID NO: 714482 - DNA, 1271 bp, Homo sapiens
  misc_feature (268)..(268): n is a, c, g, or t
  misc_feature (272)..(272): n is a, c, g, or t
  misc_feature (297)..(297): n is a, c, g, or t
  misc_feature (342)..(342): n is a, c, g, or t
  misc_feature (351)..(351): n is a, c, g, or t
  misc_feature (359)..(359): n is a, c, g, or t
  misc_feature (365)..(366): n is a, c, g, or t
  misc_feature (369)..(369): n is a, c, g, or t
  misc_feature (403)..(403): n is a, c, g, or t
  misc_feature (449)..(449): n is a, c, g, or t
  misc_feature (552)..(552): n is a, c, g, or t
  misc_feature (588)..(588): n is a, c, g, or t
  misc_feature (632)..(632): n is a, c, g, or t
  misc_feature (655)..(655): n is a, c, g, or t
  misc_feature (660)..(660): n is a, c, g, or t
  misc_feature (690)..(690): n is a, c, g, or t
  misc_feature (704)..(704): n is a, c, g, or t
  misc_feature (718)..(719): n is a, c, g, or t
  misc_feature (735)..(735): n is a, c, g, or t
  misc_feature (818)..(818): n is a, c, g, or t
  misc_feature (864)..(864): n is a, c, g, or t
  misc_feature (1125)..(1125): n is a, c, g, or t
tcgcacgcttttctatattacttcggttccccgtgcaaacggcaaacattggacgccatgtcgggttattccgaagtgaactgaagaacggcgggccggggaaccgagagggtttggttgcgaactctcaatttgggagagaagtcaagggcaggggccccttcatattgggacaagcaagagtttgggacaacccctgtgtggcagcaacattcacgttcaaacacagcaacgatggcacatcccttggatagcagacctaggcccntaanactatttgcaagcaacgcacatatnttctcatactcaatgcagaccacaccgctgtgcatattagagcgntctaatgcntgcgcacncagacnnacncacagacaagaggtgtaggacaaactcatttacncagacacagacacagacccacaggtggacacatattacccagagtntcaagtcagagcgtctcacacatacattgtggcgccgtgacagacgcccagagtatcctttacacaatatatctatcaatagggacagaacgcccaaaatctntctcgcgctgtgcccagacagtgcggtcccataggngcactgtgtatccatattggggcacaggcacacaggcacatatntcccacacttgtgatacaccccnacatngtggctaaatatcacaagggccttcacagnggtaggatgggggncacagggtatggcnntctctataagggtggngagatttggtgagatatatgagggtatggggacaggtgtggcgaccacagacacctagtgagcatccttgtgggagacacacncacatttgggtcctgttaatgtttgggctttctcctgtggcacatntggtctcaccacatctcagatcacatctacagggcaccatttccctattgaaggaaggaaggggccgacatgtgggagcctcaaataatgtgatatggggtgtgcagagggacaccaaaacttccggtggaacactgtgggcgcccacaaggggtgtgcaggcaacggataagcttgcgtggaactatataggtgcgaaagcgatggtcgtcgcttgtaaagtgtctcactgtggaatatctaacgagggggagggttccntaagtgggaaccacccaaatactggtgtttggagacgcacggtgtgggaacatcctgtatttggcacaccctgtggacgactggtttgactttttagaaggggtgaagaaccagcttgggagacctccctgttcttgtgatcgcgt

SEQ ID NO: 714483 - DNA, 233 bp, Homo sapiens
tacgttgttgagctgtatagttatcttgtcgctatgtaacaaattgatactcaaaattaatggtgttgaacaataaacacttattatctaatagtgtcagaagttcagaacatttcgtacaacaggcttagcctgggtacgttcttggctctcttgactgtcttcggtcaaaacgatcaagcttgaacgtttgcaacttactcttgaacacttgacctggatggcttggacgg

SEQ ID NO: 714484 - DNA, 1100 bp, Homo sapiens
cggagtgaggctgacagcggggaacctggtgagacccctccgccctccccgtgtgtggcagctggcctgatccccgtgctccgtgcgcgaggtgacggccgcgatgcgctcggcctgagtgttacccgtgcccggcccttcctcgcttccctcgactattccactgctgtctccgcagcccctggctgtcatcctgctgagtccctctgacggtgacgggaagatgtgctgcactggagctggcatggacgagctggcccagcaggcctgaggagggctcgtgcccggctgcgcggaaatgcatctcgtgtcggcctagggctttcttgcgcacctgagctggtgcctcgacctgggcgctggatgccgaaactggtaccccggctgggtgatcctggttgggcacttggcgcagctcgagggctgctgctgcctgcacgcactgcaatgggccatacagggcatgggaccggcgggacacataatgacggccgagaggacaccagcacacacaagcgcgagagagaccacagaaccaccgcaaagacagggaccgggagggccggccggcacaggtggcccagggacccgcgggacccccacaggagcgaaccgctggcgaccagatggctcggacagcacatcgtcacagggaaggccggacgggcaacgaccggacaggaatcgacggcgaacaacccgggaatacgcaacacgagccgggcgcccgccgacagcgcacaagggaccgccaaaagatgccccggcaacattgggggcccccgcgcaacgaggcgccacaggaaaccaggcttcgcagcgccatgcgaccgcggcgcgcaggagaggccgcggcgtggagcgtccaggcgaaacgccgccgccgccagcacccagaaccgggggggatcacaaccccacgggccacgcgagcgccgccaggcgacgccaaacggcgaaggagaagggcaccctagtgggaggcccaggccgcgacgacccgcgaccggcgccccgaccgcaccagcgcgaccaacgcaccgacgccgcacgcaccccagcaccgcatcagcgggcgcacccaggggccaacggcccgt

SEQ ID NO: 714485 - DNA, 1298 bp, Homo sapiens
  misc_feature (400)..(400): n is a, c, g, or t
  misc_feature (403)..(403): n is a, c, g, or t
  misc_feature (458)..(458): n is a, c, g, or t
  misc_feature (461)..(461): n is a, c, g, or t
  misc_feature (467)..(467): n is a, c, g, or t
  misc_feature (469)..(469): n is a, c, g, or t
  misc_feature (473)..(473): n is a, c, g, or t
  misc_feature (490)..(490): n is a, c, g, or t
  misc_feature (506)..(506): n is a, c, g, or t
  misc_feature (510)..(510): n is a, c, g, or t
  misc_feature (522)..(522): n is a, c, g, or t
  misc_feature (524)..(524): n is a, c, g, or t
  misc_feature (535)..(535): n is a, c, g, or t
  misc_feature (593)..(593): n is a, c, g, or t
  misc_feature (623)..(623): n is a, c, g, or t
  misc_feature (665)..(665): n is a, c, g, or t
  misc_feature (857)..(857): n is a, c, g, or t
  misc_feature (901)..(901): n is a, c, g, or t
  misc_feature (932)..(932): n is a, c, g, or t
  misc_feature (937)..(937): n is a, c, g, or t
  misc_feature (992)..(992): n is a, c, g, or t
gggcagcaccgagatctcgatgaagctaccgtgcaccgaggtgctcatgaagaaacgcctaccgtttgacactcatccatcagagccgaaccgagaagcccatgatgtgcataccaaccttccagtccactggctatagtatcatcagatagcatccaatagtcccaagcggccagtagatcttaatcgaagtctccgtctgctgcgatactgctcctattcttgtcatgcaagcgattcgaactccgtacatttagcaacggcctctccacagtacgaagtgatctgaccctatacgacgctaaggccctcggacagtcgtttcgcctccagccaacggcgcgtagccttagtcattatgctaaatacggtgtgaggtgagtccctaattccgacggcngcnctctttaatggaaagaccgtcggcaggggcgcaccagactgcattgagaaggaanctncaagcntnactnatgcgttgcgtggatanagtgatgctttgaacntccnaatactctcggncntagactgtgantgcgcgtcaggtacatattattatgaagacacaaccgtactcgtctcgacccggctcnatttgaccccgccgatcgcgtatactaatnctggacgataaggtggaatcatgaaactgtacgtgacagtcntggcttcctagccgaaagaagaataagccaccgagcgaaatcgaatattggatctcccgcggacccctaccagtcggttgggacgttaggatcctccctgtaccagccaactccgtggaccttgaagacgaagccacaggatcccaaacagctaccaaacggaatattgagtactcgttttgtagtaggggntgcgcctgaagaggcaaggctcataactttcgatggaaggtagngtgggtggatgccagcccttcggtaacacgnggatncgctggggtaccactcgttcctcggccggcctgttaacggtccaagtaacgaaancgggttacgggtatcctcaacaccaggcctggcttgaccaccagcaaccatcggcattagcgcgtgcagcattatgtgaacgatgtgtccatatgcttatgtggtccaagatccattccacctgcccacgatccccacgggtacgtctaacgaaactggttttatagccacacacgggaagggtgtactctatgactgtaaggacatgttaacgaacctgggagccaatgttatacgaagcttaccaatggaattccctccttatattgggaacttccaactaaatgtactcggcataaaaagacg

SEQ ID NO: 714486 - DNA, 287 bp, Homo sapiens
ttatctcgggagttcgggctgtctgccaatcacaagcaataacagctaagatgtgatcttctgcacaatatgtggtgttctcccgacttttgtgactgacatggtgtcttccgcatttgacactgtggccgtgaccaagagccccttgacatatcccctactgtcacggagcatccaggtattgttcccattcctcctggaattggggaaagccttccttatcccctgtcccacctcccctctccaagtaaagcacctgttgccctcagtcacgtggcctgccattg

SEQ ID NO: 714487 - DNA, 200 bp, Homo sapiens
ccccccccctttttggccccccgggggtccttttttttcccccccccccccccccccccccccgggggggggccgggaaaattttggcccccccaatttgggggggtttggggggggtttttttttaaaaggggggccagtttgcccctttgcttttttttccgggggggccccccggtttgggggctttttttccccca

SEQ ID NO: 714488 - DNA, 300 bp, Homo sapiens
ctcctaccccacgacaacatgggcagatgtgcagaacattaggctaagcgaaataagcagattcagaaagacgggtaatgcataatctcctttctatgtggaatctaagagtacaactcacagaagcagagagtagaatggcggctgccttgcggggtaggggaaaatgagaagcaattggtcaaagggtacaaggtttcagttacccaagataaagaagatctggatttccaaggtacaacacggtgactatagttaataataacggtattgtatacttgaaatttgctaaaatggtac

SEQ ID NO: 714489 - DNA, 1081 bp, Homo sapiens
ggtgaccagcaccatggcgggttggcaagaacaagcgccttacggaaagggcgggaacaagagggagccaagcaaggaaagtggttgagtccattttctaagaaagatgggtatgatgtgaaagcacctgctatgttcaatcataagcaacatattggtaacagacgcgtcggtcacccaggacccgaaggaaaccgaacatatgccatcatgtatgggtcgtcgacagggtctggtgtgcttaggaaggtgcagtctgtgcctggattagcgagcaatggatggaagttgccatttcacagagacattcgaagctgagttatttgaaggatggtatcagggggttaaaaaaccgtggagcagtacactaagctttccagtgtgaactggaatgctataccgcggtgaaaagaattgtgttgaccactgggtcaagagaaattgggagactaaatgagttggacaggtcagggtatgaatgggtcaaagcgaacataacgcagaatggggtgtgaacctatgcgctaatccgatacgtgctgaacatgggaggtggagggcttgatcgagcgtgaggacacagaacggacaagagcaaaaatgcgcggaattaacgagaacagaacccgtcagtgtcatgtctcgcaaggaaaaccaagagcaagtggtacgcgggaccatagaggcccggggacacgacacacgcaagtggaccgtggaccacgttcgagtggaacccccacggagcggaatgggtggccaggagaccacaaactggaacatgatggaaagaaggaacagactggggtgcgaaagaaaccaaatttggccagaggcccaagaaacccagggacaatgtgggcgcaaaaacaggaaacgatatacggaacaccaacggggggtagggacacaacatagcgaggaaggtcgaacagaacgcaagccccgccaaagtgggaagagagtccctgttcggaacgcaagacaaaaaacgggtacaagaaagaccggcgatgacgaagcaagagacacacccaagagataccaggacaacacagcaggaaaatagcgcgtacaaggg

SEQ ID NO: 714490 - DNA, 334 bp, Homo sapiens
ggttaaaaccacctgaaagtttgggtttggtggtttgggggccgggccacccaacctgtatggggcaggccaaacaaactaatgtagtgagtgtacctgtacctaaggcttaactgggaagggatcccgaccttgctggaactactgggaccaaaaagcggggtaccccacgcccctgcctgcactcctcgggggggtggggggtcccttgctccacccggactccttgggttgggtcccccatcccccctcctgccccgtggggcaatttaccctttttcatgaaagttttttccaatgaaaagtttttaaaaataaaatttttaaaattcta

SEQ ID NO: 714491 - DNA, 591 bp, Homo sapiens
  misc_feature (102)..(102): n is a, c, g, or t
  misc_feature (129)..(129): n is a, c, g, or t
  misc_feature (137)..(137): n is a, c, g, or t
  misc_feature (139)..(140): n is a, c, g, or t
  misc_feature (158)..(158): n is a, c, g, or t
  misc_feature (171)..(171): n is a, c, g, or t
  misc_feature (182)..(182): n is a, c, g, or t
  misc_feature (189)..(189): n is a, c, g, or t
  misc_feature (192)..(192): n is a, c, g, or t
  misc_feature (237)..(237): n is a, c, g, or t
  misc_feature (240)..(240): n is a, c, g, or t
  misc_feature (248)..(248): n is a, c, g, or t
  misc_feature (268)..(268): n is a, c, g, or t
  misc_feature (286)..(286): n is a, c, g, or t
  misc_feature (308)..(308): n is a, c, g, or t
  misc_feature (330)..(330): n is a, c, g, or t
  misc_feature (347)..(347): n is a, c, g, or t
  misc_feature (363)..(363): n is a, c, g, or t
  misc_feature (366)..(366): n is a, c, g, or t
  misc_feature (564)..(565): n is a, c, g, or t
atggagcattattcagctcctttttaatagaatgtgaagattacttgatatcaatttataaagaatttatttttcagaactgcatattattttactgtatangtatgccataatttatttaatcattcncatagccntnnaggttgattgctttcttngccttagcagcangtaattttcanctaagtnatngcacacattcacacgtaggaatatgcatgttggctaagttactanaanttagtgtngttgagctacagtctgtgtngtaattttgataagcatngccaaattgctcttcatagttnttatatcaattcagctctcatnggcagtgtatatacgtnagaatgagaatttcancanccctggccagcacaagtactgtcaagttttatcttggtcagactgataggcaaaaatggaatattgcagttttgatttaatttttctcatatgtattaggtattgaacatctttctgtttgtatttcctactttaagaactttgttcatattcttcacccatttttcttagtggctgaaaactgcacagatcttgttnnctttcatttcttcggagcccggtgga

SEQ ID NO: 714492 - DNA, 1788 bp, Homo sapiens
  misc_feature (1599)..(1599): n is a, c, g, or t
  misc_feature (1644)..(1645): n is a, c, g, or t
  misc_feature (1647)..(1647): n is a, c, g, or t
  misc_feature (1654)..(1654): n is a, c, g, or t
  misc_feature (1668)..(1669): n is a, c, g, or t
  misc_feature (1674)..(1674): n is a, c, g, or t
  misc_feature (1676)..(1676): n is a, c, g, or t
  misc_feature (1683)..(1683): n is a, c, g, or t
  misc_feature (1689)..(1689): n is a, c, g, or t
  misc_feature (1694)..(1694): n is a, c, g, or t
  misc_feature (1701)..(1701): n is a, c, g, or t
  misc_feature (1708)..(1708): n is a, c, g, or t
  misc_feature (1712)..(1712): n is a, c, g, or t
  misc_feature (1717)..(1717): n is a, c, g, or t
  misc_feature (1732)..(1732): n is a, c, g, or t
  misc_feature (1744)..(1744): n is a, c, g, or t
  misc_feature (1749)..(1749): n is a, c, g, or t
  misc_feature (1760)..(1760): n is a, c, g, or t
  misc_feature (1763)..(1763): n is a, c, g, or t
  misc_feature (1766)..(1766): n is a, c, g, or t
  misc_feature (1768)..(1768): n is a, c, g, or t
  misc_feature (1784)..(1784): n is a, c, g, or t
agcgagcgggccgccgccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggcgctttcatggaactatatgatcatatgggcaacattctgttgcagtctaccttctgtctgacggatatgccatcctgaaaaaggaaagaagctgaacttcaagttcctttcatttagccttggctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaacaccattggtgtgctggaggagcccctggggaatgcccgtctgcatggcgcccgctcatggcagcactgttgacacaaacacacccaggatcaancaggagctctgccggtcaacacgatggacttactgctggacttgnncntttaagntacacctggaatannttttngnacttccnagtggnactantgatagncggtatntctncccangctgcccgtgagagnaggacaaagccngggancgagagcaggnggngcncncatgaacgggaccggnccgg

SEQ ID NO: 714493 - DNA, 1706 bp, Homo sapiens
  misc_feature (1517)..(1517): n is a, c, g, or t
  misc_feature (1562)..(1563): n is a, c, g, or t
  misc_feature (1565)..(1565): n is a, c, g, or t
  misc_feature (1572)..(1572): n is a, c, g, or t
  misc_feature (1586)..(1587): n is a, c, g, or t
  misc_feature (1592)..(1592): n is a, c, g, or t
  misc_feature (1594)..(1594): n is a, c, g, or t
  misc_feature (1601)..(1601): n is a, c, g, or t
  misc_feature (1607)..(1607): n is a, c, g, or t
  misc_feature (1612)..(1612): n is a, c, g, or t
  misc_feature (1619)..(1619): n is a, c, g, or t
  misc_feature (1626)..(1626): n is a, c, g, or t
  misc_feature (1630)..(1630): n is a, c, g, or t
  misc_feature (1635)..(1635): n is a, c, g, or t
  misc_feature (1650)..(1650): n is a, c, g, or t
  misc_feature (1662)..(1662): n is a, c, g, or t
  misc_feature (1667)..(1667): n is a, c, g, or t
  misc_feature (1678)..(1678): n is a, c, g, or t
  misc_feature (1681)..(1681): n is a, c, g, or t
  misc_feature (1684)..(1684): n is a, c, g, or t
  misc_feature (1686)..(1686): n is a, c, g, or t
  misc_feature (1702)..(1702): n is a, c, g, or t
agcgagcgggccgccgccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcagatggacttccaggacttgggtctagtgttgctgagggtggatctgcagggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaacaccattggtgtgctggaggagcccctggggaatgcccgtctgcatggcgcccgctcatggcagcactgttgacacaaacacacccaggatcaancaggagctctgccggtcaacacgatggacttactgctggacttgnncntttaagntacacctggaatannttttngnacttccnagtggnactantgatagncggtatntctncccangctgcccgtgagagnaggacaaagccngggancgagagcaggnggngcncncatgaacgggaccggnccgg

SEQ ID NO: 714494 - DNA, 1414 bp, Homo sapiens
  misc_feature (41)..(41): n is a, c, g, or t
  misc_feature (1225)..(1225): n is a, c, g, or t
  misc_feature (1270)..(1271): n is a, c, g, or t
  misc_feature (1273)..(1273): n is a, c, g, or t
  misc_feature (1280)..(1280): n is a, c, g, or t
  misc_feature (1294)..(1295): n is a, c, g, or t
  misc_feature (1300)..(1300): n is a, c, g, or t
  misc_feature (1302)..(1302): n is a, c, g, or t
  misc_feature (1309)..(1309): n is a, c, g, or t
  misc_feature (1315)..(1315): n is a, c, g, or t
  misc_feature (1320)..(1320): n is a, c, g, or t
  misc_feature (1327)..(1327): n is a, c, g, or t
  misc_feature (1334)..(1334): n is a, c, g, or t
  misc_feature (1338)..(1338): n is a, c, g, or t
  misc_feature (1343)..(1343): n is a, c, g, or t
  misc_feature (1358)..(1358): n is a, c, g, or t
  misc_feature (1370)..(1370): n is a, c, g, or t
  misc_feature (1375)..(1375): n is a, c, g, or t
  misc_feature (1386)..(1386): n is a, c, g, or t
  misc_feature (1389)..(1389): n is a, c, g, or t
  misc_feature (1392)..(1392): n is a, c, g, or t
  misc_feature (1394)..(1394): n is a, c, g, or t
  misc_feature (1410)..(1410): n is a, c, g, or t
caccttatattatcagctaggatttaaacaagagatttccncagaagtctaccttctgtctgacggatatgccatcctgaaaaaggaaagaagctgaacttcaagttcctttcatttagccttggctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaacaccattggtgtgctggaggagcccctggggaatgcccgtctgcatggcgcccgctcatggcagcactgttgacacaaacacacccaggatcaancaggagctctgccggtcaacacgatggacttactgctggacttgnncntttaagntacacctggaatannttttngnacttccnagtggnactantgatagncggtatntctncccangctgcccgtgagagnaggacaaagccngggancgagagcaggnggngcncncatgaacgggaccggnccgg

SEQ ID NO: 714495 - DNA, 1937 bp, Homo sapiens
  misc_feature (1748)..(1748): n is a, c, g, or t
  misc_feature (1793)..(1794): n is a, c, g, or t
  misc_feature (1796)..(1796): n is a, c, g, or t
  misc_feature (1803)..(1803): n is a, c, g, or t
  misc_feature (1817)..(1818): n is a, c, g, or t
  misc_feature (1823)..(1823): n is a, c, g, or t
  misc_feature (1825)..(1825): n is a, c, g, or t
  misc_feature (1832)..(1832): n is a, c, g, or t
  misc_feature (1838)..(1838): n is a, c, g, or t
  misc_feature (1843)..(1843): n is a, c, g, or t
  misc_feature (1850)..(1850): n is a, c, g, or t
  misc_feature (1857)..(1857): n is a, c, g, or t
  misc_feature (1861)..(1861): n is a, c, g, or t
  misc_feature (1866)..(1866): n is a, c, g, or t
  misc_feature (1881)..(1881): n is a, c, g, or t
  misc_feature (1893)..(1893): n is a, c, g, or t
  misc_feature (1898)..(1898): n is a, c, g, or t
  misc_feature (1909)..(1909): n is a, c, g, or t
  misc_feature (1912)..(1912): n is a, c, g, or t
  misc_feature (1915)..(1915): n is a, c, g, or t
  misc_feature (1917)..(1917): n is a, c, g, or t
  misc_feature (1933)..(1933): n is a, c, g, or t
agcgagcgggccgccgccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggcgctttcatggaactatatgatcatatgggcaacattctgttgcagtctaccttctgtctgacggatatgccatcctgaaaaaggaaagaagctgaacttcaagttcctttcatttagccttggctctgcgcttccaccttctctgtggctagaaacaggaccgtccagaagtcacctgtaactgccctatcttgcaagttctgattttggcaaaaaaaaaaaaaaaaagccttgacaaggttggattcacttctttccctggattgtgtgtcatccaaggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaacaccattggtgtgctggaggagcccctggggaatgcccgtctgcatggcgcccgctcatggcagcactgttgacacaaacacacccaggatcaancaggagctctgccggtcaacacgatggacttactgctggacttgnncntttaagntacacctggaatannttttngnacttccnagtggnactantgatagncggtatntctncccangctgcccgtgagagnaggacaaagccngggancgagagcaggnggngcncncatgaacgggaccggnccgg

SEQ ID NO: 714496 - DNA, 1037 bp, Homo sapiens
tgtgttaaattaactatatgttgtgggtcccttaatacctctatcgcgacttccggtgaggtacccatgtagatgtggactgatgaagagtagagaaacgtttccccaaggtcactaacacacatgttaatcaattatcactttctattttttaccaatatttgagattgaacatctagactgactgtcaggtatgcacgtcccgttccttatttggccatatcagatacgaatatacgttatactaaagtcagtctacatgttagacttctctgaggacaagaaacggcctcgtgtatccgatcattcctttaaactggcttggaaacaggacttctatatattactgacagggtctctgggaaagcctggttcactatctcgtgtagttctaagttggtgccactcgttccttggccttgggaagggcagtaggaagaaaggagatctacattcggtgataaagtcctgtagtacagggctctgtggctcgatcggccagggacactcttggagacgtacattccatcactttaatctcgcgcacgaacgaagatactggcaaacttcattaacgttcatttaaagcaactttgttccaggtggttggaccctggagctttcaaacctattggacctttttgcacgtctcaattcaggacatctaatactaggggctggcctcccaatggggctatttttcaacagccgcccgagttcaaagttagtaacatggcgtatggagtaacaaccttaaattcttcacctataacgagcaaacatccttctccatttattcatgggaaaccgtttcacgttttaagtgggccttttcaaccgtgggttgagctccccaggttaggttgatatgggactggttctttcaggcttaatttgaacgcgtaaagtgtcgcccgggaattagagtttgccacctgtggctcagccattctaggggacaccccactaattccccgtcatgttagacgttctcatccccaaattgggcggaactcttcacatcggcctggtgacca

SEQ ID NO: 714497 - DNA, 1731 bp, Homo sapiens
  misc_feature (198)..(198): n is a, c, g, or t
  misc_feature (251)..(251): n is a, c, g, or t
  misc_feature (1542)..(1542): n is a, c, g, or t
  misc_feature (1587)..(1588): n is a, c, g, or t
  misc_feature (1590)..(1590): n is a, c, g, or t
  misc_feature (1597)..(1597): n is a, c, g, or t
  misc_feature (1611)..(1612): n is a, c, g, or t
  misc_feature (1617)..(1617): n is a, c, g, or t
  misc_feature (1619)..(1619): n is a, c, g, or t
  misc_feature (1626)..(1626): n is a, c, g, or t
  misc_feature (1632)..(1632): n is a, c, g, or t
  misc_feature (1637)..(1637): n is a, c, g, or t
  misc_feature (1644)..(1644): n is a, c, g, or t
  misc_feature (1651)..(1651): n is a, c, g, or t
  misc_feature (1655)..(1655): n is a, c, g, or t
  misc_feature (1660)..(1660): n is a, c, g, or t
  misc_feature (1675)..(1675): n is a, c, g, or t
  misc_feature (1687)..(1687): n is a, c, g, or t
  misc_feature (1692)..(1692): n is a, c, g, or t
  misc_feature (1703)..(1703): n is a, c, g, or t
  misc_feature (1706)..(1706): n is a, c, g, or t
  misc_feature (1709)..(1709): n is a, c, g, or t
  misc_feature (1711)..(1711): n is a, c, g, or t
  misc_feature (1727)..(1727): n is a, c, g, or t
gggagagacacctgggcgcattcgcctaacagaactacagagcaagcaagagcattgaggggcatgtcgagcacgctggtgggtgggggacagtgtggtgaaggagggcaaaggagggggttagcccagaggagaacctggggaggcaggtcctggagctgggggtgcagcctcagagctgttgagcagctgggaagnctgctaactttgtgagcccaacctggagaggtctgatgggaatggttactggngagggccccacatcctgagctctgggaatcttgtgtgttcatgctgcagatggacttccaggacttgggtctagtgttgctgagggtggatctgcagaggtgagagaaatgacccctttggacttgggtctagtgttgctgaaggtggatttgcaagggtgagagacgtgacccctttgccctcgttgcagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaacaccattggtgtgctggaggagcccctggggaatgcccgtctgcatggcgcccgctcatggcagcactgttgacacaaacacacccaggatcaancaggagctctgccggtcaacacgatggacttactgctggacttgnncntttaagntacacctggaatannttttngnacttccnagtggnactantgatagncggtatntctncccangctgcccgtgagagnaggacaaagccngggancgagagcaggnggngcncncatgaacgggaccggnccgg

SEQ ID NO: 714498 - DNA, 1037 bp, Homo sapiens
  misc_feature (293)..(293): n is a, c, g, or t
  misc_feature (1037)..(1037): n is a, c, g, or t
ggccgtcgcgccgggtgggcggcatggttcgggtgccagcatgggggcttcgatggtgactgtcaagcaaagagcgcggcgagggttcgacagctgcggtcgagattggggtaccatgaggaggagctgggtgaagaaatggtcgggtgagttcaagggtgaagaatgcgtgaaggaggattctggggaatgggacccaaggtgacctggtaacgggttacgtgtcgctgtccatgtagacgagcggcgtcgaaggagaattccgggacagcggcggagcgcgcgaatcatgncccctttttccccggaagatcaccctatggacttggtggaggcaggcgcgacggttgggatgctaaagccttggccacgccacagatcgcgcagaaaaggcaacgacgtgttacccgtggggaattagcaggcgctctgaacgcatgcacggaggacacgcccattgccagtgttaccatttgcacacggtgaaggcttggcgtgggcctggttatcccaatgcaagctgctttggtaaagtgctcccgtaatataccactgcaactggtttgccaatcgggtgaccgaacaggaaattccccagggtgggcagtaaaacggcacaaggaaattccagaggggaaaaaccggacagaggaacgttccggaaggccgttcatgggggggctttccaaattggagaaccaatctttcctttccgcgtttggactcactttggcggcaccgctaaccacaacgaggcggcgggaatgaggcgggtgaggcaaccaatttggggccccgaacccatttgggggcgcgcttttttacgtttccgcaaaagaccacccttttcatccgcgggcaaactataggcgtatgctccccccaccaaaaattttcctgtttatttaccaagccctttgtggggaagacagcacgaaaaagggggttttattccgattatatagagggtaacaccgccgtagagaggaatacaccgccacaaataataatgggactaggccccgcgatatatggan

SEQ ID NO: 714499 - DNA, 324 bp, Homo sapiens
ataaaaataaaagcaatgtgcagaaagaggctggccacaaaaaggtcacatactgtatgataccacttatatgaaatacccagaatgggtaaatccaaagagagcatattggtggttgtcaagggtcggagggaggatgaaatgtgtgacagctgcttaatggatggaggatttcctttggggtgatgcaactattttggaactaagaggtggtggctgcacaatgttgtgcatggactaaatgtcacagaaatgtacatttttaaaagttaattttatattgtgtaaattttccctcaataaaaaaatcaggaaaacagcaaa

SEQ ID NO: 714500 - DNA, 140 bp, Homo sapiens
ggtcaggcactgaagcctggtcaggcactgaagcctgggtgacagagtgagactccatctcaaaaacaaacaaacaaagaaacaaaaaaacaaaaaactgtctgtggcttattaggcttcagtgtgaccaggcttcagtg

SEQ ID NO: 714501 - DNA, 279 bp, Homo sapiens
  misc_feature (63)..(63): n is a, c, g, or t
  misc_feature (90)..(90): n is a, c, g, or t
acgcggtactctctcgggcgaccattcaggcgcctgcctcacaagaaggagactctcccgggnctccgccgcttctcgggatcggtcgcngtacgcactggacgcctcggggccatctccgccactccggatcggggatctgaacccgactccctttcgatcggccgaggtcaacggaggccatcgcccgtcccttcggaaacggcgctcgtccaattctctcaggaccgacttgacctatgttcaactgcttgttcacatggaacccttttccacttc

SEQ ID NO: 714502 - DNA, 1340 bp, Homo sapiens
tttgccgccagaacacaggctgtcgctgaaaactaccccctaaatagccaacacatgggacacaggaaacagactcatactcagacattgctcgctcacttggcacacgctacgattcggcgcacagctccaccactactggccactctgactctactacaactgccggctggccactccgcaccacaaaggacacccatctgcaacaaactttgcagcacagcgcagcgcctgcctgacgcactggcggaacagcggccctcccttcacagtaatgcccctggcgctccttgcgactaaacaccctgcgacacacgctgcacgccgctgcaaccgctgcgctatccaccccacttgcactactcctccctctgctgcgcacccaccttctcgcacgcacccacggccaacgcctacctactgctgaccctacctccactctgcactgcccccagcgaccacacgcacgcacctcttactccaaacaacactgcactctacaacgggcacactctccagcgcctgcacccctgctgcctgctccctgcactctgctctgcctgccctggcctgcttcgcgcctgcacactcctgcacacggcctggcctactcgtcccaacgcaactgcgctgcacgaccctgcagcagccacttgcccctatctgcgacttacaccacctgcggctggtgcacaacccaactaactcgctcggctgctttaaaccaacacactgggcacttccaccctgaggcccaccccttaccagctcacgcacacgcaccactactgcaggcacacactcgctaaaacgcgcaaccttcaagcccacctctacgactccaccccacacacactttgggcctaccaacccccccgtaccacaggctacgccactttctgctggccaaactcttcctgcctccgcgcacactgcgtgacccaacattgccctgggcgccccacgttgcctaaaacattgccctttggaccccaaggcgacatcgcaacagttcaacgccgctaacggattcgccacatgcccaacgggcaaaccaccgccagccctgtgacgccacatccggacatggcagctcccttacccaccccacactttggccccacaccttggacaagggccccttggccggcgcaggccaacccccacggaaggctaaccacacccacgggcggccaccacagcgggacagatccccaggtcagcccgccaagcagaaaaacgaagagactcgcaacaacgccgagcaaacagcagcctagccccctatgcgcgccccgcacaagcgctatcacagcacagcaaaaacatacgagcagaaa

SEQ ID NO: 714503 - DNA, 122 bp, Homo sapiens
ccttccccataacccgacgtccagtagttgcggcgccaggaattgagttcctcgcgggccgcgatggccgatgaagtctgcaggtgatggcctggagcgccttcgtggtaaacggtggtgag

SEQ ID NO: 714504 - DNA, 304 bp, Homo sapiens
tttttgggggccccttttttaaagttttaaaaattggtgccccggggggtccgttttttaccccttacttgggggttttgccccccctttccggggttggggttttaaggggttttttcccccccggttgggggaggtgtttcggggtttctgttttggaatttaacccggtaaagttaatgggttaaagggctgggttttttctttgtttgggtaaaacctattttggttcggcctgggccttattttttatccccttttttccccctttccgccccaattaagttttggttttttcccccca

SEQ ID NO: 714505 - DNA, 806 bp, Homo sapiens
gcctgtaatcccagcactttgggaggccaaggcgggcggatcatgaggtcaggagttcgagaccagcctgaacaacatgatgaagcccccatgtctactacaaaatatgacacattcaggccagggcgtggtggccggggtggcctggtaagttcacaagcttacttcaaggacgggctgaaggacagggagaaattccgccctacacacttgacaggcaggacggtcacacgtaaagcccaagaatacacagccactggcactgccagaccatggcgtgacccagagcgaagaacttcaatactcaacaacaaaaaacaaacaaaaacaacaaacaaacaaacacacagacacaacacacgcaaagggcaacacccacagacacagagcctataacagaacacagcagagagtgagagagcacaccagaggcggacacaagaaaagagaaaaaggagaacacatggtaggaacaagaaagagagaccaccacagagagacaacaacggagtgaacaaaggacgaacaataacgaccaacgcgagagccaaacgagcacacacaaacacaaaacaaccacacccgacagcggtgcagaagaaacaacagacgacaacgggatgcacagatacacagaaacaagaaacaaaaccagagaacgaagccaaaacacagagacgaagagcaaacacactgcacgcgaacaaagccatgaccacacacaacaagacagacacgaccacaagcaggaaacccacagaagcaaagcactacacaaaagacaacaaccgccggacccaccaggc

SEQ ID NO: 714506 - DNA, 295 bp, Homo sapiens
tcggttaacccaccctaaatcttgaagatgagagaactacatcagcagcagatagttatatgcgtgagccaatgtttacataatacagaaagtggaggctttttctagattaagatgctccacgcagacccgcactaatgagtggtctggcaattcttactgcaagcccagcaacttaagtccacacctggtatatgaccagctgactggaagacctggttttctagatagaccagtattagttattgaatagagaatacatgcacctatatagtatagttagactgatcctgca

SEQ ID NO: 714507 - DNA, 435 bp, Homo sapiens
aatggaagatcttacctttttctatcttgtaactctggggttatggtccccctaagagatagcactttttgtatgggggtaattcagctgcatagataaccagcttgatccctggtgaaatgaaaagccttccttctcctgaagcctctttccgccctgccctccactaacaacactgaggagcacaagcccaggcttgcccacctggtaggaacggaagaaattagaacaatgggagccttggctcccctctcgtctcctcccctccttcttgtcgctggctttgttgaggcccacttcccagaggctcctgggcctgtgaatgcaggagctcattctcccctcactgctgaagtctgtgacagcttcttcctccagttatgtctttcttccaaagcaatttcttaaccatcagccatgtgctgctatttctag

SEQ ID NO: 714508 - DNA, 509 bp, Homo sapiens
catgggtaggaaatacttttcctgcccatttttttaaatatcagcacctagtgctgacctggcactagtaacccttgaataaatcttgaatggatggatgaataactgttagaggatacagcatgccaagtacttaatagaggtacagcacagttcgggggaggggggtgaacccaagtttagggccccactgtaatggccatcattattgggtagaaaacacaacatgaggctgggcaccgctgtcacgcctgtaatccaagcactttgggaggccaaggtgggtggatcacctgaggtcaggagttcgagaccagcctggccaacatggaaaaaccccatctctactaaaaaatacaaaaattagctgggcttggtggctcgtgcctatggttccagctactccagaggctgaggcaggagaatcgcttcaaccaagggggcggaggttgcagtgagctgagatcacctcactgcactccagcctggagacaagacgccatctcaaa

SEQ ID NO: 714509 - DNA, 168 bp, Homo sapiens
aaaaaacaaaagtagtatgaaatatgtcgaagacattgatttttttgatttaacctttatatatgatatattcttatattaggatttttgagggatttaaaacaatccaaattcgacttgtagactactagtttatatactgtagactggaccacctgaccatctgac

SEQ ID NO: 714510 - DNA, 451 bp, Homo sapiens
gactgtagagatagcgtcagaagcattgctacgagagcaactccatgttgaataggggctgggtaaaagtgtcagaggtatttgaaccagagcgactccattttgagtgagggctgggaaaatgaggctgagacttactggcctgcattctcagaaagttaggcattcctaccctctaggattgaattgggacccctttcctgtaacatatttctggtgaccacagaagggactatagtgcagaaacgttgacccaacggctacctttgcgtaagtgttggggtcctgtaacatatttctggcaaaccacagaaaggatgatactgaagaaatccccccaaccccaaagaaatagactgcagcactgattggacgactttgggtaagtgatggggtaccgagtaacaaatgggattgggttagaggcccacttaggggagttggagtttct

SEQ ID NO: 714511 - DNA, 1369 bp, Homo sapiens
gggagagcgagaaggaggatctggggtttatcttctgggcccccgagttctgcgccgccgttaggagcaaagtgatttatgcacatgcgtaccgacaggactgccattctatggaatacagctgacagggatcaaagtaatgaaattgcaagctaagtgctacagagcgaggtccaggatccgctgcgagcccatggtcagaagaaagctgagggggctaggtgccggtctagtcgtccctgtgagtggtcaatgacctttgtgatgccgccgttcttgagccgcccgttgtcgcgtggcagacaatactgggccaatgcacaccaataaccctgacctcgttgcgcgagggtatgcaaggggcttggtcgctcgctttcgcttgcccatgacacaggtaggggcgtgcctgaggaggcgcatccctaagaccaagaggtgggatggtgccataatcacacatttcatcccgcgcaaggttggcccacaaacagggatgctcgcacacatgcaccacgctggtaatatgttgccgttcgtcccggctccaaatccgcttgaagcggtttactaggccgtgtaacccataaactggcgtgttgggacgtacgtttcccgacttgtcctactgttggggtcgtgagaagcaggatgcagaggcgtttgcgcccctcgcatgggcaagggctcaagctcttggtgggggggggaggcccatagtcattctatatattttctaagcaaaccaaattccacgcgattttctccactaacgcatgggggttcacattccaccacttttaccccaaattgtcgtggaactaaacatctcttaaaacgcggggcatattatgtttgcacctcgtgatgggcaattttggttcgtgctcttaagagatatcctttgtaggtgacttcatcagtttgggaaacttcgtttctagtttgggagccagattagaaccaccccccaattctcgcggttggctaagcccgagagacgtttggtgtgtgccctcacttctctccccgcaatttttaaccacgcaccttcggtgttcctatccggtgaccttagttttccgatttggcgaagaagcccaagtgaagcaccaagggtttaaaggtggggagccctcttcggaagtataaacaccccagaacaacaacggggccctttgttacttcctgagaggcgtggactgggaacgaaaaagggaggcgtaacagtcgaacaccttggggccaccaagtgggctacgatgtacgacttgctcccctgtggaaccccctaggctttgttctctgctaaccaatgacgtggggtagacaattccttgccgggcgtggtccggcatatattagagtc

SEQ ID NO: 714512 - DNA, 397 bp, Homo sapiens
  misc_feature (155)..(155): n is a, c, g, or t
cctgcagcagacacagcaaaacttttcaggcgcaaaataactctgcacttaaagaaaaatagcaaattaaaacacaaaatcctaacaagttaattaacgctctgcattagcacactggtatctaaaacacacatctcacagcacgtctctaatcnctacgggtaaacaatccttgacttatccagaggtgcatatctaagatccacatagcttaccaagtatcttctatgggacgtaggccataaagggaaaccaggaaaacccgacatattaaaaaaacagttttcttttcggcttaacgttttcctggaagccgaatctgaagttggcggaggacgtccagtcggtccctcgtcctttctccgttgaagtccatcggtcctccctcgttcgtccc

SEQ ID NO: 714513 - DNA, 151 bp, Homo sapiens
  misc_feature (10)..(10): n is a, c, g, or t
  misc_feature (77)..(77): n is a, c, g, or t
  misc_feature (117)..(117): n is a, c, g, or t
aagccaagtnagacgggctctgggaccatggtgaccagggtcttcccctgctccctggccctcgccatctgccaggntgaaaagaagcctcagctcccacaccgccatcctcaccgnccttcctcgggagtcacttccactggtggaccac

SEQ ID NO: 714514 - DNA, 915 bp, Homo sapiens
  misc_feature (705)..(705): n is a, c, g, or t
ttccccccccacctgggggggtccctagcaaccgcggagttccttgtctcgtggttctcggctccgatttatttgttgtggtttctcgcccacaattgccttctcttctcttggccgcctttcccccccgtggaccccctcgtgccgtccttgcggatctgattatggccgcgttctcgtttacaccggttgggtttaatatttctcaactcttaaagagggttctttcctctcctcacgaaaacttgggaacgtttgtttcaacaaaaattccttggacaccgacagaattccacgcgatttctctcaacctagatataaaaaattttaagccctttttgaattgaggccccttctccacacgtgttttgtacttatcacgtcaacccccctgtttctgtttgtaaaacacactggtctttctgttttttttggcgtcttgctttctttcgagtctttttttcgtcttgtgagcgaacacacacctcgtgcctataagagtgacactctctagaagctgtttacccgttcttgcactcttcccacatctttgtgtttgaaatactacttctgtgaatcttataaatatttttcttttcttatagctcttgtataatatttttgcggggataactcctcacttttgtcaccactcacagtcaccacttactcggtatcttcacggcgctacgacgtgattttttntttgccacgcacagtatgtctctaaaattgtgatggcccaccaccccattgttatagaaatatttgtgtttaatttgcccctactagaaataggtcaacaagtttctgggcttgctaccatttgttaactcccctggccccggcgaatatacctgtttattttgttgcccccatgcagaaataaaagtgaagtaagtattttggggccca

SEQ ID NO: 714515 - DNA, 296 bp, Homo sapiens
aggatccccgttggtatgcccacgatcacgcaaatatgtaactcagagaaaggggctgtttagaaccttatctgaagagttgtcgtatgttaggtcaactgatccaactatgattgagacactgatagcttgaaattttgacgaaacttggcaaatgaagccaaattatcaactcttcttcgagaatttcagacctatgtgaacagcctaggataaactaatttgcagcagccactattcagactctcggccgatgtgcaaccaacatcgttgtcagtcactgagccgtgcctcaa

SEQ ID NO: 714516 - DNA, 171 bp, Homo sapiens
gggtgtcatgaagggtacagctcctaagaaccccacataccaccctccatttgtcaagctcctctggttacgatcgatggccttgtcgtcactcacaccggaccccctcagagggagagatgagcttgtctaggcgaccatttcctcccatgaagcttctgatttataccg

SEQ ID NO: 714517 - DNA, 395 bp, Homo sapiens
  misc_feature (191)..(191): n is a, c, g, or t
tcaccatataaacctggtaaaatcaatgcagaattacagtgatcatgtaaatgattacagcaagtcacacaactaatctaattgaagtgtgcttattttactcaaaaggacttgttatatggcagacaagccaagttttaccacataaatatattaaagttcggtgttgttaatgaatccccgctttaaanccgcaacaaaggtaaggaagcatatagtgctgatatgtaacatctcagaatggttacatttaaaaacaaggagtagttgcctgacaacagtaccattattggaacaaagtaatcacttatgtaagattatctagatatataacaaagcttgcagtagaaagaagcgattcaaccttgtaacaaacatttcaaggtagctcgtgc

SEQ ID NO: 714518 - DNA, 669 bp, Homo sapiens
  misc_feature (16)..(16): n is a, c, g, or t
  misc_feature (25)..(25): n is a, c, g, or t
tggaccatccaggccntattagccncggctatgcgcctgtattggattgccaacccggctcacattgcatgcacagtttgctgagctgaaggaaaagattgatcgcccttctggtcaaaagctgggagatggcccttcaattcttgaagtctggtgatgctcgcccttgttgatatggttcctggccagcccatgtgtgttgagagcttctccagactatccccctttgggtcgctttgctgttcgtgatatgagaccagaccgttgcggtgggtgtcatccaagccgtggaccagaaggctgctggagctggccaggtccacccagtctgccccagaaagctcaagaaggctaaatgaaatattatcccttatacctgccccacccccctcttaatccagtggtggaagaacggtctccagaacatgtttgtttccattggcccatttaagtttagtagtaaaagactggttaatgataaccattagccatcgttaaaccttccagaaggaaaggagaatgttttgtggacccctttggttttcttttttgcgtgtggccagattttaagattattagtttttaaaatccagtactttttaatggaaaccacttgacccaaaatttgtcaccagaattttgagaccccatttaaaaagttaaatgaga

SEQ ID NO: 714519 - DNA, 86 bp, Homo sapiens
tatctacgcggatgagggttgttttcgcttttttcagctgtttttagcaactgaactggaaacaagaagcaggggcctttttcaga

SEQ ID NO: 714520 - DNA, 213 bp, Homo sapiens
aactagcataccacaaatatgtacccccgccgtactccaagccatagtagatatgtgctccggatccatcatccacaaggcttaacaatgaacaagatatacgaaaaataggaggactactcaaaacatacctctcacttcaacctccctcaccataggcagactagcataagcaggaatacctttcctcacaggtatctactccaaagttca

SEQ ID NO: 714521 - DNA, 929 bp, Homo sapiens
  misc_feature (601)..(601): n is a, c, g, or t
cttgcctttccgtttggcggcaagccatcctagttaaccccagattggggggcataccacagtacatcccccggagctattggtggtaaggacccccttctgatgttccatgcgcgttttcttttgaggtggtgccccctgtctgcgcccgttgcccgccacgccttctgctggctcgtcacaccacggggctgtccccgcccccccacccccggccctcgatataaggcgtgcccccgcatctgtggcttacacaggcccacacgacacaggtttacccgttatataataatatagggattctctggttctcgccccgttggttggccccgaatatccgcgcccccgtttctctatacagagagtggcccacacttttctcgcgcacacagcgcctggtccacacatcacatgggtggttaacgccaccgcttaaaagttttgctcgcaaaagaccctctcacagttccgcttgccacagaaggaggccgaaagctttggagcgccgccactcgtgggggctctctctaggaagtgcctcgagattgtctctaactcgggtttggtggagaagagttgccacacactgccacaaattttnttgaaggttaatcctcacttgagtccctctccactataaggctattcacgagagagaaatcctgacacaccccgctggagtcaccccacaacccgttccaccacacgcaccacgggaagaatgcgctgggctgacaatctgcacggccgaaagagccgctggcccttggaaaagggccacccaagttccacccaccacactaattggtggctctcgccgggcacgcttggagaaaggcgccataactctccacgctccacccgttatccgctaatataagtataagtttgttaaattcatacttaataccccctttaggaccagtcca

SEQ ID NO: 714522 - DNA, 1475 bp, Homo sapiens
gggaacagggtgagcagaggatgtgtgcagggccttggaggaagggggccgagaccgggcctaacgtctggtaacagatagctgtgagggatcgtgaaggccagacctagtcggtagtccggccgtggggaagaatgaacggagaccagaattgcgagatgtttcatgcaccgaagaagaagcaggatgttcggtgtcagcaagttcgtcctcagatcgttagggtgctgacatgaggatgaggatggggcaccgcagaagataagagacgaggctaatggtccaggcatcgaacggacggtcgcgtggcaagtgacaactgtcgctactcggcatggcatacgttagtacatccagtggaggtatacgaccgtgtcgggtcacgtaggcgagttccctgggagagtctggatgggactgcataggaaacactgggatgactggatagatcatcgcaggacggaggcccttgggatcttggtgaagactgggatggctagtgggaaacctgcgtggacaaggagacaagtgccatggcctgggccgtgcaaggaatggaagcacttccattgggcatttccaattcaccctataacactcgggcacgtgagggcccaaccaagaaatcatggaccgtggggagtgattccatgcgaagaggtcccgtggtgccttgtgagggggtcccggggggaatggcaccaccctccaaacatggaattgacatgtacaacgcttcccttggggaaaagggaacaacttgggtgattgcggtgaaaaccccggcaaagctagaacccctaggaaaagacgctacttggagatatcgactgaccgggagagataaggactaagcacattacacctcaatttttaacccacctgttcggaaacgtacagttggaggttcccagaaacgcggcttcgagaatcaggcctggggcggattggaaacagctctactacccgaaaagttcgacgcggaggctaaggcacggccagtttggtggaggcgacacaacgtaaaccccactttggggaaaccacacttagccgcctctctggacacaacagagagccgcacacagcggtggaggtgggagaacatttgcgagccggagactgctgtttaatggcctacgaggagcaccatggcacaaccatcggaggaaactaccgtcagggcgggtcaacactaccagctaccgtgggtgtgggcgcacacagacgaggatgacgccaagaagggcacaccagaggggggtaagcaccactaatggctcccccatttcatatatagggcgatcacaccgcgtaacactataaggtggtggacacgacggcgcgaaaccgtggagtccacaaacctgggcgtccacaatgcggcaatagagcttgggaaaaaggcgaagccacgcgaaccgaagtgaaggacagggggcccccgcaacattggggcgcagacaaagaagaaa

SEQ ID NO: 714523 - DNA, 378 bp, Homo sapiens
ataaattatcattgacccagcataccattcttaggtgaacacccaaaagaactgaaaataggaactcgaacactatgtacaccaatgtttgctgcagcattattcacaataaccaaaaggtgaaagcaacctaagcgtccatcaacagaagaatggataaacaaaatgtgatgtatatataagtacaacagaatattattcagccataaaaaggaatgaagttctaggctgggtatggtggcacatgcctgtaatcccagcacgttgggaggctgaggcaagaggatcacttgaggcccggtgtcaagaccagcctgggtaacatagcgagattctgtctctagaaaaaaaaaaaatttttttggagatggagtctcc

SEQ ID NO: 714524 - DNA, 164 bp, Homo sapiens
gctcagttcctgatcgttgtcatggctggtttcctgttgtttacagcgtttgggaccagctcgatcacttgccctttctctcgccattactggtttgtgaggtgagcctggcgctcttctttgcgctgagctatagctacatattatggctttgtggcagctcc

SEQ ID NO: 714525 - DNA, 371 bp, Homo sapiens
tgctgaaacgctgtccagggcaaggttatgcttcacgtacccccacgagagtgttgagggagccacaaggtgataggagcgggctgaataaactcgaatcgttacattgctggccagacacttcttccgcttcattcatcagagtaggtgaatgagatacagtattgagcgggtgagacattggcatgggctgctcaccgagaatccttctaaactcaagcccttactcagtctgccttctaccttgtatcaaataaagcgttctcccgtgaaagggaaaaacctcttccccttttatgaaaaaggtcgcaactcgaaagccccaagcggcaactcgaaaggcccaagcggcaattcgaaagacccaagcg

SEQ ID NO: 714526 - DNA, 433 bp, Homo sapiens
agttcatcagggcccatcaaaatttcccaaatttaagtgttaggtggtattttacgggtgtggccccaagaacaatttcttctttcttcttgatgtggcccagggaaagccaaaagacgtggccaccctctgggttcaaaataaacatttacacgcctcatgtcacatatattagaaaaatgaaaagagactgaaaaattgtgccaggctactgtgcttgacacaggtacaacagaaaaaacaacacgcaaagcaagcagaaagaagcgcagaagaaggaaggaacaccataaagtataaggagacgcaattaatgaggctagaaaacaaatgtaataatgcagaaatcaacccaactaaaagccggttccttgaaaagagtgataaagccatttctggcaagaatgaccaaggacgagagaaaaaaaaaaaa

SEQ ID NO: 714527 - DNA, 431 bp, Homo sapiens
gctgctttaatttcctgcgatttcttcataaaacattgaatattcaatgctcattttgatgttggggttttgagaggtttaggggtgggggtttagcttgcttttcctggagttaatttctccatttgatgtgagattaatggtcctgtggatgcttgtgagtaatcagagtttactagagagaagcacagagctttacaagccagaagggctttctttgcctctatttactgtttcctgagaaatcaacaacaccatattgtggaaagccaattaccaccctatacaaggttaagcttttcatccaggacagcttaattgttgaggtaaatatatcattgagaacttctgtcttataagaccaaagcatttcggagcacctcatatagcatcagagacaaaagacctcaataaaattttaatgaatcaaa

SEQ ID NO: 714528 - DNA, 441 bp, Homo sapiens
cccatagcttcaacttgatctgacttgaccagtgatgacccacatctggttctacacgccgctgctcctgtatgtcacacttgttgccaaggaccacgatgatgacctccttcttgttccttgggatttgtcactctccttcttgaacagctccacacgctgaaaagactctctgctatctgtgctatagaccaggacgtagccatcagtgcaagagaagcagtgtcggggcagttcggccccatctcggagcccccgggtgtcatagaaacgcacctgctctcgcacgccccggtctgtctcaatggagcccacgtagatatcctcctgcgtctcgatcatttccgaacccactacatggttcccatacagaagctgctccaggattgaagtttagcccacagacgcctggccaaacacgaacaccttgcagctcttcca

SEQ ID NO: 714529 - DNA, 933 bp, Homo sapiens
ggctgggctcgtgcgcgccaggagcgtgtctctgtgcactgacagaggccaccgtgcagtacgcagccagtgcgtgtgggtactcagcgacttggaccatatagtggacattccacgctggagaccctggtggcctcgtatgaagccatatgaggacctggatgaaggaagtcgcatggagggcgatgggcacttctacgctatgagtctggagcagcataggtggtctgctctgctggagcgcacgcagtccacctgccaggcccgcgaggctgcccgccagcagctcctggacagggagctgaagaagaagccgccgctcacgggcgcacatgccccaaagcctgctgctgcccctgcaacggaggagagtgaggcagtggaagcaggagaccccccctgaggagctgcgcaagaacttcaccacctgacatgggtggctggaccagtgagtgcctgacagagcgtatccgtgggaaagatgcacacccaccaggatcgaagaatccacattccgagggcgccccgtctacacgacaagctcaccgggaggtgccctggggatcagcagctaagcgtggtctggtgcccgttgtgatcacccggggataacataagtacggggctacctaataaaggcaaggagaaagaagaacaacgaggaggaccaaaaggcgcgcccgagagaaagagaaggccacaggaagagaaaccaggcgagggccagaccagcatagaggcaagaaggcatgggaccaaaagcggcacaccgggagcacagggcacgcaaggctaaccgagaggaataaattcgcgaaaaaggaccagcgaccaacgacaagaggacgggaggcggataataaataggggagaaggggaaacaaaggccaaccgaaagcaaacagagaaacccacaaaaatgaaccccccggt

SEQ ID NO: 714530 - DNA, 390 bp, Homo sapiens
ccctcggaggaaggatacaattatgtcttctgaggaagcagccaatggaaagaaagcccactggggaaagcttggaaccagtggaaaagtaagaagcttaagcgcctctttgggggcactaactcacctgacagctttgcatttgagggacaatttcctggcccgaattccttctgaaattgacaagcttcacaatttgggggatttggaccccgcgtctaataaaaaatctagcttaccccccgaactcgggaaactgggggtactcctggagcttctttaaaataacaacctggtgcgaggcctaccttttgggctgggaaaaactgttcagttgcagactttaagcctgaaaggaaaaccccttacccacgatatattgaaccttta

SEQ ID NO: 714531 - DNA, 664 bp, Homo sapiens
agaaaaaacaatgattaaatgagttctttctttaaactccatccaattgtggcgggtgatctcgattcctgtgaacaacaggatttaagtgttccccccggcacagaaataaatgctgtcttgctggtagtgatcccaatcgcgatggtcttttccataactaaaagaagaatagggtttttgtcctggaatcactttttttgtaacattctccctaatgccggtctttatgatgatcatggtattgagttaagtgtctataaaagaaataactgtccctgctgctatcatcgtgatttgaattctcttttagtctccccacatttggatttctaatcacgtaaggattccagttgctgttttgatcactgtttaaatgagactccgctcgtttttgaatagcatgcttatataatttatgaaattttcttgcatcaaattcagtcatctaagatacaacaatccacaggttttttctgcattgcttaatttgttcaggatttgtatactctcttaaacattatgtgatatggtccacaatttttattaaacattgtctagtatgctctagttgttctctttgtgaaaggcctttgcaggcctatcaagttgtttcaaaactgctttaacagtcgtcattctttctttacaaatgctgaatgtc

SEQ ID NO: 714532 - DNA, 386 bp, Homo sapiens
  misc_feature (10)..(10): n is a, c, g, or t
  misc_feature (75)..(75): n is a, c, g, or t
  misc_feature (375)..(375): n is a, c, g, or t
ttcctgcccnaagtcctcaaccagacaagaggctgcaggcaccaaatctatggagctggataatagaaaaagacncaaaagctcacctaacagactacatgaagcttcaacagctagtttgtaccagtgagtcagcattaaatccaccagaaaagaacagcaccacccaaagactggggggcagctgggcctgaagctgtagggtaaatcagaggcaggcttctgaatgatgagagtactgagacaataggccacataaacgtggctggatggaacctcacaataaggtggtcacctcttgtttgtttaggggtgcaaggataaggcagctcagttatatgagagaagcagaacaatagtcttcagagaaatggntgcatcagagt

SEQ ID NO: 714533 - DNA, 468 bp, Homo sapiens
ggtcggtgttatctgatgccacagatgggggagcttctgagccaggagaagaagttcacgaggtaatgtcatcagttaaggcaagaaccactcattttcacttcttttgtgattcttcagttacttcaggccatctggatgtgtatgtgcaggcttgggctcagaggcctgacaattacctcccgaaggccccacttccttctttttcattttctttcttttttttttttggaggcaggggtcttgctctgtctcccaggctggagtacagcagcacgattgcagctcactgtagtctgcatttcccagagtcaagccatccttaccttagctttctgagtagctgaggcaacagacaaacaacattacccagctacttttttggtttttaagagacagagtctcactattttgcccagaggctggtcttgaactcctggcctgaagcaatactcctgctgaagcctc

SEQ ID NO: 714534 - DNA, 408 bp, Homo sapiens
ttgacaaatgcgagtttgcaaattgcgcgatgaggcgatattacacgttattcgttactatacgcgcgaacgcaggggtgcgcgaattaaaagcgggcatttggcgtccctttagccgcaaagcgggtcgtttgatccgtgtcagaagagaaaaaacgcgtcgtcgtgacgggaaaaaattagaagagttttaggaacacgaaaatatccgctacgggccagcggaattgccagaaccagttaggggtggcgacaggactggcataataccccatttgggtggggaatacactctcgattgaggtgttgttcatcgctggggaaaggaaaattggttcttactggaaaatataggggacgttatgaaagagtcggcgcaggcggcatttagttatgttcgttccattt

SEQ ID NO: 714535 - DNA, 89 bp, Homo sapiens
cctcgcgtccctaggcggcggcgggcgggcgtcccgggatggccttcatggagaagccgccaggccggcaaggtgctgctggacgacac

SEQ ID NO: 714536 - DNA, 211 bp, Homo sapiens
gttgctcagtcaaaacacttgcgtagtataaatcagtagagaacctactgaatcatgcagaaagaaaatgctgattcccttacaacacagatacactctcctttcttcaaggattaccaagagggctgagaagctgcttctaatgtcagataaactaacattttattgggaagcttctccatctttccctgaatgcaccaacacagacaga

SEQ ID NO: 714537 - DNA, 343 bp, Homo sapiens
ccggttacggtcgggctggccatggcgctgagcgtgtccacctgaggccctgcgcgctagctgtccatctcctccatctggcgatgatgcgcaccgccgaggacaaccgcagccacagcgcccacttctttgagtttctcaccaaggagctagccctgggccaggaccggatacttatccgctttttccccttggagtcctggccagattggcaagatagggacggtcatgacttttttatgattgggcacggagggatccaggacatctgtgaactggctgcttcttccagagagatctcttggcagagtgagggcctggagataaccagctttggattatc

SEQ ID NO: 714538 - DNA, 745 bp, Homo sapiens
taaaaagtctatattttatatgggggggagggattaaaaaacaagcccctataggggccctattcaggtggcagcttctagtgtcccataggattaagggaacgactctgaggaaataaaatggttgtctggcgacacaaatccaggctgtacttcgctttgtcatgtcgtgatcggagtagaagggatcgaccgtgcaacctgtcgaacgtgcccctctcaatacccatcaatatgtgcctcaaaacagctagtgctccaggcagaacccctgtggggagagggaacaaacacgcgcccacattcacaatctccgtgcatagcaactggcgaagtgagatcagacacgcgaccaccgaccgaaggaaaacagagacaacagacacacagccaagagaaacacgcgaacagcgccacaggcacagtgatcgcgccagaaaagtggccagaggccggtgcagaccgatacccgcgtgaacgccaaggtcgcgtgaaacacccaaagctaccgggggaaacgtccgggaacatccacccgaaggcccagaccacaaacaaagaaaccgcacgtgcgaagaaagaaagcgaagacccccttagaggcaacaccctaacccctcatagagaaaggtgaacagagggaagaaacaccaaagaaaaaatacacgaaatatggatatcagagagccccaacaggaacccacgcaaggcagactgcgccgtcaacaaggaagtagtcctcaca

SEQ ID NO: 714539 - DNA, 410 bp, Homo sapiens
tctctacaggatccccccacagtcttctccgtcccgcaactcgtgccacagcttctcggtcgccactagacttctccaagacagccgggaccatagacatgaaccaccatgcccggccaatctttgtgcctccagcagaaacggggttccgccactttggccaggtcggtcccgaacacccgaccccaggcgatctcatccgaccctggcctcccacagtgctgagatcgcacagacgtcagccactgtgcccgacccgctcccatggtcttgagtcttggcccccacgaatttgttttcggtgagacagagtctagctctgctccccaggctggagtgccgtggcgtgatcatcgctcattgtagcctccaattcctgggcccaagctatcttctctcctcggcctccc

SEQ ID NO: 714540 - DNA, 198 bp, Homo sapiens
atagtaatcgcggcgctcgactagtttacatagcatttacattgtattaggtattataagtaatctagagatgatttaaagtatacaggaggatgtgcataggttatatgcaaatactacgctatttttagctgaggacttgggcatccatgtatgttggcatctgcaggggatcctggaaccaatccccctatagat

SEQ ID NO: 714541 - DNA, 472 bp, Homo sapiens
atactgagatagcacccagtagctccagacttatatcctattgattcaactatccacagagagcagctccagcaaaaacccagggatttgctgtgattggtctggactgagtcatgcatccatcctcaagctaatcactgaggcttgggtgatagacgatatagattcaccaggcctggagctgagggatgagaatgaatcccatatgaagcatgtggcctgagcaggaagatgaggaaattcagctgctgttaccaaaagaaaggacaggataaaactacagatgtccctctgcgagattttagccctgcctcaggtatgtgaccctgcacaaattatttctcctctccagtctttgagttccctacctgtaagattctgacttcaaactcaattgctgattttgataccttttgtagcagaaaacttttttacttttcaataaacaatacacggaacccaaaacataaaa

SEQ ID NO: 714542 - DNA, 176 bp, Homo sapiens
ttatcgttgctagctagaacaccacctataaaagacttgcaggctaatgtgcattgtcatatactgtacactgacacatactattacagtctcgtatgttatagactacaaaatcagttagatggtaaaagtataggtagtgagcttaatgttatcgttcagtaatacgcctatca

SEQ ID NO: 714543 - DNA, 441 bp, Homo sapiens
ttttagcacttacccaatgtcatccgcctcactgggcaaaccccctaacggggtctccagctacctcctacaggtgtgtttgggccagcaacaagttcattcatacctccctagggcaaagcttccaaagggagcagtaggctgccaacttttctgtttcacagccttcactgatgataactccaggtactggaaaatctgaggctactagagactgaagtgggccctgggcatactgcaacagccctatggaaaagtggccagactgttacctgggttcccattcctgtatcttctcactaggcaagtcttgcaggcctgggcctctacctaacccccctgtcagatgctcagagcaggtacctgaaccattccttcttgactgtcacgatcttgagaactctatccaggggagaatgtgaatctctgtcagctctagaa

SEQ ID NO: 714544 - DNA, 153 bp, Homo sapiens
gagtctcagatctgtacgtatctgtaaatagcataaaatggattcaagaccctattatggtactgttaatatttaaggtctattaaaacagactaaattccacaatcctataataggtaaatgggcatatttgcccgaggaaaaaaatccaga

SEQ ID NO: 714545 - DNA, 89 bp, Homo sapiens
attcttgtaaccatcagagggcaccaccaaaaactttgagaagtctatgatgaacttgcaaactaagatgatgccaagaaacaaaaaaa

SEQ ID NO: 714546 - DNA, 423 bp, Homo sapiens
atgttagaaaaaaaaaaaaaaaacccccctcttggggacttgaaaccagccggcaatcatgcggggtccacacgtggtgtgtttcttggaaacaactgggcctgggatggggcttcactgctgtaacttcctcctgccaggggatttggggctttcttgaaaaacagtccaacccctggaaaatgcttaactttctgtgttgaaccactgttggttttttggttagtgactgatgaaaaacggttttcttggggggaggttaaagaggctaacttcagaggggacttgttttttttcttttaaaagaggcaaggtggggctggtgcccacagctttaatcccagcactttgaggttggctgggagttcaagaccagcctggccaacatgtcagaactactaaaaataaagaaatccgccctga

SEQ ID NO: 714547 - DNA, 420 bp, Homo sapiens
tcgcctagcatccatcgggtgtaccatacccttctggccactccataagataaccacttccattccactcggaatgagggataccatgccattccattccatatcattccgttgcaatccattccaatctattccattccattccattccactcgagttgatttcattccattcctttccattccattcctttccactgcgagttgattccattccattccattccattgcattccattccatgcctttccactcgggttgattccattcctttgcattccattccattccattccattccattccattccattccatttcattccgttgcattccattccattacattcggattgattctattcaactcccttactctccattccattccattccattcgggtagtaacataccattac

SEQ ID NO: 714548 - DNA, 119 bp, Homo sapiens
caggacgcgggggccgcaccggccggaagaccacaaacccaaaccaaaagaacaacacacaaaaacaacacaaccaacacacacaaacaacccaaacacccgcagcagcacccacacaa

SEQ ID NO: 714549 - DNA, 316 bp, Homo sapiens
atacagaaaatgagggacaaaggtacacaggatattaaacaactgcactggattgagttctattatgctaaagaataaacaacattactcgatgggttccaatagaagaatacattttatcgatagaggtttcatttatcagaagtggtctgcttattcgtaagtggcaaaatgtataatctgtatcaatgtgacctgtatgaattaagttcccgtttattaccaatgagactgtaggtttcaacatgagttctatatgattttataaataaacttaaagtatgtattaatcactcttccagcatagcaggcagga

SEQ ID NO: 714550 - DNA, 296 bp, Homo sapiens
cactccaagtctctggccgtgcagattgaagtgcaggttgtcctccatataccaggtacgaccccctcttcagaatacagggcaccaagtccacagacaagctgaacaactaaaaacgcaaaccagtcactccagcagcccgcctctaaaccaggcttccacgcacccccaagtgcagccatgccaccgcagagacacattacttccactggcatgacagtgtataatgtattactaatacggacaacatctaggatagtatccagccaggaaatacatcctgagttcaacaaacc

SEQ ID NO: 714551 - DNA, 211 bp, Homo sapiens
tagcagtccaaactctccctgtgactaacatctgtcaggcagctgacgaatagctattcacgcttgttgagtgggcaaagagaatccacatttttcctccttgcctctggattatcaggtcattttgctgcgggcaggtcagtgatcttggatccctttgacttcttgacattttacccctctttgactccccgatgcgccacccccagag

SEQ ID NO: 714552 - DNA, 479 bp, Homo sapiens
tggattacatgtcccagaaatataaccaactgctcaattaccagaagactttaaaataaataagatccaacaactttttatcttttaatccagtcctcaaattcacaaatttaaaaaggggttggggaaatgacacaaatcattaacgaattattccaaatataaataactttagttaaaaacattcttaaaatttagttaaaaacattatttaaaaaacatcttaggccaggagcagtggctcatgcctgtaattccagcacttcgggaggccaaggcaggcggatcacctgaggccaggagttcaagaccagcttgggcaacatagtgagacccccgtctctacaaaaaaacaaaaacagttagtcagacatcgtggtgctcccctatagtccagctactcaggaggctgaggcaggaggattgcttgtgcccgggagttcaaggctgcagtgagctatgcttgcaccactgcactc

SEQ ID NO: 714553 - DNA, 512 bp, Homo sapiens
aatatgggcatttacctcagctggacacaggtacccagtttctgaccccacaagccaagtaccatgccaaggaaagatattgatgcttagtattaattgaaataaacttgaaattaatatagttagttaacttagtttgtctcaaaaaaaatatggacataggacaaaatgctcagaacttaatacaaatcttcttgcttatattcctaacagacatcccttaaaaagtagttggaatgtacccaagtagaggtgagacaagggcactttggaaactcgcatatgacttgtattcctgtccttctaaatataaattgggacgaatagaagtaaatatgttgatgggtgaaaaagaatcccaggtatgtaattaacacatacctatttttcgtactgagtctgtaatttttctctgagtactcttaatctgtgcgattttactgtcgggctcgtgacatttgagggtctaagattgtaattaaattctgcagagccgtctaatgctcaggttg

SEQ ID NO: 714554 - DNA, 376 bp, Homo sapiens
  misc_feature (202)..(202): n is a, c, g, or t
aaggactctgtgggcaataaaatattattcaaaaaaggaagtgaaagcataatgcattgcttggcttggcactggacatatatgccaagtataataacaaacactgaatacccacttttgaaaaaatacataatttacttatactggagtaatggaggaccgaaaatggagaggctgtatggtcatcattagggctgttcangaatattccagagcatcttttcccaggcacattgtagggttgtacttccaggcctcttttcagattaagtatagtcgtgttgcttgctttgacccatataatgtgagttcaatttatttttttcataccagggaagaagttttgagatgcagccgtctataaattctttgtttg

SEQ ID NO: 714555 - DNA, 201 bp, Homo sapiens
atcaaattagtgacgcgcatgaatcggatgacacgagattcccactgtcccgtacctaactatcgcagcgaaaaccacgagccaagggacacggcgcttggccggaatcagcgcggggaaagaagaccctgttgacgcttgactctaggtctgggcacggtgaacgagacatgagcaggtgtaaggggtaccgaagctcga

SEQ ID NO: 714556 - DNA, 714 bp, Homo sapiens
tcagatgggtcgttctaccggtcagcaggcgctcctcatcgacaatcgggtcgcgtgagtgctcggcatgaccagcgcctggcggttgctgatctcaatgggcagcgtcgaatcgcgccccggcttgaccagcaagcgtgcggtggattcgtatttggctggtagtaaaaaggcccccagcagaatgatcaccagcgccgcgatggccgccagcttgaactcgtgccggaagatgaagaacaggcgcagaagatcgcgaaaagaacggatctcgatcatgggatgtcgctcctttagttactgccgccgctggttcgggtgtagttgtagccaaccccgatcgacttggtgaatgggatcaactggttcaagtaggtatctacgccctggatgcgctcgcccacgttggatttgggcacgaacaccacatctccccgctgcagcggcacttgtttacgcccgttggggccggtcttgaggtattggctgaagtccaggaagtaagcgcggtaggtgccttgggtatcttcgcgcaacagtgcaaccatgctggcgttgcctgcagggttcaccccgccggcgccgacgatggcttgttccagggtgttggccgaggcgatcggcaccgtggtcgggttgtttaccgcaccgccgacgatgatcgagttgcccggtgcctggttgatgtcaccgtcacccgtggctccgataaac

SEQ ID NO: 714557 - DNA, 991 bp, Homo sapiens
taattcaatctggaatcaaaaagcgggggattctggcaaatggtccttttgtgcccttccccaactcatccctgtggttctggttccccgtgttgtgcccatagcccttttacccgtggagcaccaccccaacgagacgtggggcaccagcccccttcgccgtgccgtggtgtctcttcccacaaacccctttataaatgtgggagaggagaaagaggagagaaggggggagggggacctgtgcccccttccttcaggcattctgggaggggccctgtgcccccatgtgggctttaaccctttcccgtgggggctcttcttcccgcgaacacatttgtgttaaaatctcaaagccgtgaattaaacattacaagttttacatattgaaaaaccaaaaaaagaaaacaaaaaaaaaaacaaaaaaaaaaaaaaaaaaaaaaaaaaaagggggggcacaaaaaaaaatacccagagagggacaaccaaaaaaaagacaaacacgaatacagagaaaagagggccccaaaaagaagcacaaaataaaaacaaaacagagaccagcgcaaaacacaagagaagaaaggaaaaaacacaagcaaagagaaaaacagaacaaaaaaaaccacacaaaaagagcggggaaagaacaaatggcgacaaaaaacaccaagaaaaataaacccccaaaagagaatataaaatacaagaggatataaacgtgtaacaaaagagcggcacatgtacgcgatgagaataaaatatgcaacacggaatacagtgtacaaccattttaccgaagggacgtagaaaaccaaaaaattataatgaatcagaaacaaaaaaagaaaaataaaagaagaaaaggaacaaatggtcacaaaaaaggcacacacagcaacatacaaatggataagaaaaaaatgaccgagcaagagacgaaaaaaaacaggacagcagacaacaaaacaaaaccaaagaacacaggacaggg

SEQ ID NO: 714558 - DNA, 553 bp, Homo sapiens
ggaacattttgtctggcctagaagccagggtattatctgcacaggcccgatttgctattgaacatgatgtccagtgtggagatgcgagatggctctctatgtagaggacgtcattcacttattgcaaacaaataatggctcccaatggcacacaatgtattgctatggattgctgcataaggcgaagaatgtcttactcattgagatgtttgcaaaggcagcactgagagctacgggatttctgctggctgactcaacaatgcattcagagagaccatgagacacatatgtaggctatgctcagtaaagtatacactcttgcctcactgtcttaacacttacccatctatcatgaagcatgagctcttggtcccaccatttaactgacgaaatgacttagagtgaaccatgctcctataacatgttcctgcacttgcaacccaataaacttcccactagatttagaacttgctgaatttccacatcttaacatattttagtagaatgtagctcatgtctcatatttagaacaactcgggacttggacttcttc

SEQ ID NO: 714559 - DNA, 287 bp, Homo sapiens
ctagcggccgcccgggcaggtaccaatctactgacttattcttatttcacactgctgatgaacacatacccaatactagtaagaaaaagaggtttacttgaacttacagtttcacatggctggcaaggccttataatcatggcaggtggtgaaaggcagttcttacatggatgtggccagagaaaaggaggaggaagcatgaagcagaaacacctgtgtaaacccatcacatctcatgatacttatttactatcacgagaatagcatgggaaagactggcccccatg

SEQ ID NO: 714560 - DNA, 151 bp, Homo sapiens
tgagccgtccccatcacttgtacagctccattgaagaagcttcagagtgtatctattgatgacggtgactacgcttctgcgttctggctcgggagctgatgaggatgttgagagtccatagctgacaactactcgaacacttccaaagata

SEQ ID NO: 714561 - DNA, 240 bp, Homo sapiens
agacaggtcacaggtgatagagcaaagcatcaaagaatctttaagggaggtttacaaaaaaagacaaaaaaaaaagatgggttgccccggccttggtgatcctggttccagatgggtccacatggtgattatagggtgatgtcactcacctaaacacccagaggcgggcattgaggctaacctccaacacagggcttctcagatgcctcatgtaggcttctgtttgtcgctcgggtccct

SEQ ID NO: 714562 - DNA, 777 bp, Homo sapiens
tatcaaatgcactgcaagatggttttagctggagattctgcatatcaatataattattctgagtcagttgaaattagaacaagaaagcatacagtggtccaccggatggacaggattcacaagtcattgtgatgcgtcgtttttgcttctgtgtgtcagacagacataagtctatgatttaaattcgttacacaagagtgtagtgcaaagatatagaagatgttgcttgaacaatgatagtccttaggaagagtcaaactttgtacattgtaaatgttgtctagagtatactgtatgccaagcagagtgtacgttgtccgatgcaaagatcttcatgtatgtaagtgtggaacgattcaaaggattgcaagatagtaaaatgatctctggtgattttgaaaccatggagtaatattgtctttgtccatattcatgattacgaatttgaagaaattttgtcagtttgatattgtgagtgagtgggtgaatgtgcacgtctacagtgttatacatttagtcacctaactctagtcaacttcttgggcatatgctcctggaagacattcgaagatcatggcagcttttagataaaaacatcttctattattttgcgtgcaaggttgttactgtgttcacagaggtggcagtcatgagaccatagaggaaacagctgcctttagtgtctacataccggctgtgatatagatgggcatttatcctgtgaagcatgacatttgaagtatttacccttgtaatgctcatctggtattatgtgac

SEQ ID NO: 714563 - DNA, 193 bp, Homo sapiens
cgacgggaacttgtacaggcaggcatgcacctgcagtggtgaatacacgatctgaccaggctccaggttaacaatattgtggaggtcaacacggtgctcactgtgtctgacggaacttgtccagtgaaggcatgcaccgcagtggtgaatacacgtctgacctggaagcatgcatgcatgctcgggtactgga

SEQ ID NO: 714564 - DNA, 417 bp, Homo sapiens
acgtctgtgtcgactataaaatatccctcgaaagtactgagcaatgctctactgtcgacttacgattacgaatctaagtaaatatttcataatactatacagactgtctaccaaacttagtgaaacggaacctagtgagtgtctggacttggaaaaccctgggcggagtagaatggtcacatttgtccccacggtgtctgacctagagtgctctggatcctggaagcctcgacttcaggtaaataaccaccgcctcttgagggtgcagaagaacgccctttaaggccagttggggccatgagaacccaaaggtaaaacaactggtttatagttaggcagcatgccaacagaggttttgaagtttataattagtatttttaagaacaactgctctccgccactgagatataaacttca

SEQ ID NO: 714565 - DNA, 146 bp, Homo sapiens
gatcagccggtccgacaacagctgcacttgactgaaattgtttggagtactcagaatcatagtgaccactacttgagtagcagagtagaatcttgtcttcatagccattatctgtgacataagttggagggtttcttagcgatagt

SEQ ID NO: 714566 - DNA, 956 bp, Homo sapiens
  misc_feature (13)..(13): n is a, c, g, or t
  misc_feature (307)..(307): n is a, c, g, or t
  misc_feature (557)..(557): n is a, c, g, or t
  misc_feature (559)..(560): n is a, c, g, or t
  misc_feature (566)..(566): n is a, c, g, or t
  misc_feature (573)..(573): n is a, c, g, or t
  misc_feature (584)..(584): n is a, c, g, or t
  misc_feature (587)..(587): n is a, c, g, or t
  misc_feature (653)..(653): n is a, c, g, or t
  misc_feature (661)..(664): n is a, c, g, or t
  misc_feature (666)..(667): n is a, c, g, or t
  misc_feature (670)..(670): n is a, c, g, or t
  misc_feature (673)..(673): n is a, c, g, or t
  misc_feature (676)..(676): n is a, c, g, or t
  misc_feature (688)..(688): n is a, c, g, or t
  misc_feature (703)..(703): n is a, c, g, or t
  misc_feature (729)..(729): n is a, c, g, or t
  misc_feature (737)..(737): n is a, c, g, or t
  misc_feature (746)..(746): n is a, c, g, or t
ccgcgattcctgnccacgttttctcgcctccatagggctccacgtgtccccacgttttgtggcgtacgagctcacggtgctggtgttcctcaccttgtcagtgggtggtgatgaagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctctngctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggctttgccagaatattcttgccctattttagantnncccggngtggttnattggccgtcngtngattatgtgcagtagacccgggacactgcgttttcccgatcacctggaatggggcccccggcggcnccgggggnnnngnnccntgnaantattattaattntctattgtgaggtcntcagttcatagtttttttataaagangcaaaatnaaaaggctnttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaataatttcatgtcaatttctattag

SEQ ID NO: 714567 - DNA, 294 bp, Homo sapiens
  misc_feature (165)..(165): n is a, c, g, or t
  misc_feature (176)..(176): n is a, c, g, or t
cctgggattacaggcatgtgccaccacgccggctaatttgtatttttagtagagacggggtttgccatgtggccaggctggtctcgaactcttgacttcagatgatccatctgccttggcctcccacatgtgctgggattacaggcgtgagcaaccatgcccggnctctttctcanctttacacctgtcttcttatcctcacatctgtttccacccttcatccctgtcttcctcatgtcccacacttgtcttcccgatgttcatagctgcctttcttcacatttgggttcgcag

SEQ ID NO: 714568 - DNA, 328 bp, Homo sapiens
cgaggtctcactgtcacccaggctggagtgcagtggtgccatcatgactcactgcagccttgacctcccaggcgcacaaaatcctcctctcagcctgagtaactgggactacaggtgtgtaccactacatccagctaaaggagagcgttttttcctttttctttttgagacagagtctcactctggcgcctggtcactgtgcccttcaccttctgggttcaagtgattctcctgcctcagcctccctagtagctgggattacaggcatgcaacaccatacccagctaatttctgtatttttagtagagatggagtttcaccatgttgg

SEQ ID NO: 714569 - DNA, 208 bp, Homo sapiens
atactggctcggtcccccgactagcccgacagaatccggcaggcaagagaggcaatgcaagtgcttgagaagataagtcacacgcaacacaggtaggactgcagactatagacttacagacggtcacttggggactgggacggacacacggaccggtacggacacccatggacacttacccgacacttacactgacgttactggggac

SEQ ID NO: 714570 - DNA, 1154 bp, Homo sapiens
caaaaaaaaaaaaaaaaagtcatcctcctccaactacggatggacatatggatcatcagttcagaccctcactgggcatacaggatcccctaagaagggtcctaatttaaataagctggaggaagggagactttaaaagggacgtgtggtgagtgacataggatatagccataaaccacggtgccaggacctgacagcgtcccaatatcttttggcacgcatgggggaatcaaagggtgggcatggccaaggttcaactacagggctagaggtatccacattggtccacatcaggcaagccctggcactggacgggttggacgcctcatgggaagacggagcatggtgtcgggaaagaagatcccttggtaaactggtattaggtgggtggtactccttcaatggaattagagctcatggccccattttctgggcttggctggtgagattcacggcgatgggccaaacgaatacatcccctggagaagcctaccctatatggggcccccaagcctaagagccacccaactctcataactctgggtcggaatccccctcaaaggaaagggtccactgtcgcaataggacccggtacacgctcacaactcacgtcctccactatactaatcggcagtcaccattatatattgggtcgtaaaaccctcagagaacactcaggggtaagagcttttcccttggaccagttatacaggcacgcctgaaataccaagcccccacaacgctcgcccacagaaaaactgggatcgtccacagccacggcaacacggccgtgcgaaacaccccggaatggcccggataacccggacaacaaacagggatcaccgcaaacacggaaaacaaggatctggtagggcccaagcaccacccggtgtccaaaggaatttccagctcgaagtacataggcttaacaggcaaccctttaaactacaacaacaacaaaccatggcgagcaaaaaaaaaaacaaacgaacccggaacggaccaacccatcaacaaacccccgcgagaaaatgagaatacgatacgagaacacgttgaagagacctgaccatcaccaaagagagagcgcacaacagacccgtagcaccccacggaagcagaccacaaaagcgaaacacgagacaccacacccc

SEQ ID NO: 714571 - DNA, 107 bp, Homo sapiens
  misc_feature (17)..(17): n is a, c, g, or t
  misc_feature (29)..(29): n is a, c, g, or t
  misc_feature (33)..(33): n is a, c, g, or t
ttacggtcttaagcggnctaaatggcccngganggccctgggtggcgagaagatacattccatggtgaaggagaccaagaaccaggactggagccaggcgatattac

SEQ ID NO: 714572 - DNA, 197 bp, Homo sapiens
caaggacttatactcaggaggctgcggtggcctgatcagtaggtcagcagttcaagaccagcctgaccgatatgtgtgaaaccccacctctactaaaaatacaaaaattagctgagcatggtggcgttttcctgtggccccagctactcaggaggctgaggtgggaggatcactggaacccgggagcagagactgca

SEQ ID NO: 714573 - DNA, 124 bp, Homo sapiens
  misc_feature (71)..(71): n is a, c, g, or t
tcgagctcggccccaattattagaacaaaaaagtggtagagataactatattaaaaatctgttaggtattntctttaaaagtaggtgtttttttttttccttccctttttttcctaataactgg

SEQ ID NO: 714574 - DNA, 1048 bp, Homo sapiens
tcaaagcaatacactgaaaatgtttagaaaaaataaaaaagaaaaaaacaagaaaaaaaaaaaaaaaaaaaaaaaaaaaaaaaaaaaagaaggggggggtggggagtaatatattgtctctctgtgagaggtgcggcgaatgatgcctggagttatccaaggtatgttttttgatcaagaggggtggcctgaagagggaggcagtttctttaagctggcgaaggggtgagaggttggagtgtaaatgcttgaagagtggggagaacagctgtgttgcacccatgggaagatggcaggggtgaaaaaggagcaccactgtgtacacgtccgagggggggggagaccagatcgatgtggggctccagacgctaccaccttgagaacgaaacattttcaagggaccgacgacgggagagagaaaattagaaatttttatcacaggggtgtatataagggcggtgtgtgaactacaacaagaggcgtgatattggagtggggaaagcgcttgaagtaaaaatttggagcagaggcgggagagaatgaataatggtatagaagaattttattttattataacagtgggaaggttttgtgtttttcaaaaaaaaaaaggcccataacaacagttgaagaaaaatgggccaataagggccaaggattacgttaagcaagttgtcagagctgggagatggttcttcttcttttgttgccaaaagtggctaacaagttgtacaacaggccccctaaaggcaattgaaaggtgggcaaacaatcgggtttggagatttcagcaaaaaagtaacttttccaacagttaacagaaggtttaagttttttggccctggtggtctgggtgtccttgggacctgggctactattttccttggctggttccagttatggtcgtttcactggggtaagacaacaccaagacccaagaccagaacgcttcaacccaaagcaaacaggaacctacccaaaaaccttaacgttacagacagttttaacaagccatatggaccgacaagccaaacccacggaatagagc

SEQ ID NO: 714575 - DNA, 284 bp, Homo sapiens
cttgtgggatactgcctgggaccggtttccgtgacttctgaagagactgtcacttccctctcacgatcctgcggcgatttcaggcttactaactccccaactttctgagtctgggtgcactcgttctgtcacctttccgcgggtctcttgcgtcgcccttctgtgctcacgccactcatatattcttgatccggagttccaggagaatcgggatccattcttgtcgcatctttgtgggtccaacatgcacttgtcccgcaacttgtaacggcggggggtaccga

SEQ ID NO: 714576 - DNA, 467 bp, Homo sapiens
  misc_feature (103)..(103): n is a, c, g, or t
  misc_feature (109)..(109): n is a, c, g, or t
  misc_feature (271)..(271): n is a, c, g, or t
  misc_feature (290)..(290): n is a, c, g, or t
  misc_feature (296)..(296): n is a, c, g, or t
  misc_feature (413)..(413): n is a, c, g, or t
aacgggtgatgcggttgggcagaaccgcaccaagctcgtcgacagcaagattgtgtttcctcatggcatcacgctggacctggtcagccgccttgtctactgngcagangcctatctggactatattgaagtggtggactatgagggcaagggccgccagaccatcatccagggcatcctgattgagcacctgtacggcctgactgtgtttgagaattatctctatgccaccaactcggacaatgccaatgcccagcagaagacgagtgtnatccgtgtgaaccgctttnacagcnccgagtaccaggttgtcacccgggtggacaagggtggtgccctccacatctaccaccagaggcgtcagccccgagtgaggagccatgcctgtgaaaacgaccagtatgggaagccgngtggctgctctgacatctgcctgctgccaacagccacaaggcgcggacctgccg

SEQ ID NO: 714577 - DNA, 557 bp, Homo sapiens
ggagctcggtaccagtttcgacggagactctctgcaagtatcccccacagtgatatgttgtgagaagagaggcagtgttgcacaggatctaaatgcacacgctatgagtcagagagacatctgggttatgcagcgctctacccctatagctagtaatcgtctaaactaagtagcttaacctcactttcctcagttgtattagggggtgataacagtaccaacctcatagggctagtgtgatgcttgcatagactactaaagtggtacagtaaggacttagcatgtagtaagtgctcatacaaaatgttagctagcactgactactgctataataggcccattccaaagttaaaacagctccaactatcaggaaggtcaaaaccagctgtctgcttcctccctctcatgaatcctagtctgccctacagaatttcaccagtctctgagttgctgtcaacagggagggtggatggggccatggcccacctgagtctccttgttaccaagcagaacatgcccagcttcctcgacggttcctcaggtggcctccatgatca

SEQ ID NO: 714578 - DNA, 294 bp, Homo sapiens
  misc_feature (241)..(241): n is a, c, g, or t
  misc_feature (276)..(276): n is a, c, g, or t
  misc_feature (291)..(291): n is a, c, g, or t
gtaccaccagtgcaactgaaggaccagtttgggcaaccctctcccacgtcagcatggacgatcaaatagaaccatgtcacctggagtctggcagacatcacacctgccaacaacgccgggctgaaccgccacactactggaaacagcatttaccatccattgcgtcgtaaatatatggtagtaacgccgtaataaaatatagtaatcacaccaaggttgtagataatagtaatcaatccanaaaccgccatattccactgagacaatccattattncacggatcgacgtcncgc

SEQ ID NO: 714579 - DNA, 448 bp, Homo sapiens
  misc_feature (1)..(1): n is a, c, g, or t
ntgtttactgctgtttgactttccccttgacatttctcagaaaaatgcagggctgcagctgagagcagactgctgattggtgactctggtctgcctagcttttgcaactctttaagcttactgtgatcacgtgccctctcagtagggggcttttagagcagttgaaatctgcagaactgaacctctgagggccaaaataggacatttgggaacaactccttaacccatgaactagctgtaacatagtttgtggatccatgcactgatgctgtgaagcctgcccctgtgtgtatctgttctctcacctccctagcactgtaagcagcggtgcctcttgtagcatgtgtgtttgttttttaatgtttcatgactcccactttgattttacatgttttcttgtaaataagcctgccttcctacctggaatttgtgtgtgtgtgactaatac

SEQ ID NO: 714580 - DNA, 2580 bp, Homo sapiens
gctgagagacgacctggaagttctgaggcagcctttgtctggctggaacacgcattggcagcgggagctgtcggtaggacctgggacaccgcggaagtcgggaaatggcctcagtggctttagaggatgtggctgtgaacttcacccgagaagagtgggctttgctgggtccttgtcagaagaatctctacaaagatgtgatgcaggaaaccatcaggaacctggattgtgtagtaatgaaatggaaagaccagaacattgaagatcaatatagatatcccaggaaaaatctaagatgtcgtatgttagagagatttattgaaagtaaagatggaactcaatgtggagaaacatctagccagattcaagatagtattgtgaccaagaacactcttcctggagtaggtccttgtgaaagcagtatgagaggagaaaaagtcatgggtcattcatcccttaattgttacatcagagttggtgctgggcacaaaccacatgagtatcatgaatgtggagagaagccagatacgcataaacaacgtgggaaagccttcagttaccacaactcatttcaaacacatgagaggcttcacactggaaagaaaccatatgattgtaaagaatgtgggaagtccttcagttctttgggaaaccttcaaagacacatggcagtgcagcgtggagatggaccttataaatgtaagttgtgtgggaaagcgtttttttggcccagtttattacatatgcatgaaagaacgcacactggagagaaaccatatgaatgtaagcagtgttctaaagccttttctttttacagttcctatctaagacatgaaagaacacatactggggagaaaccgtatgaatgtaaacagtgttctaaagcctttcctttttacagttcctatctaagacatgaaagaacacatactggggagaaaccatataaatgtaagcagtgttctaaagccttccctgattccagttcttgtctaatacatgaaagaactcacactggagagaaaccctatacatgtaaacaatgtgggaaagccttcagtgtttccggttcccttcaaagacatgaaaccactcacagtgcagagaaaccctatgcatgtcagcaatgtgggaaagcgtttcatcatctgggaagctttcaaagacacatgataaggcacactggaaatggacctcataaatgtaagatatgtgggaaaggctttgattgtcctagttcactgcaaagtcatgaaagaactcacactggagagaaaccctatgaatgcaagcagtgtgggaaagcattatctcatcgctcaagctttcgaagtcatatgataatgcacactggagatggacctcataaatgcaaggtatgtgggaaagcctttgtttatcccagtgtatttcaaagacatgaaaggactcacactgcagagaaaccctataaatgtaaacaatgtggcaaagcctaccgtatttccagttcccttcgaaggcatgaaacaactcatactggagagaaaccctataaatgcacacttgggaaagcctttattgatttctgttcctttcaaaatcacaaaacaactcacactggagagaagccatatgagtgtaaggaatgtgggaaagcattcagtcgtttcagatacctttctcgacataaaaggactcacacaggagagaaaccttatgagtgtaaaacatgtaggaaagccttcggtcattatgataacttaaaggtacatgaaagaattcactctggagagaagccgtatgaatgtaaggaatgtgggaaagcattctcttggctcacttgctttctacgacatgaaagaattcacatgagagagaaatcctatgaatgtccacaatgtggtaaagccttcactcattcccgttttcttcaaggacatgaaaaaactcatactggagagaacccgtatgaatgtaaggaatgtgggaaagcatttgcttctctcagttccttgcatagacataaaaagactcactggaaaaaaactcacactggagagaacccatatgaatgtaaggaatgtgggaaagcatttgcttctctcagttccttgcatagacataaaaagactcactagcattctctctaaatgtatggaatgtgggaaagcatttattaattttatttcatttcagatacttgtacgaaacacattggagatagaccctgtgaatgtaagcacttggtaaagccttaagtagtttcagtttctttccagtacagtcatcccttgatacctgctgggtattggttccagcactccgtgagccatgtccagtcccttttataaaatgacatgtttgtatgtaacttacccacatcctcttgtatagtctcaattatgtctagattacttaaaatacctcatgcattataaaagctatgcaaatagttgttctattgtattgtttagggaatcatgataaggaaaagagtctatgtattttcagtatagatgcagtaattgtcagcctatcaacatagtgtagtcagccagaacattaaagtttctttgtttcaactcccaaaaaaaaaaa

SEQ ID NO: 714581 - DNA, 3601 bp, Homo sapiens
ggagacacaccgcggccgatgacaggcgcagagcaggacgtggtgaggtcctcatacctaggaatgcagaacaagggcaagaaactcggtgcccgcctggcatctgccctgcaccagtggcctccaggaagttctccaccaaggatgttccccaggcactctgtgctcgccttcaccagcgtcctgtgaggtctttcacactgatggggaagcctttctaaagggtattagggggctggggggctgggggtgctgagtaccaagggtcccaggaagagacaggccaggcttatgggctgggcatccagagatcgccctgacgccagctccaggtggagttaggagggcactcttgtcccgacgcatttacagaccactccctcttcttgttcccctcgactctgagagtgtggtggggtagctgtggaacctgactgcttgcctgaaggttgggcagcgtggctagaaattgcggcccagacctgggatctcacccacacctctatgagacgtcctgaaggaaaccatcgactgagcggagaggcttcgccttgcccgcctcctcccaggaaggaagagcggaagaggcgtcgccagccaccgagactgccagccaccaccccctcccagactctctgtccccaccccagaccagggtcaccttcttcctgcactgggggtggggtgcggtaggtttcgcaatccagactgtggggtgggggtgggagcaggtgtgtgtaaatgagcagctcgtcaggagtcactgagaaggaggcagatggagctggtacccagcaggtctcctctcataagcgtcaaccctcgcctgggcgggctgggggatcctcagcaccccagctctgagccaggggtctgcaacccgggcaccagcgatgggccctcatgcacacagggcgccgagcggggcgcggaggaagagtgacttcagacaggaacccgacgccacagccggtgacgcggaccctgggtcagccagcacgatgggccgctggggagaggagggctggaggcaaagagtgtaagtgtgcagccttcatcagcttaattttaatcgcgttatgtaagtggcttcatctcaacgtcacatgggggggggtctcagatttaattacaggatgacagcctttgcttttcaagcaagctgttctcctggcaagccaggcgaaggattggggagttttgctaaacagaaggagccctttctgaggtgaccacccgtcaaaacttgaacccgcttccacctccgtctccctcttcccgaccagcctcacccagcctcggctgaatgtggcctgagagtagccacttgtccgcaatcacagggacgttttatgcctgtcaagggagcttcctctctcctcttcctccccctcccaccttctgcctggcagctttgccttctctccaagagaagggtccacccaatcagaactcctcttccttttcattcctggattaaagcacttgtaatcagtaaccagaaagttccagagcgggagagaccggaaggcactggagtgctatcggacgggtgtctggggcagagccaggagggcgagcctcttctctccccgcctgcccttgctcacttccccctccatgccaggtgctgtgggagcagctgggcctggccggggtcggcgggtgaagctatccgcatggtgtctggagcaccgtttctttgcttcctggatgggctggatgggctcccgtgttcttcaccaatggcagcgttaccagcaccaatggcagcgttaccagcaagaaggcaaaggcaggagcacatcgagggtgggagccaggctgtggggtcaggagtcccgctccttgccgcgggaagcctggctcagccacctccagcacacttcggctttgtccagcataaaaggcagagcgacgttttcactgcaggctgtttcccaccagggcaagtgggacagggcgagtgctgacgtctgcaggcatggtgtgcatttaggggtgggcggcaccgagggggcatcatttggcataggcgggcccgggggccactgggctagatgactggctggttgctgggggcaggtgtcacagcctctctgagcaccctctaagtggaggacagaacattgttgggaggagtccaggcataaagtgacataaacagcgcagagaatgggaccagcgcacctgagaggtgatcattagcctcagcaactggatgggacattccgaagagctcccagccaacacagatggtcactccagaggctgacatttaaaaggaaggggcccggccgggcacagtggctcacgcctgtaatcacaacactttgggaggctgaggcgggcagatcaactggggtcaggagttcaaaaccagcctggccaacatggtgaaaccgcatctctgctgaaaatacaaaaaattagccaggcatggtggtgggcacctgtaatcccagctactcaggaggctgaggtaggaggatcgcttgaacccaggaagtagaggttgcagtgagccgagattgtgccattgcactccagcctgggcgacaagcgaaacttcgtctcaaaataaataaaagtaaggggcacagggagggggccccagctcgtgccccttctgtgtgggctgcacatggtgacttccttccagagagcacagagtgggaggtaggcaaggcgtctccacagtggagagcccgacccactgtctcagcccagaggtcaaggctggcaccatcaccgagaggtcacacgggcagatgtgacagggcgcttcaccactgggctcttcctcccagacccataacccttgtcttagtattagaaaaacactggcagaccgggcgcagtggcttacacctgtaatcgcagcattttgggaggccgaggtgggaagattgttcaagagcagtctgggcaacatagtgagaccccatctctacaaaaaaaatttttttttaattagccaggcgtgatggcacatgcctgtggtcctagccactagaggctgaggtgggaggatcactggagcccaggaggtcaaggctgcagtgagctgtgatcacaccactgcactccagccttggcgacaaaccaagaccctgtctcgaacagaaaagaaacattaaccttagcgcaaatcccaacaggggcgacactctacagaaaaaccgacagcctcctgaaaacttcccagtcctcaaacccacgaagtgggctgggcgcggtgggtcacacttaatccagactttggaaggctgagggggcagatcccaggtccggagttgagaccaggctagcacctggcggaactctctctttaattccaaaatatcggcggggaagggccgtgttccccatcggagggcgggaaattttggtccacagcggggtgtcgagcggacaatacccagatggcggggggagaagaagcgtgctgtgtaaaaaaaacacaacagggagggtgggtcagaggaggagcacaatcttctggcggcaaaaacagcaaggttaaacagacgcagtgtgcgtgtgtagttattcttttgtcgtcttcggtgcggtccgtctggttggtgtgtgggtatgg

SEQ ID NO: 714582 - DNA, 204 bp, Homo sapiens
gccaggctgtgtgtaaggtcttgaggatttagtaacgtactcaggtacaacatcaggtgaggtttgtcgggcacagaccagcgtagcagtgtcgggaaaggcaccttgtccactcctacgatacgctactataaagagaagacgaaatagtgacataatatattctattctcatactcttcctactcccgtcgcttgaccctgt

SEQ ID NO: 714583 - DNA, 434 bp, Homo sapiens
gcgtcagaccccatgtacaaataaaaaataagagacataaatgaatacaatgtaagatagtatctatcttcagggagtatcctgagacaattcaaggtgggcaaaatgaaacattcattgaaaagttttggtgaagaagaagttaaaatgatgacttagggttgtatgtcagatattttaataatgttggcagttcctagattctacagtctttctcaaaactaagaggtttatccctaaggcaattttcttctctttttttactaccaaaaatgtttattctatcggcaggtttccagtgactagaaaaatttccttctttacaactctgaaatcgtagctcaaatcattttctaacagagtgaaagtaaaaacattattagttgatgtcagcaccagcagaaaatctcttaaaactggacatttctttaaaa

SEQ ID NO: 714584 - DNA, 3574 bp, Homo sapiens
ggagacacaccgcggccgatgacaggcgcagagcaggacgtggtgaggtcctcatacctaggaatgcagaacaagggcaagaaactcggtgcccgcctggcatctgccctgcaccagtggcctccaggaagttctccaccaaggatgttccccaggcactctgtgctcgccttcaccagcgtcctgtgaggtctttcacactgatggggaagcctttctaaagggtattagggggctggggggctgggggtgctgagtaccaagggtcccaggaagagacaggccaggcttatgggctgggcatccagagatcgccctgacgccagctccaggtggagttaggagggcactcttgtcccgacgcatttacagaccactccctcttcttgttcccctcgactctgagagtgtggtggggtagctgtggaacctgactgcttgcctgaaggttgggcagcgtggctagaaattgcggcccagacctgggatctcacccacacctctatgagacgtcctgaaggaaaccatcgactgagcggagaggcttcgccttgcccgcctcctcccaggaaggaagagcggaagaggcgtcgccagccaccgagactgccagccaccaccccctcccagactctctgtccccaccccagaccagggtcaccttcttcctgcactgggggtggggtgcggtaggtttcgcaatccagactgtggggtgggggtgggagcaggtgtgtgtaaatgagcagctcgtcaggagtcactgagaaggaggcagatggagctggtacccagcaggtctcctctcataagcgtcaaccctcgcctgggcgggctgggggatcctcagcaccccagctctgagccaggggtctgcaacccgggcaccagcgatgggccctcatgcacacagggcgccgagcggggcgcggaggaagagtgacttcagacaggaacccgacgccacagccggtgacgcggaccctgggtcagccagcacgatgggccgctggggagaggagggctggaggcaaagagtgtaagtgtgcagccttcatcagcttaattttaatcgcgttatgtaagtggcttcatctcaacgtcacatgggggggggtctcagatttaattacaggatgacagcctttgcttttcaagcaagctgttctcctggcaagccaggcgaaggattggggagttttgctaaacagaaggagccctttctgaggtgaccacccgtcaaaacttgaacccgcttccacctccgtctccctcttcccgaccagcctcacccagcctcggctgaatgtggcctgagagtagccacttgtccgcaatcacagggacgttttatgcctgtcaagggagcttcctctctcctcttcctccccctcccaccttctgcctggcagctttgccttctctccaagagaagggtccacccaatcagaactcctcttccttttcattcctggattaaagcacttgtaatcagtaaccagaaagttccagagcgggagagaccggaaggcactggagtgctatcggacgggtgtctggggcagagccaggagggcgagcctcttctctccccgcctgcccttgctcacttccccctccatgccaggtgctgtgggagcagctgggcctggccggggtcggcgggtgaagctatccgcatggtgtctggagcaccgtttctttgcttcctggatgggctggatgggctcccgtgttcttcaccaatggcagcgttaccagcaccaatggcagcgttaccagcaagaaggcaaaggcaggagcacatcgagggtgggagccaggctgtggggtcaggagtcccgctccttgccgcgggaagcctggctcagccacctccagcacacttcggctttgtccagcataaaaggcagagcgacgttttcactgcaggctgtttcccaccagggcaagtgggacagggcgagtgctgacgtctgcaggcatggtgtgcatttaggggtgggcggcaccgagggggcatcatttggcataggcgggcccgggggccactgggctagatgactggctggttgctgggggcaggtgtcacagcctctctgagcaccctctaagtggaggacagaacattgttgggaggagtccaggcataaagtgacataaacagcgcagagaatgggaccagcgcacctgagaggtgatcattagcctcagcaactggatgggacattccgaagagctcccagccaacacagatggtcactccagaggctgacatttaaaaggaaggggcccggccgggcacagtggctcacgcctgtaatcacaacactttgggaggctgaggcgggcagatcaactggggtcaggagttcaaaaccagcctggccaacatggtgaaaccgcatctctgctgaaaatacaaaaaattagccaggcatggtggtgggcacctgtaatcccagctactcaggaggctgaggtaggaggatcgcttgaacccaggaagtagaggttgcagtgagccgagattgtgccattgcactccagcctgggcgacaagcgaaacttcgtctcaaaataaataaaagtaaggggcacagggagggggctgcacatggtgacttccttccagagagcacagagtgggaggtaggcaaggcgtctccacagtggagagcccgacccactgtctcagcccagaggtcaaggctggcaccatcaccgagaggtcacacgggcagatgtgacagggcgcttcaccactgggctcttcctcccagacccataacccttgtcttagtattagaaaaacactggcagaccgggcgcagtggcttacacctgtaatcgcagcattttgggaggccgaggtgggaagattgttcaagagcagtctgggcaacatagtgagaccccatctctacaaaaaaaatttttttttaattagccaggcgtgatggcacatgcctgtggtcctagccactagaggctgaggtgggaggatcactggagcccaggaggtcaaggctgcagtgagctgtgatcacaccactgcactccagccttggcgacaaaccaagaccctgtctcgaacagaaaagaaacattaaccttagcgcaaatcccaacaggggcgacactctacagaaaaaccgacagcctcctgaaaacttcccagtcctcaaacccacgaagtgggctgggcgcggtgggtcacacttaatccagactttggaaggctgagggggcagatcccaggtccggagttgagaccaggctagcacctggcggaactctctctttaattccaaaatatcggcggggaagggccgtgttccccatcggagggcgggaaattttggtccacagcggggtgtcgagcggacaatacccagatggcggggggagaagaagcgtgctgtgtaaaaaaaacacaacagggagggtgggtcagaggaggagcacaatcttctggcggcaaaaacagcaaggttaaacagacgcagtgtgcgtgtgtagttattcttttgtcgtcttcggtgcggtccgtctggttggtgtgtgggtatgg

SEQ ID NO: 714585 - DNA, 851 bp, Homo sapiens
  misc_feature (682)..(682): n is a, c, g, or t
tggaaactttaaaatccctcaaaaacggtttattatacaagtgagtttggagtcacgaggggcttatcggtaggatttctgggtagcgagcgcgggcaccagggcctccaaacttttgggactcgcagcgacgagggtcagctaccagcagggtccggtcatacgggatgaggatgtctttgatctccttctgggaagcctcatccacatatttctgggtaataggccaccggggcttgggagagtggactgacggatagcataaatcgtgggccacgtgaccaccacccttttacacggacacggttgtttacaccagcaaatcgcctccttgccgagaagcagaacgtggcctccagcagcttgtactggtagcgtggcgcgggctcaatcatctccgggggccgcccgttcaccttgatgagaccttggccgcgtttggcagtggcgccacagtgtgtcgctggtcttctggggtccgaagacctgcacagactgcagggggcccttgtgacggcttggtctccgagcgtggactagcgggggcacctgaaggagactggggggcccccgggtcgtgcctcctgggttgtgaggagtcgccgttgccgccattgcctgtgcttcatgaggaagatgctcgccgagcgtctcccgagtgctgtcggggcgctttctcaanagccggaaagcaagagtgcggggtaagcaccccgtaaatttggccaagtgatgcacacttggaccatgacgaatgtgtgaccttcaccgggttgaaaagaggccccctgtcaccaaagggctccacggggaggaggggcccaaacctacggtgatccgatcgtacccaa

SEQ ID NO: 714586 - DNA, 227 bp, Homo sapiens
tgggatcgacgggcagattcttgttcccagcccttggggctccgtgtatggggtgggggagctgcttagagactgtgcccgtcctcgtgcccccacaccgctgatgtgccagcaccaccatgcaccatgatccgtccgcctgccaacacctggcacttgagtgacactgcctggcctgggcctgcctcgtactcaacgttgtatacaagttgtcccctgtggtccct

SEQ ID NO: 714587 - DNA, 3009 bp, Homo sapiens
  misc_feature (2978)..(2978): n is a, c, g, or t
  misc_feature (2995)..(2995): n is a, c, g, or t
  misc_feature (3006)..(3006): n is a, c, g, or t
ggagacacaccgcggccgatgacaggcgcagagcaggacgtggtgaggtcctcatacctaggaatgcagaacaagggcaagaaactcggtgcccgcctggcatctgccctgcaccagtggcctccaggaagttctccaccaaggatgttccccaggcactctgtgctcgccttcaccagcgtcctgtgaggtctttcacactgatggggaagcctttctaaagggtattagggggctggggggctgggggtgctgagtaccaagggtcccaggaagagacaggccaggcttatgggctgggcatccagagatcgccctgacgccagctccaggtggagttaggagggcactcttgtcccgacgcatttacagaccactccctcttcttgttcccctcgactctgagagtgtggtggggtagctgtggaacctgactgcttgcctgaaggttgggcagcgtggctagaaattgcggcccagacctgggatctcacccacacctctatgagacgtcctgaaggaaaccatcgactgagcggagaggcttcgccttgcccgcctcctcccaggaaggaagagcggaagaggcgtcgccagccaccgagactgccagccaccaccccctcccagactctctgtccccaccccagaccagggtcaccttcttcctgcactgggggtggggtgcggtaggtttcgcaatccagactgtggggtgggggtgggagcaggtgtgtgtaaatgagcagctcgtcaggagtcactgagaaggaggcagatggagctggtacccagcaggtctcctctcataagcgtcaaccctcgcctgggcgggctgggggatcctcagcaccccagctctgagccaggggtctgcaacccgggcaccagcgatgggccctcatgcacacagggcgccgagcggggcgcggaggaagagtgacttcagacaggaacccgacgccacagccggtgacgcggaccctgggtcagccagcacgatgggccgctggggagaggagggctggaggcaaagagtgtaagtgtgcagccttcatcagcttaattttaatcgcgttatgtaagtggcttcatctcaacgtcacatgggggggggtctcagatttaattacaggatgacagcctttgcttttcaagcaagctgttctcctggcaagccaggcgaaggattggggagttttgctaaacagaaggagccctttctgaggtgaccacccgtcaaaacttgaacccgcttccacctccgtctccctcttcccgaccagcctcacccagcctcggctgaatgtggcctgagagtagccacttgtccgcaatcacagggacgttttatgcctgtcaagggagcttcctctctcctcttcctccccctcccaccttctgcctggcagctttgccttctctccaagagaagggtccacccaatcagaactcctcttccttttcattcctggattaaagcacttgtaatcagtaaccagaaagttccagagcgggagagaccggaaggcactggagtgctatcggacgggtgtctggggcagagccaggagggcgagcctcttctctccccgcctgcccttgctcacttccccctccatgccaggtgctgtgggagcagctgggcctggccggggtcggcgggtgaagctatccgcatggtgtctggagcaccgtttctttgcttcctggatgggctggatgggctcccgtgttcttcaccaatggcagcgttaccagcaccaatggcagcgttaccagcaagaaggcaaaggcaggagcacatcgagggtgggagccaggctgtggggtcaggagtcccgctccttgccgcgggaagcctggctcagccacctccagcacacttcggctttgtccagcataaaaggcagagcgacgttttcactgcaggctgtttcccaccagggcaagtgggacagggcgagtgctgacgtctgcaggcatggtgtgcatttaggggtgggcggcaccgagggggcatcatttggcataggcgggcccgggggccactgggctagatgactggctggttgctgggggcaggtgtcacagcctctctgagcaccctctaagtggaggacagaacattgttgggaggagtccaggcataaagtgacataaacagcgcagagaatgggaccagcgcacctgagaggtgatcattagcctcagcaactggatgggacattccgaagagctcccagccaacacagatggtcactccagaggctgacatttaaaaggaaggggcccggccgggcacagtggctcacgcctgtaatcacaacactttgggaggctgaggcgggcagatcaactggggtcaggagttcaaaaccagcctggccaacatggtgaaaccgcatctctgctgaaaatacaaaaaattagccaggcatggtggtgggcacctgtaatcccagctactcaggaggctgaggtaggaggatcgcttgaacccaggaagtagaggttgcagtgagccgagattgtgccattgcactccagcctgggcgacaagcgaaacttcgtctcaaaataaataaaagtaaggggcacagggagggggctgcacatggtgacttccttccagagagcacagagtgggaggtaggcaaggcgtctccacagtggagagcccgacccactgtctcagcccagaggtcaaggctggcaccatcaccgagaggtcacacgggcagatgtgacagggcgcttcaccactgggctcttcctcccagacccataacccttgtcttagtattagaaaaacactggcagaccgggcgcagtggcttacacctgtaatcgcagcattttgggaggccgaggtgggaagattgttcaagagcagtctgggcaacatagtgagaccccatctctacaaaaatgctgcgattacaggtgtaagccactgcgcccggtctgccagtggnttacaccctgtaattgnagcattttggngag

SEQ ID NO: 714588 - DNA, 244 bp, Homo sapiens
atagttcaatcatcccaagtaggcgatgtgtagaagtctgtgcttgccagaaaggtcatcttcgtagtaggggaggcagcagaagaagaaggcacagccactcaggactaatctgtgtgctgcccaccacaaagccgataggcccagttatagatgtaagtgacagcagggttggcatgaagggtgaaggtctgggtgtacttcacggggtacattaccagggagatgatctgggacacagcag

SEQ ID NO: 714589 - DNA, 3050 bp, Homo sapiens
ggagacacaccgcggccgatgacaggcgcagagcaggacgtggtgaggtcctcatacctaggaatgcagaacaagggcaagaaactcggtgcccgcctggcatctgccctgcaccagtggcctccaggaagttctccaccaaggatgttccccaggcactctgtgctcgccttcaccagcgtcctgtgaggtctttcacactgatggggaagcctttctaaagggtattagggggctggggggctgggggtgctgagtaccaagggtcccaggaagagacaggccaggcttatgggctgggcatccagagatcgccctgacgccagctccaggtggagttaggagggcactcttgtcccgacgcatttacagaccactccctcttcttgttcccctcgactctgagagtgtggtggggtagctgtggaacctgactgcttgcctgaaggttgggcagcgtggctagaaattgcggcccagacctgggatctcacccacacctctatgagacgtcctgaaggaaaccatcgactgagcggagaggcttcgccttgcccgcctcctcccaggaaggaagagcggaagaggcgtcgccagccaccgagactgccagccaccaccccctcccagactctctgtccccaccccagaccagggtcaccttcttcctgcactgggggtggggtgcggtaggtttcgcaatccagactgtggggtgggggtgggagcaggtgtgtgtaaatgagcagctcgtcaggagtcactgagaaggaggcagatggagctggtacccagcaggtctcctctcataagcgtcaaccctcgcctgggcgggctgggggatcctcagcaccccagctctgagccaggggtctgcaacccgggcaccagcgatgggccctcatgcacacagggcgccgagcggggcgcggaggaagagtgacttcagacaggaacccgacgccacagccggtgacgcggaccctgggtcagccagcacgatgggccgctggggagaggagggctggaggcaaagagtgtaagtgtgcagccttcatcagcttaattttaatcgcgttatgtaagtggcttcatctcaacgtcacatgggggggggtctcagatttaattacaggatgacagcctttgcttttcaagcaagctgttctcctggcaagccaggcgaaggattggggagttttgctaaacagaaggagccctttctgaggtgaccacccgtcaaaacttgaacccgcttccacctccgtctccctcttcccgaccagcctcacccagcctcggctgaatgtggcctgagagtagccacttgtccgcaatcacagggacgttttatgcctgtcaagggagcttcctctctcctcttcctccccctcccaccttctgcctggcagctttgccttctctccaagagaagggtccacccaatcagaactcctcttccttttcattcctggattaaagcacttgtaatcagtaaccagaaagttccagagcgggagagaccggaaggcactggagtgctatcggacgggtgtctggggcagagccaggagggcgagcctcttctctccccgcctgcccttgctcacttccccctccatgccaggtgctgtgggagcagctgggcctggccggggtcggcgggtgaagctatccgcatggtgtctggagcaccgtttctttgcttcctggatgggctggatgggctcccgtgttcttcaccaatggcagcgttaccagcaccaatggcagcgttaccagcaagaaggcaaaggcaggagcacatcgagggtgggagccaggctgtggggtcaggagtcccgctccttgccgcgggaagcctggctcagccacctccagcacacttcggctttgtccagcataaaaggcagagcgacgttttcactgcaggctgtttcccaccagggcaagtgggacagggcgagtgctgacgtctgcaggcatggtgtgcatttaggggtgggcggcaccgagggggcatcatttggcataggcgggcccgggggccactgggctagatgactggctggttgctgggggcaggtgtcacagcctctctgagcaccctctaagtggaggatgggaggtaggcaaggcgtctccacagtggagagcccgacccactgtctcagcccagaggtcaaggctggcaccatcaccgagaggtcacacgggcagatgtgacagggcgcttcaccactgggctcttcctcccagacccataacccttgtcttagtattagaaaaacactggcagaccgggcgcagtggcttacacctgtaatcgcagcattttgggaggccgaggtgggaagattgttcaagagcagtctgggcaacatagtgagaccccatctctacaaaaaaaatttttttttaattagccaggcgtgatggcacatgcctgtggtcctagccactagaggctgaggtgggaggatcactggagcccaggaggtcaaggctgcagtgagctgtgatcacaccactgcactccagccttggcgacaaaccaagaccctgtctcgaacagaaaagaaacattaaccttagcgcaaatcccaacaggggcgacactctacagaaaaaccgacagcctcctgaaaacttcccagtcctcaaacccacgaagtgggctgggcgcggtgggtcacacttaatccagactttggaaggctgagggggcagatcccaggtccggagttgagaccaggctagcacctggcggaactctctctttaattccaaaatatcggcggggaagggccgtgttccccatcggagggcgggaaattttggtccacagcggggtgtcgagcggacaatacccagatggcggggggagaagaagcgtgctgtgtaaaaaaaacacaacagggagggtgggtcagaggaggagcacaatcttctggcggcaaaaacagcaaggttaaacagacgcagtgtgcgtgtgtagttattcttttgtcgtcttcggtgcggtccgtctggttggtgtgtgggtatgg

SEQ ID NO: 714590 - DNA, 160 bp, Homo sapiens
aagtactgggatgtatgtgctgctaacaaacccagctgatttcttttttttttttggcgagacagatatcgctctgttgcctaggttggagtgcaatgcgtgatctcaggtcactgcaacctctgcctctcccaggtccaagtgatactcctgcctcagc

SEQ ID NO: 714591 - DNA, 2055 bp, Homo sapiens
ttctcaatgagctgttgggtacacctcccagacggggtggtggccgggcagaggggctcctcacttccccctccatgccaggtgctgtgggagcagctgggcctggccggggtcggcgggtgaagctatccgcatggtgtctggagcaccgtttctttgcttcctggatgggctggatgggctcccgtgttcttcaccaatggcagcgttaccagcaccaatggcagcgttaccagcaagaaggcaaaggcaggagcacatcgagggtgggagccaggctgtggggtcaggagtcccgctccttgccgcgggaagcctggctcagccacctccagcacacttcggctttgtccagcataaaaggcagagcgacgttttcactgcaggctgtttcccaccagggcaagtgggacagggcgagtgctgacgtctgcaggcatggtgtgcatttaggggtgggcggcaccgagggggcatcatttggcataggcgggcccgggggccactgggctagatgactggctggttgctgggggcaggtgtcacagcctctctgagcaccctctaagtggaggacagaacattgttgggaggagtccaggcataaagtgacataaacagcgcagagaatgggaccagcgcacctgagaggtgatcattagcctcagcaactggatgggacattccgaagagctcccagccaacacagatggtcactccagaggctgacatttaaaaggaaggggcccggccgggcacagtggctcacgcctgtaatcacaacactttgggaggctgaggcgggcagatcaactggggtcaggagttcaaaaccagcctggccaacatggtgaaaccgcatctctgctgaaaatacaaaaaattagccaggcatggtggtgggcacctgtaatcccagctactcaggaggctgaggtaggaggatcgcttgaacccaggaagtagaggttgcagtgagccgagattgtgccattgcactccagcctgggcgacaagcgaaacttcgtctcaaaataaataaaagtaaggggcacagggagggggccccagctcgtgccccttctgtgtgggctgcacatggtgacttccttccagagagcacagagtgggaggtaggcaaggcgtctccacagtggagagcccgacccactgtctcagcccagaggtcaaggctggcaccatcaccgagaggtcacacgggcagatgtgacagggcgcttcaccactgggctcttcctcccagacccataacccttgtcttagtattagaaaaacactggcagaccgggcgcagtggcttacacctgtaatcgcagcattttgggaggccgaggtgggaagattgttcaagagcagtctgggcaacatagtgagaccccatctctacaaaaaaaatttttttttaattagccaggcgtgatggcacatgcctgtggtcctagccactagaggctgaggtgggaggatcactggagcccaggaggtcaaggctgcagtgagctgtgatcacaccactgcactccagccttggcgacaaaccaagaccctgtctcgaacagaaaagaaacattaaccttagcgcaaatcccaacaggggcgacactctacagaaaaaccgacagcctcctgaaaacttcccagtcctcaaacccacgaagtgggctgggcgcggtgggtcacacttaatccagactttggaaggctgagggggcagatcccaggtccggagttgagaccaggctagcacctggcggaactctctctttaattccaaaatatcggcggggaagggccgtgttccccatcggagggcgggaaattttggtccacagcggggtgtcgagcggacaatacccagatggcggggggagaagaagcgtgctgtgtaaaaaaaacacaacagggagggtgggtcagaggaggagcacaatcttctggcggcaaaaacagcaaggttaaacagacgcagtgtgcgtgtgtagttattcttttgtcgtcttcggtgcggtccgtctggttggtgtgtgggtatgg

SEQ ID NO: 714592 - DNA, 1848 bp, Homo sapiens
ggagacacaccgcggccgatgacaggcgcagagcaggacgtggtgaggtcctcatacctaggaatgcagaacaagggcaagaaactcggtgcccgcctggcatctgccctgcaccagtggcctccaggaagttctccaccaaggatgttccccaggcactctgtgctcgccttcaccagcgtcctgtgaggtctttcacactgatggggaagcctttctaaagggtattagggggctggggggctgggggtgctgagtaccaagggtcccaggaagagacaggccaggcttatgggctgggcatccagagatcgccctgacgccagctccaggtggagttaggagggcactcttgtcccgacgcatttacagaacattgttgggaggagtccaggcataaagtgacataaacagcgcagagaatgggaccagcgcacctgagaggtgatcattagcctcagcaactggatgggacattccgaagagctcccagccaacacagatggtcactccagaggctgacatttaaaaggaaggggcccggccgggcacagtggctcacgcctgtaatcacaacactttgggaggctgaggcgggcagatcaactggggtcaggagttcaaaaccagcctggccaacatggtgaaaccgcatctctgctgaaaatacaaaaaattagccaggcatggtggtgggcacctgtaatcccagctactcaggaggctgaggtaggaggatcgcttgaacccaggaagtagaggttgcagtgagccgagattgtgccattgcactccagcctgggcgacaagcgaaacttcgtctcaaaataaataaaagtaaggggcacagggagggggccccagctcgtgccccttctgtgtgggctgcacatggtgacttccttccagagagcacagagtgggaggtaggcaaggcgtctccacagtggagagcccgacccactgtctcagcccagaggtcaaggctggcaccatcaccgagaggtcacacgggcagatgtgacagggcgcttcaccactgggctcttcctcccagacccataacccttgtcttagtattagaaaaacactggcagaccgggcgcagtggcttacacctgtaatcgcagcattttgggaggccgaggtgggaagattgttcaagagcagtctgggcaacatagtgagaccccatctctacaaaaaaaatttttttttaattagccaggcgtgatggcacatgcctgtggtcctagccactagaggctgaggtgggaggatcactggagcccaggaggtcaaggctgcagtgagctgtgatcacaccactgcactccagccttggcgacaaaccaagaccctgtctcgaacagaaaagaaacattaaccttagcgcaaatcccaacaggggcgacactctacagaaaaaccgacagcctcctgaaaacttcccagtcctcaaacccacgaagtgggctgggcgcggtgggtcacacttaatccagactttggaaggctgagggggcagatcccaggtccggagttgagaccaggctagcacctggcggaactctctctttaattccaaaatatcggcggggaagggccgtgttccccatcggagggcgggaaattttggtccacagcggggtgtcgagcggacaatacccagatggcggggggagaagaagcgtgctgtgtaaaaaaaacacaacagggagggtgggtcagaggaggagcacaatcttctggcggcaaaaacagcaaggttaaacagacgcagtgtgcgtgtgtagttattcttttgtcgtcttcggtgcggtccgtctggttggtgtgtgggtatgg

SEQ ID NO: 714593 - DNA, 913 bp, Homo sapiens
gagccccgtcgcgctcggagcagattcccgggactagggggcgggagaaagcctgttgcgtggaagataagtgcggcgcgggaagtggacacaggctgggctggagatctaactggactctcgactcctgactggcatgtgacatggagtgattttgtgaggaagatgtaagtgtttatatgtggatgagacggttgagactttgtgggggctgtacaccaatctgaccagccgtgagtgaggaagacataacatgtgtttggtgactcacgagatgaaagccacttctgacgtgggacctcatacccaacctgagagtgaccgcaaagttgcatgtgtgcaaccatgacacccaccagtcggtgttgaagggctccagtccgtagggacccacctacaatgtaccaagagagagagcctggcgatcggaaaaatcaccatcgaacatgaagggcccacggcccggggccttgggcaccatgcactccaagggctatgagaagacatatgtagtttggcccacattgcaacggtggaatcacgcacggaatgatagcgagcaaagggacgagaaaggaacacaattggagaggaccatcgagccactgaagtcgcttgtcaaaatgctgcccatggaatcacaataagaatacatgggacgaaaggtaaacgacgaatattggcatgaacgccatgtcacaagggggaaaaacagcaacccaatgacaacaccagaaagaaacgaacagcaaaagacccccaaaagaaggatagagaaagaatacagacaagaggaaaaggaaaagagaacgaacaaacaaacacaacaaaacacaacaccaaaaagacaagagaaccaaaggaaacaaagccgaaaacacgaaaaaacataccagacggaagaagaaaaaaa

SEQ ID NO: 714594 - DNA, 853 bp, Homo sapiens
gcatgtcatattcctggtggctccactcaggtcccgcgccaggtcatctcagtgtgcgattggaccgagcgtggtgccacatatagccgggtcgttacagagcggtcatctgaccagctttctctacttgttgtagtacaacgagaatcgtatcgatgagcggtacaactcgggttctgctggcaaagggaaatgacagcatgaacttcaatccggtgacagccgaattgtacgtggtctcgcctctagagtgatccatcgagtccgtgaagtcgtccccatcgacgtcacggatgggggaagtcatctccctggggctgcctttgggaaggtcaccaaccttctgatgctgaaggggaaaaaccaggccttcatcgagatgaacacggaggaggctgccaacaccatggtgaactactacacctcgggtgacccctgtgctgccgcggcaggccatctacatccagttctccaaccacaagggagctgaagaccgacagctctcccaacaggcgcgggcccaggcggccctgcaggcggtgaactcggtccagtcggggaacctggccttggctgcctcgcgggggccgtggacgcagggatggcgatggcgggcagagccccgtgctcaggatccatcgtgcgagaacctcttctacccctgtgaccctggattgtgctggcaccagattttctccaagttcgggacagtgttgaagatcatcacttcacaagaacaccagttccagggccctgtgcagtatgggaccccgtgagcgcccagaagcaagctgcgcgtggagggcgggaaatttacaaggctgtggagtgggcttatttcccaggtaccaac

SEQ ID NO: 714595 - DNA, 423 bp, Homo sapiens
tgcaggaattcggcactatgcagggcccggctgagaccaccccaagccctcttctcagtcccacccccagcaatccctcacctcttcatttcccagccctatagctcctcctccaggactcagtgcccttcatagccaacggcgcctctgctgtccaggggctgagccacaggtgactcgaatcctggtggaatgctccacaggctctccggtcactattacagagggtgtggacagaggtgtcaccatcttggggaaggggctgctgccaggtacagctggaggagaggtgattctgagtactctgtgactctcccagaagtcttgatttggacatacctgagagagaagcggccgctgagagagctgggcacagtggctcgcacctgtaatcctagcattttgggaccgaggcggctggtc

SEQ ID NO: 714596 - DNA, 723 bp, Homo sapiens
  misc_feature (185)..(185): n is a, c, g, or t
accaagatattgtattaagttgatgatccaaagcacgcgtcgtgcaacaggataattccttccggcttacgggtgttgagggttggcatatcgcttccgttctcggatatgggctgcaatagttgaaacattgcaacagcaaagtgactagagctcttcatttcagtattatgctcagatgtgangataaatgttatctgtcgatcattgctatagtcatacgctgtacaggaagacacttaggtgcgtccattttcacctcttgtgcacataagagcacagagctgctctctctgtcaccttcctggttctttacagcggagagaacattttcttgtcattgtgctgccctatataagggtggcatatgtgccttttgaactagcgtagtatttcgtgcatgttattaaacagttgatagttgtaatgcctttcaaccttttcctgctgtggtcatttttcttacaggctttttcacacaagattcagcagtcaattgttttttgcacacctataacatattatttgctgttcttgcatggatcgaacctccattctgtagccggccatcctttgccgtatctatcagtcttttttccaggaaggtggaaaagcaagtgttgctctcattgtgtgactcagtgttgctgtccatcccatgcaagcatggggctttcatagtatttgtccagcatactgcaggcttctcttgactttataata

SEQ ID NO: 714597 - DNA, 1566 bp, Homo sapiens
  misc_feature (160)..(160): n is a, c, g, or t
  misc_feature (452)..(452): n is a, c, g, or t
  misc_feature (1112)..(1112): n is a, c, g, or t
caaatgtgtcctcccttttctcccgggagcaagagctcctgttgtggttaccttataatttgggcacaaaacggacacacgccacatggaagttgccgcacataggcgcccatatctcctgaagggcgcactcccctctgggtgtgacccactacacccngccagacgtgtgcttgggaggggataatacccttctgccgttgtgccgctttcataatattataccccggggggtgataacttttttgtggggcccattttttgtgtgtgttgtcacacaccaccaagggaatggtggtctccctttcctctcgttggtaggagtcccatcaggggggacccaattatttgttcccttggtgcgccacaattaaaaaggtggtggtcatcaacacacgtggtccgtagtcccccctggtgtgccatgtgggtgttcccccaccttgtggccncccccaacaattgttgagaaagttctcacacttggtggcaccacagctccccacgaaaccacacactgtgggggttttcatcccggggcgcctccccgatggatgaaggaccccctcccccctcttgtgttgttccaccacagaggcctttttatagggtgatggtccacgccgcacctcgttagtagaaaagtttcttctcacacaggggggggcacacaccacacctgtggaagaaattctccctcggagagttatgatattgttggccacgccccttggagttctcacatagaaccccttgtggagagaacccacaaacagttggtgggagagtcccctcttgctgaagaagcccaacacgctctctgctgtgagacacacatgggctgcacacacactgtgcgtgccccgcgcttgtttttcctctttggggccttgtgtacacatacccacaccacagagttgttctggacacacaatggggcacagacactgttacgacacacaccctctgagaagtggcccttagacatattcacacacagagaggataactcttctggcacattttcttcgggctttcctctggagagcggtggtgtccgccacaatgtgttggggcacacagtgcgtgtctctgttctcgccacagagatntggctctatacccacacactcgtgtgggcactccacgtgaacccgcactcttctaatcactccacaccgggtgaccacacacacgaggtgtcctggccctctgttctcgtggagagaccgcgagttaacaccctttcccacactctggctgagaaaaggttacaaggcctcttcttgggtgagataccactcctgcctcttgtggactgctgcccctcgtggctgctgccacccaccagcctgctcctcgctgctgctgcacgccccacgctataaggttgaaaccccaaggaaagaagtcgcgagaggaagtcggaacgaaggaatatatgggaatttggtctctttgacactaaatcaccccaaaagccaacccacttagcccgcttgttaatttgccaaaacacagggaatataaggccttacttcctttataaaaaagagaaaaaaaaaa

SEQ ID NO: 714598 - DNA, 365 bp, Homo sapiens
gagccggaaacccagtccgaagtcgaaagccacggtcatgctcacgactaagagctgaaacgctttgatgtcacgcgcgaggagagctagttgcgcgtgacaatcagcattttccttttcttctcggctaccgctacatcatgcagctgaagtgttgaatggctgcttttggccggtttctgcctgttgcgtttctgctgcccactggccaagtcgtatgcacgcggtgttcagcaccaatgcaattgactggtcaaatgggtgcaattgcgcaggtatggactataagcctcaatttcctgggaaagaggttctttctatggacatccgacatcagagattgagtatcggtatgtctgagctga

SEQ ID NO: 714599 - DNA, 655 bp, Homo sapiens
gaaggaacgggagagggagaagtttggtagggaaggaattggggattaagcggtccctcagaggatccagcgaggggtgccaacaagaggcgaagaggtggcaccagggcggcggcaggaagaggagctgggagcatgtgatgcgcggagctggagctgtcccgaccctgcctgtgcgtactttctggagtggaagtgtggcgtgggtgaatcggcccctgagtggaagctgccctgtgtggcgagggggttagccaagttccggctgcgtgcgccactccctctggttccacggatgatggaaacgtttttttattattccagagactgctatcctgccttgtgctctgcgtgcccttcctgtgtgcccaggctctctcctggatgcctttcggatgctgtggctgcctgtccccagccctagctcctgggtgaaactgccgagccgctgattgcctggggggtgctcccggggccccgccgcctggggacgggcgtctgcggctggcgcgactagcgctggtactcctgggctgggtctcctcgtcttctcccacctcctcggcatcctccttctcctcctcggcgccgttcctggcttccgccgtgtccgcccagcccccgttgccggaccagtgccccgctgctgtgcgag

SEQ ID NO: 714600 - DNA, 146 bp, Homo sapiens
tcataatgtcgcccagcttacactcattactattctgcctgcaaactcaaactacgaacgcactcacagtcgcatccataaatccgtctcgtctagaggacttcaacactcgtactcccgactaattagcatttttgcatgacttc

SEQ ID NO: 714601 - DNA, 1094 bp, Homo sapiens
ctggcgcagagagtatcctggaccgccggtgggtggtcgctagggctgggccagccgcttggaggtccacgcccgccgagcccacgctggctggggccggggtgcctggcgcgctcgggactcgtctcagcagtcgctcactggtctttgtgtcttctcttcctgcccctttcccttgcctgcctgcctcctggcctgccactgatgcccctgctgccccgcatgcatgcctgccgcggactggctgctgcctggctgctgcgctgcttgcatgcgtgcggtgtgttggcgccccatctgctacactgggcctgaagaaggaacgaagaggaagctgaatgctgcgcccccctggcccatgccgcagccactgggcccagacccgccacggctgcccgcgccgccagcccatcgccaggaagcaccacagagacctgcatggacgggcatgggcttgagaagcagcaccattccagacgccagccgctgccggccgccgaggttgagcagcgccgccgacccgggcatctgccccccggctgctggagcatgctgctgctgctgatgttcagacatcgggctgatccaacgcaggtgactgccaacagccagcccaatgtcgaatccagaaatgcaccacggacttcgagtcccatgacttctcaacctgaactctgccgttgacgtgctttgactcatgagattatgcatggccttgcagtgctatgatgtgtgaaccagtgaacttcaaaagactgcggtgggcaacctggtataccatacagccgggaggggataagtgacctcatgaccaaaggaatggaccacggatggaccaaagtcatctaccagcccagagtgaacatgaccttgcagcacacagcaagccggccccaggacacagcggagcggggaccggacgtaccaggtaacgaacaggggcaaggacggagaccacaaacaggaatcaggggaactccaccactcacgacagggcgcgcccccatgacagcaaacacgaagacacgcacagaccagcccaggaccagatcgcagagcgagcaataaacacaggcggcgcaaacccggcagaa

SEQ ID NO: 714602 - DNA, 1268 bp, Homo sapiens
cccacgcgtgcgccacgcggtcggtaatgaccgaggttcgcgatccgtccctgacgagcagctgaagcagctaggccgttcctgctccacgttcccggccggactctgccctcgaggtctgggtgcagcggctccaggaggtcgtccctgcgtggcaggtgcatgagtggccgagcccgagggcgtgctggccgtcctctgttgatgcaaggctgacgagagtgaccatccgggaccgtgccgagtcaaacatcgcctggcaagttacctagtatcacgcacgggagccacgctgaggaggctgaggcggtgcgcggacagttgcagggcgcacagcgcgatggagcgcgtcagaggacccaagagctagacgggctcattctcggttgtggcagggatgtgtcttccatgctgcctccgatgcccgagaggcgccggtgtgggccagtgacccctgccctgcgctggcatgacacactcctgctgggtgacaggggacgcaggtagatcccgatcaaccatcacgccgtcacaagacgaatatcgtaccaggtgtccatgcattgccagtattgccttcttgcgtgtcggagcacggaagaagggatggtccatggggctatgatagggacaaacatatcacaggcgagtctgacgacgcatgacgaacaataatcccaagacacatgggtggctggaagttgtgcgtgagaccttcgaacgatgggcatggaccattacagatgaaccatgactggcgaggagagctagactacaatcacaaagaacaaagaagcatatcgcaagaatagcatggcagcaataaccccagcacgtatcctatggcaccgatggggacatatccattgtcgcaaggatgaggactaccaacgccaaacaacaacacaagaacgcacaattatcccacaaaagagccaacaggagatggcacaaaaaaccggaaatacgcccagaatgaaggaaacccgcaacccacaaagcacgtgaaggaccagaaaaatcgcacaagaacaaaaagaaaaccgaagacaagacaccaagggacattgaccacaagagcacacctagggaaggcccagagacagacaaggggaacccacaaggccagccccgagggacaacaagagtgtaaaaccccgcagaaaagacacaaggcacacaagaaggagacaagaacaaaaaaagaaaaaacaagaaagaaccaagaagaaaaacacaaacagaagcaacagcaaagcaagaaaacg

SEQ ID NO: 714603 - DNA, 157 bp, Homo sapiens
tacgacgtatttcagagaggaactggacccaaataaggaaggaggacaaagaggagaaaggactttctgcctcgagaacatcaggtttctgaaagggatgggctactccacgcacgcggcccagcagattctgctcagcaatcctcagatgtggtgg

SEQ ID NO: 714604 - DNA, 828 bp, Homo sapiens
cattccggatgcgcctaaacacgttaatataaacaatggggtctttcaaattaaacttttatggtcctataatacctccttctcaatccttcctaaaatatcccggtccccccctcctttccactgctggcgccttcccaacggcagccccttctcaccgggcatcttctgccacgctcccccccccttttgtagacctcctattgctcccctcaaatctaccggtgattccccccccccctgccttttcttcagaaggaggataatattgggcgcgcataagatgctctcccgagggctccattcacatcgtagtcccagtcaacactccgtggctccaccacaacgacttccccgctttcttttagtccagcgtttcaacaaggcgctcacccctttccactttgaaccacgcgcgcgccgcgtgtcacccaactaccacacgtaggcccctcctctccccacacaatttactcctctctcttgtaatcaaactgttgtcaccctctcacgaacctctcacaagcctgttataactattttcccccccaccgcaacaatgtgtccaccttatccagtcatatgtctggtaagaaccaccttccaatcgcacttgatagatccactctcattcacgcaccctcgcacctatcctgctatgctcccctcttggggcagaactaaagggcaatttttttcatctatgctttatcatccactaaacatcctgtcatttttgtcttccacagcatctatatcaggaccgcatcggaatctcctgagataaaaaataatctctcttcatccaccgctccatcaataacgaaa

SEQ ID NO: 714605 - DNA, 383 bp, Homo sapiens
  misc_feature (1)..(1): n is a, c, g, or t
  misc_feature (28)..(28): n is a, c, g, or t
ncactcttaaaaatggtagtgttttaanggatatatttatcttcttttatcttttctttttttgcttttttctttttgaaatggaatctcactctgtcgcccagactggagtctagtggcatgatcttggttcactgcaacctccacctaccaggttcaagtgattcccatgccttagcctcctgagtagctggaattacaggcatgcaccaccatgcctggctgatttttgtatttttattagagacagggtttcaccatgttggccatgctggtcttgagctcctggcctcaagtcatctgcctccctcagcctcccaaagtgctaggattacaggcatgagccactacacctggcaggatatatcttctttctgaaaact

SEQ ID NO: 714606 - DNA, 307 bp, Homo sapiens
  misc_feature (249)..(249): n is a, c, g, or t
ggcggccatcgacagatgtgtgccaacgatagacgccgacaagcatactgggaatagtagaagcagggtgggctcagtgcaacgctgccacgcggtacaaaggatggatgtactggaagtgccgcaaagcgtggagcgcgcataaccacgagaacgcgctgtaagctttctgccaatatagggacccccgcgggctccctgcgtgcggtggacttgcggcgtcttcatgatgacttacgagacgttctnatggacggcgcacgccggtctaaaacgtctaggcgaatagtatggggcagagtgtgag

SEQ ID NO: 714607 - DNA, 260 bp, Homo sapiens
gaacgagattcccactgtccctacctactatccagctcgcccagctcgcccagcgtccgccgcgcttgggcaaggtttaaacggaccacaccaaattgccatcttaaattggaccaggcaatggaaaccatgatgttacaatttacaaaatttcgttgggatataagggttattacaaatggagggactctgagatactctcgtggaaaggagagttcccttggtttttgagaaatcataaagagaccctcgtctctgtg

SEQ ID NO: 714608 - DNA, 284 bp, Homo sapiens
ttttttttttagcaatgaaaataaaagttttttatcaggcagactccagacgctcaaggcctttcacaacaccccccaatttagcaatagacttcagggaccaaaggaccctttaacagaaatagaacaacaagaaaacaaactcaaagacactcgagggccagggcctcaccacaccaacccccacttccaaacaggcaacctgcaccggaggggagactttttcgccaaagcgacgggccagcacacagaccaacacatcgcccaggaacctgaagttttca

SEQ ID NO: 714609 - DNA, 139 bp, Homo sapiens
ctttaatcccaaccatcgggaggctgaggtgggaggattgcttgagcctgggaggttgaggcttcagatgagtccgtgacttgtgtcactgcgctggagtcttggaaaacagatccatccacgcaatgagtacagatta

SEQ ID NO: 714610 - DNA, 359 bp, Homo sapiens
actgtcttgaattactcacctgctcgttcccagtctgggggtggttttgtgccagtgatgtgacaaggctttctcctttggccaacgagctagtggcatctcaggctgcttctcttcctctgtactcctggtgatacttcgcttgctggagggtctgcactacccatgaactcctggtcagtactgtctgaagctctcctggtcagtgctggcctggttggaccctgtgcggcgcattagcatctgttaagctggactcactttcactggacaatgccatgtaatcttcaaatgagttgtgtttcttcaagatagcagcttcctttctcactttcagagttccaagaagcaggaacggg

SEQ ID NO: 714611 - DNA, 188 bp, Homo sapiens
agaggagtcttaccaatgcatgagcccaacaggacgtatctggtttctaaatactgcattttccattgaaaggaaccaaggctctggagaatgactgaggcagagaaagtactagatgagtctaactaattttcttactgtgcacggcaaaggaagtgctcaacagacataacagctgaaactatcaa

SEQ ID NO: 714612 - DNA, 648 bp, Homo sapiens
cgtaagtaaaatgtttgccgggagaagcggtaagacctaaaatttaaagtaaaccctcgggtcccaaaggtcatagccttcgtcccaattcgaacggtgggtatttcccagcatgtgaatacatcttagaatccgctgtatggcatacgtagcgtaccatatcgacctagggtctcccggtaattcaggcacaaaggttattcttaggcatagtataggacggtgtacgtacgccttgtctatagctcgagatactacacgcgatacatgggaccactatgaatctatgtcggttcataagcagagtggttgaacagtagcagcagatgttgagtcgtagatttgtaggagtttcagtcaagcgcaagtgctgacaaatagacctcagaacacaagtagattcaccatacagatatgtcataagtgcggggcacagtccttaatgtcggatctgcggtgcatgtacagccatgttgatgtgcttcatctgaccactcaggatagcatcttgaattagcataggtcggcttcactaatatgtgcaggcctgcctacacatcgaaaacagtgcgcagggtcgcagggtagcactgggcaaatggcaggcctgttccagtacggttaaagggtgggtaatgcgcattacag

SEQ ID NO: 714613 - DNA, 812 bp, Homo sapiens
  misc_feature (6)..(6): n is a, c, g, or t
  misc_feature (78)..(78): n is a, c, g, or t
  misc_feature (114)..(114): n is a, c, g, or t
  misc_feature (282)..(282): n is a, c, g, or t
  misc_feature (375)..(375): n is a, c, g, or t
  misc_feature (728)..(728): n is a, c, g, or t
tggtanggttggaattctcgggattgcggggagggccatggcggcgaaattgagctggaacggccagcgctgcaagangcgtacgtgcgggtggttaccgagaagttttcgatngattgggctttttttatttatgaaggaaaaagcaatgatatccgcgtggttggcacaggggagggtggcctggaggagatggtggaggagcttaaaagcgggaaggtgatgtacgctttttgcagagtgaaggaccccaactttggattgctcaaatttgttttcatnaaatggaaaggggagggcgtgaacgatgtggggaagggagcttgtgctagctacgttagcaccatggccagctttttgaagggggctcatgtnatcattaaagcacgggctgaggaggatgtggagcttgagtgaataatggagaaggtggcaaaggatttaggtgcaaactaaagattttataaggagagtgggcgcttttaggaagtgggaacacaggctccagtgggctctgtgtaccagaagaccaatgccgtgtctgagattaaaagggttggtaaagacagcttctgggccaaagcagaggtgagtgctgccccggggcatgctgggcacgtgggagtgttctgcttgctgtggctcatctttcctcacaagtgagctcatgcagcatccactctccttggtgcccattacagatggtcacactgaggctcgggtaagtnaagccacaaggtaatgatcgactggctctggtgcccgtctttggccatgtgcctaaaactcagtcctgggcaggggattaggct

SEQ ID NO: 714614 - DNA, 711 bp, Homo sapiens
tccaatgggttagtcggtgccccctcccgggcccttatcaggtcctcttcatggttcttaccgcaggggactcctgtcgtgttcccccacggggcggcccagggcttgtgttgccgccaccctcgctccatggccttggctggcaacccggacccgtgtgcagcttgtgtggtccctcgcgcctcagtccctccaaccagagcgtcttcattcgcccccaacaggggacgctgctcactcccctcaaggtcccccacttttccgcgcggtcaccccctaggcgccataattatcggcccgcagaggcgtgtctatatgtcttcatgtctccgccgtgcttatttcgctaactttttgtaggcaccacagcacaaaaggtttctcgcgatttatccccataggcccgcccacacttactattcagtatctccccggagacattaatctaccccactcgtcaaactctctttctttcatctccctctcggagtacatcacatttctattataccccccagtaatatttcaaagacttgtgttacgcattatgaagatccctctttcctgtgctagaccgaaaaatctcgaaatatgaatagaatagacactcccactcgccacctcctcggtggcgctaccaatactggggtcgccccccccccctcccccccccttcgggaccctaaaaaaaaattttcaacccacataaca

SEQ ID NO: 714615 - DNA, 235 bp, Homo sapiens
  misc_feature (7)..(8): n is a, c, g, or t
  misc_feature (10)..(10): n is a, c, g, or t
  misc_feature (15)..(15): n is a, c, g, or t
  misc_feature (20)..(21): n is a, c, g, or t
  misc_feature (28)..(28): n is a, c, g, or t
  misc_feature (53)..(53): n is a, c, g, or t
  misc_feature (61)..(62): n is a, c, g, or t
  misc_feature (82)..(82): n is a, c, g, or t
  misc_feature (89)..(89): n is a, c, g, or t
  misc_feature (115)..(115): n is a, c, g, or t
  misc_feature (151)..(151): n is a, c, g, or t
  misc_feature (209)..(209): n is a, c, g, or t
  misc_feature (216)..(216): n is a, c, g, or t
  misc_feature (226)..(226): n is a, c, g, or t
tcggcanngnacttntaagnncttaccnatagtacaagtacatgatgctactnaatatttnnccacttggaaactgtgagcnggttgtngcattaaaacacacatacaaacaaantcaaaaacactgcggactttcactcaagctggtctntcttccccagtgtaaggcaatcctgcctactaacaacaccaacaacaaaacattccanctgtgangctgacgganttaaggggg

SEQ ID NO: 714616 - DNA, 101 bp, Homo sapiens
actctgaggatcccgaatccggggatgggatatgtgcagtcatagaaggtcactttatgcagagaatggggccgggccgacccattccgtactactgcact

SEQ ID NO: 714617 - DNA, 452 bp, Homo sapiens
gctgttggtcgtctctagcaggatcccgtcagcaatggtgatgctcaacaccctcctaatgcacaggacaggtccctcaaaagattatccagcccaacaatgccaatataccaggttgagaaagcctgtctttaggagataatgtttctactacgttggagttgtctttatataaatcataatacagaggggcaaaaattaagtttggtaagaatgtttacattgaagaatgccttaaccccttatttcatgttgatcaatcttcaatctagcagaggactcatttattcttacttctccatctatctttactcatagatgatctttatttccattgcataatgacgagattttaattagatcatagatagcgtaaatgtttaagactacatgaataactagcaactcctaatacaccagtccaagttaagtattctccaggtcataaggcc

SEQ ID NO: 714618 - DNA, 586 bp, Homo sapiens
agagagtggtcacgtccgggtcaggagcggaagaattctataaccatcgactaaaaagagaattcaatatgggtccaaatagcgaaacgcacgaacattcttataatgaagcagacccagggacacaccataaaactgacacaaaatcacatcacaacgacattccaccattttcggggggggccgaatacatcccacacccctgaatactcttacacaaccctcaacacagttgggccatcttgtccatagcgcaatccactttcaaataaactcccccaaccaaaacaatctcattccctgctcatacgcaatactccacctaaacaaaaaagccaaccacaaccacccctcccaatctaatctctaaaacgcttgctccctccccaattcaacccccaccattccacaaaaaaaaaaaatccccacacaccaacccccccctctttcaaccaaaacaccccacaacacaataccccctcaaataaaatacccccctacctccccaataataccaaaatccccaaccccccccttttgttaaaaaaaatacacccccaccccaacacttccccccccacattct

SEQ ID NO: 714619 - DNA, 198 bp, Homo sapiens
gaacgagtgcctcgtgtgtgatgtttttctcccgaaaatggctcagattttttgatctctcttggctgtagaaaatatgtttgaggagtggagaaaggcatatattctctcaaaatatgagagtgtgtttttcttgaatcacttaggtaaagcgataaaggatggtttagggcacagggaattttggcccttatcgag

SEQ ID NO: 714620 - DNA, 338 bp, Homo sapiens
ccccccccccaagggcctttgtggggtggcttttccccccccctttgggggggggggggggccccggtgggccccatgtttttttttcccccccccggcccgtcccgggggccaggggggggggggtttttccccgggttttttgggcccccccccccgggggggcttttttttccccccgggggaaaaaaagggggccggggggcccccttttttgggggggtttttttgggtccccccccccccccccccggttttttttttttttttgcggggggggggggggggggcctttccctttttttttttttgcggggggatattggcccccgggggga

SEQ ID NO: 714621 - DNA, 251 bp, Homo sapiens
ctgcacaggtacatactggaggcgtgagcaccgcagtgcacattccccgtgcgtgtgcctttgaggccttcctggccaggtggggccagcacctcggtgcaggactgacaaggaggccaccgtgagtgactggcagccccgggagtccttctgattggagatggagtcactctgcccaggactgagcgtaggacccaaccctccctctctctcctcgtcctctcatcctctctctctctctctttctctct

SEQ ID NO: 714622 - DNA, 611 bp, Homo sapiens
atagcaggtagcgaggccttggggtggcgacgctgtgcggtgggtgtgtgcagtgtgatgatcctccggaatgggaggctggtctctggcccctgaccctgctcctgctgatcgcccactcgggctgcccgtgccgggccttgcagggaatggtgccgcgccgccgcctgcgcgtttgcgatggcctggctggtggcctgctggtggcccaggaatgtgctgtaagtgggccccacctcagactcctgagacgtgcccgagcgggtcgcggctgtgggacggcggcgtgcccttcctttcctccactcaccagtgttctgcgccctgagctctgctagccaccctgtacgacaacttccggactcccagtggacagccctggccatcaatggaagacagcacatggactgggacaccaaccatgaacccttctcaggacaacccaacagcaccagtggggatgttctcctaaggccgcaggagggcctgggcacgccatccgtcctccaggaagagccatggtgttaatgcaggacaagggcagcatctcaccagtggcctggtctggcggggcgagggtggtggaacacggtcccttagcaatgctcgaa

SEQ ID NO: 714623 - DNA, 1233 bp, Homo sapiens
cttagcgtctcccgaagagagaacacagagcgcgacaccctgggatggtcgtcttttcgctgcgacaagaccgatcaattgcgggagagtcgatagagtgctcccatcggcggtggacccacgaacaagggagtgccgcaaaaggaggacgcgctcgcgacaaggagaccttccgcttccggcgatgggctcacaggggcaggaccccccccatggccctatccttgccaatgcgtgcctgatcgggggacgttgccaagggagcgcatccgaacaatggcgattccaatgcacaaacggttgttctgccatgattatccgggcttagcacaggccgaacccccgttgccccgggcaaacagcctacgcccaggctccggactggaccaagggcggtatcggactgtcggatcgagatttgtcggggcacaggcagatgcataccttcctgagtcgccttgcgtactgtgaagtcactctccttacacaactgtcgttgttcgccaccttatcgctacgtggccacacaatcccatgtctgcacaagagaagcatctcgagagatggtagacgtctgtaagaggagaaacacataggcccctgagttacggcagcctcgaggaaggacctgcccatatctggacatggtgagttgcagagacgctgaggaagtacccgccagcttgtcagattcacatcgggagcgcagctcaggactggcgaggtgctcggggcagcgcatgccacgcaggcgctgtgctagagatggccgtgggtgccctgcgatccatgagccactgagcactgggcacaagcccggagaccatgtcaaccacgtggaaaggttcacgggctgaggcccggcagcagcaccggcccatcacgtacctgccctatcggggccggcccaacggagctgcctcggggtgcgtctagggctgcttgaggctcaagtacgacactgctccacgtgctgcacaagtatcgcggtatcccaagcctgccctgagacccaggttaccgcaagcaggtagaatccaaatctggccgctaggtccgaacaaatggtgtctagtatgcaagagtccagtataccgcgctgacacagaaggctgccgggtggcggggagggcaccgccgaaactccaaagagaaccctaagtgtggatgttcagaattgttgggagaatgtcactgaagtgattgaaagattacggccacgagataagaggg

SEQ ID NO: 714624 - DNA, 114 bp, Homo sapiens
tagccggacgcacacttgtcatgcgattgatcttcagtaatggtttggtcctcggcgtgtgctgcacacgccgagtcaccaaaccaccccagatcgcaatggacgaagttgttg

SEQ ID NO: 714625 - DNA, 438 bp, Homo sapiens
  misc_feature (391)..(391): n is a, c, g, or t
tgcagtggctcatgcctataatcccagcactttgggaggccaaggtgggcagatcacctgaggttgggagttcgaggccagcctgaccaacatggagaaaccctgtctctactaaaaatacaaaattagctgggcatggtggcgcatgcctgtgatcccagccactcgggaggctgaggcagaagatggcttgccccagcaggttgaggctgcagtgagccaagatcatgccaccccattccagcctggacaacacagtccctgtctcaaaaaaatcaaaaaagaagaagaagaaaaagtattttaaacctgtcattaagaagaagatgtttacacacttagggaggccagagtgggcagattgcttgatcccaggagtttgccagcctgngtgggccgggcatggtggctcacgcctgtggttctagccttttggtg

SEQ ID NO: 714626 - DNA, 246 bp, Homo sapiens
gcgcgcatgcttcagttgagccaggaagaggggcaagaggtgctcgatggtgtagtctttgcccaagatgggagagagagccatgatgactgaggccaggtcagacttgtacatgttggttgggatcggacaccagctcacttgatgcagggcaagatctgggacatgatctcattctcccgacagtcagctgagaggttttcacagaactctttgaccttgtgggaaggtgatcttctgcacgat

SEQ ID NO: 714627 - DNA, 117 bp, Homo sapiens
  misc_feature (1)..(1): n is a, c, g, or t
ntcctggcactcgtagctttcctggagaaaaccccaacagtagacttattggggcaaaggttatgtgtatcttaaattttaacttaaaactacacctgggttactttataaaaagtc

SEQ ID NO: 714628 - DNA, 232 bp, Homo sapiens
  misc_feature (9)..(9): n is a, c, g, or t
atgtagggnctggcacgccagcccctgacagggtttatggtttgtttctgaccttggagtaatcctggcgcccgaacgggctcacctgatacccctcgacatttttgcgcgtcagcgcaaacgccgtcgggtgcgccagtggcagccacaacgcctgttgctggatctgcgcctgggcctgctggtacagcttgctgcgcacgccttgttcgctggtggtcttgccagcgct

SEQ ID NO: 714629 - DNA, 116 bp, Homo sapiens
gaggatccccctatattgtccctatgcatgctagcacaggcaagtgaagactggacttcccccctcattgggctgtggtgagagcaccccagtatccagctgggataccagagaag

SEQ ID NO: 714630 - DNA, 167 bp, Homo sapiens
  misc_feature (87)..(87): n is a, c, g, or t
ctggtgttagggttctttgtttttgggggttggcagagatgtttttaaggtcttttgccaaaagcgcgggggaggggggggttttgnggaaaatttttgttatatatgtctcttgtgtgagagcgcgctctttcagacatatcaattgttattattatgtcgctcca

SEQ ID NO: 714631 - DNA, 497 bp, Homo sapiens
ggtgatcttgagtatcccggtatccgctacaccaagccgatgttgtaaagagaagtatatatggaaagtgctgagaggaacagggagacatgggtatgacaaacgtaatcgtgaatcaggacctctgaacatctgcatacactttacagtgagagctctccttagagccattacgagaaccagcattgtgttttgtaaccacagcacctttgcctgcaatatacggcaagtgtagatcgagcgtctaatgtgtgccagggcctgtgttaggcactggaggatgcaaggatgaatggaattggccttgtcctcaaggatccctttgtttaatggtggggcattgatgtcataaacgagagagaggccatggtgtacccgtatgctacagtgatgagcaacgtatgaaagctgaacgaagcctgctcctggtacggcacagctttaactattcagccctagagtcaattcattgtcgcattcattcattccataaatat

SEQ ID NO: 714632 - DNA, 510 bp, Homo sapiens
cctggtgtaggctccgtggcaacaatagccaagacatgaatgcaaaggaaaagttcttaaaggacattaatagtgctaactccagtgaacaaacgaatgataagaaaatgaaacagtcttattgcttatatgggtaaatttttatggtctggatagcaggtcaaaccagccacaaaattcccttaagccaaagcctagtgcagagcaattctctgaaggctgagagagatggggaagctgcagaagaaaagtttgaagctagtggaggttggttcttcaagtataaggagataagccatctccataacttgcaagttgaagcagcaagtgctgatgcagaagctgcaacaagttatccagaagatgaaggtggcactgactctcctcttggggaccaatgcagctggtgactttaagttacagtcagtgctcatttatcactctgtaaatcataggaccttaagaattatgctaaatttcctctcctgtgctctctaaatggaacaaaaa

SEQ ID NO: 714633 - DNA, 1005 bp, Homo sapiens
  misc_feature (759)..(759): n is a, c, g, or t
ggacgcgtgggtcagcgcagtagttctccttgtagcctctggtttatcagatccccaaccaggttgacttccctggactccgaaatatagcaggagggttacgatgtccgatgtccgtggaccctgaggactttgtaggccagaatgtgctgatcctgggtcgtgggaactcggcctttgagacaggcagagaaacatcgttgtggtgtcacaaactttatccaatagtgctcagccgcatcccgggctccggtcatgtactagggccacccatatacgttgggaagacgcttcaggatgccaatcaacaattgcgtcatgcttggaataccttaccaagcatcaatgtccctggatcgggcgtgcgtctgatgtcttgaccttgactggattcgtggcacattcgcttgaatggacacgcatatggcaacgtggccatgtcacgccgagaattcttcctggaagaagccagcaccaggccagagtgcctgactccatgcaccctcccccaggacgacaagtggacaactttgcacagtgcgcgtgcccgtatgagcgtggtaagtccgactgcccgtgggctggaagcgtttgacttctcgcatcttcaataagtccctcagacttaactcgggaaaatgcgttcggcaagaagtacccgcgtgattcgaagctagctacgaatccaaaggaagccggggtcggtcatccctgggtactgcagccactcggtgggacttaccgggaatcttgctgggngcttcatccacggattccgatacacagggcgtgctgttcaccggctcctggagcaccggcaacacaaggttaactgggccgcaactgaagttccccatcacaccaggtgaccaacccacaacggcggggccgggacagaaggtcagggcttacagattttggaggggccatgacctctcgaggagaaaacagactgcaggaggaagagaccacgaattgcacacggacccgcgggagagaacatac

SEQ ID NO: 714634 - DNA, 742 bp, Homo sapiens
tgtaatcgtacaaattataacagagcattgcatgtataggtatatatgtatcataagacaggatttaaagtaggatgtgtgtagattacatgcaaaaaccgcgatgttctacaaaagggacatgaccatctgaggattttggtaacattattgggcaatggactaaatacatacgttcatttatttcaaaaatttatacataattactttagggccaagtgcggtagctcatgcctgtaatcccagcactttgagaggccaaggcaggtggatcacttgaggtcaggagtttgagactagcctggccaacatagtaaaaccccatctctacaaataattcaaaaaaattagccaggcttggtggtgtgtgccggttccagctacttgggaggctgaggtgaaaggatcactttaccccgggcagtcaaggctgcagtgagccaagattgtgccactgcactctaacctggcaacagtgcgacaccctgtctcaaaaatacaataataaaaataggctgggtgcagtggctcacacctataattccggcactttgggaagctgaggcaggtggatcacctgaggtcagtagttcgagaccagcctagccaacatggcgaaaactggtctccactaaaaatacaaaaattagctggtgtggtggtggcgcctgtggtccagctattgggaggctgggtggaggatgttgagccataggtgtggtgcatgactggacaggcgtgc

SEQ ID NO: 714635 - DNA, 172 bp, Homo sapiens
agttctgctctgccgttctgctgcttcctgcttcgctccaggattcaggccattctcgtgcctcagcctcctaagtagctgggattacaggcacgcaccaccatgccccgctaatttttatatttttagtacagacaaggttttgccatgcttcctgcttctaccctgtctc

SEQ ID NO: 714636 - DNA, 405 bp, Homo sapiens
  misc_feature (112)..(112): n is a, c, g, or t
  misc_feature (312)..(312): n is a, c, g, or t
  misc_feature (325)..(325): n is a, c, g, or t
  misc_feature (342)..(342): n is a, c, g, or t
  misc_feature (360)..(360): n is a, c, g, or t
caaagacattctatttgaacacttgcaattacctagatctagttggcctttggttgatagatcctctgcctcggaatttcattgagtttttttcttccttgcctttgggtgnctgcttgccacttcctaagaattcttgtagaaggcagtttctctacttgcccaagagcactgagtacttctctactatcctattattagcttctatctcttagtgtaacttcaaaacttttaaagagcagtgaagttggcagggaccatgtggccacttattattacctgcattggtcctggtcatttatttaaggggcnagaactacattgnagtggcttttaccagangacttctactggttcatnaacttccttctaactagactagctttctctccaataggctttctt

SEQ ID NO: 714637 - DNA, 547 bp, Homo sapiens
catcctgcaactgtacactgcctcagcctcccgagtagctgggactactggcacgtgcaccatgcccaggtaattttcgtatttttagtagagatgaggtttcactatattggccaggctggtctcaatctcttgacctcgtgatctgcccacgtcagacccccaaagtgctgggattacaggtctgagccacccacatagttgttttaattgtgatgttagggtgtcgattttagatcttacccgctttctcctgtgggcatttagtgctataaatttccctctaaacactgcttcagctgtgtcccagagattttggtacgttgtgtctttgttctcactgttttcaaagaacttgtgtatttctgccttaatttcattatttacccattagtcattcaggagcaggttgttcagatagaaatgacccctgaaaatatagtctttcctagtttttttaaatgtagtttactggacacattttttcatttttctctgctttttaaattgagaccttcaatttcacccacgggttctccccttaagt

SEQ ID NO: 714638 - DNA, 2273 bp, Homo sapiens
  misc_feature (1030)..(1030): n is a, c, g, or t
ttgtgtgatgtgtgttgtgctgttttgtgagtgtgtgcgttgcgttgtttgttgatggttgctctgtcatttggtgttctcgttcggttgtttgtgtgtgtgtgtgttgttattgctggagttttgtgttcgagtttgttgtgttttatgctgttccgtggtgttgttgatggctttatgttgtcttttcgtggttgttagtctttgtgggtcgtgtgtcgttcgcttcttccttgtattttgttcgtgatgttagttgctcgtacgcttgttgtgttgtgatttgtttgttgttggagttgtagtgttgtgttcgctctgttctagttcgtgatgcgttgtctcgcgttgacttgcctgtgctgatgatcgtatctttgtgttactgtggagtggtgttcttgtccttctgtcgtttttcgtcatgattggtgtcgttgcgtgtttctctatgctttttgcgtatgtgtccttgttacgtttttctgtgtggttctcgtatctactctgtctgtgttgcttagtgtttgttttcgttgcgcttagagttgcgtcatttcgtctgttgctgtgtagtgttgtttgctgtgtcttctcggtgattgcgtactagctgcgcgtggcgttagccgctgtgtgctcgtttgtgttagcgctaggtgtcgccgtctgtggtgttcgctagctgactcctgtgtgtggttcggtgtgttgcgttcgtctagtgtggactctcgttgtagtcgttctcgctgctgcctcggagtggtgttgtgtattgtatgttattgtgttttgtggtgcttttgtgtgtttttgttttttttttctgttatttgtttcttggtttttgtttgtttgtttgtttgttttacgacgacaagaacgaaagagtggaagcaggagagacaacgcaacagaacaaacgaaagagcacgcagacaagagatctattcacacaacaaggatttttgctgttgtttggactatctggtctgtgtcactcagagagtgtgtctctcctctacanagtacgagcgatctctagaaagttacaaccccacttgttgtgttggtcgaatgcaccacagcaacatgtttgttgttaatgtttcccagtggcgagacaacatggtgggttgcttgttctccctcaccggcggggctgtccataacccccacacccgtgtggtgtgaggacccacaataaatttgtgttgtgtcccgcactcactctcgccgtgttgtctgcaaactaagttggtggcgtggggcccctcgcgtgccccactcattggtgttgtaaggagttgttcttgttgtgcggcaccacgcgggtgtgttcgaccagctccttctcttgtggtggtttcgtccacgccggcgcttcccagttggtgttattcttcctcgtccccccccttgtgagggaagtaccctcgcgcgggggtgtgttccaactacggttggtggtctctctccctccgtgtgagtgtatttgttggccctcgctccgtggttggccttgcccctacgtttctgtgtatgggaacccctccgttgtgtggtgtgttactactcccatctcgtgcgctctctcatgtggttgtccgtctgtgccgactcgcccagtgagggtctcttttgtcgatcgatcctgtgtgtccatccaggaggcaactcccttctccgcggctgggcccaccactctgtgtggtgcagttatattccgcctctgtgtgtgcgtgcggtctcgctctctctcttcaccatcccctgctgtgtcactggcccgtgtgtgtgcgcagtctgtgtgtggctggttgtcactccactgcagtgtggtcggtgtgtgtgtcctgtgtggtgtgttcaccccctctcctcgcgtgtggttcgcactgtggtgccccttctctctctgctccctccttgtggggagcacgctgtgtgtttcgtggccgcccacgtacgaggaggcgtggcgtgtgtgtcccccaccgcgtgtggtcgatggggtggggggcggacacacagaaaacaccagcggtggtgtgtgttgtggtcggccaccgtgttgtgtgcgttggtgtgtaggagggtgctggttgttgtgtgttgtctctccctctttttctcaccacgcgagagagaaaagaggagccccctcacagcgccggcccgccacacagttgtgcggtgggagccacccgcggccctcccagtggtgtgtccacccacccaaaattattacccatgggcgccccccccca

SEQ ID NO: 714639 - DNA, 291 bp, Homo sapiens
tatttgacccccatttctcccgtactccacatatcacgcttgtcctgaactatcacggactccaccactactatgtcatcgcacccctattaactccctttaacatattgtaccagacaacacacatggggtcaatatcttagccccaccaccctagaccaacactaataacccctctgtcatacaccgagaaccaccccttcaagttcaaaacacccattaatcccccacctttcgtcccgttccctctcaccccgaacatcacttaccccggcgtttcttcactgtaca

SEQ ID NO: 714640 - DNA, 237 bp, Homo sapiens
cctgcagctagactatagaggtacctcgtaggaggtgttggacaaaatggtaattcagtttttaaatgtttgaggaacccacaccacagcctggcttggctttgctttcagcctctaaactgccacctgccaagacctctaccccagaagacttcatccgaatgaccaacgtgagcctcaccatgaaccagacacagctactgtgccccgagatgccagatgcaaccactgtgcgta

SEQ ID NO: 714641 - DNA, 173 bp, Homo sapiens
acacgcgtctaatgaagcctcaacgggtttaatgggaaattacatggaaacttgtaatccataatatgcttttcatctgacatgcttacacggactccttttcaactgatacggaaacaaacaaagaaaagacaaccaagaaatagatatataacactacagcgggctcccgg

SEQ ID NO: 714642 - DNA, 115 bp, Homo sapiens
caggagatgccaaaatctaatttatctcactgaggtcctctagagaagaaacgcttcatgggaaagatctccctcctttacatgttctcttctccctcctcctccttattctaaa

SEQ ID NO: 714643 - DNA, 896 bp, Homo sapiens
  misc_feature (317)..(317): n is a, c, g, or t
  misc_feature (366)..(366): n is a, c, g, or t
  misc_feature (371)..(371): n is a, c, g, or t
  misc_feature (385)..(385): n is a, c, g, or t
  misc_feature (409)..(409): n is a, c, g, or t
  misc_feature (417)..(417): n is a, c, g, or t
  misc_feature (438)..(439): n is a, c, g, or t
  misc_feature (443)..(443): n is a, c, g, or t
tattcaagcacctttgttgaagctcaaaaaaaattgatgcctcattataaactattagcaatttataggagtatttatgtaactatcttatgcttcaaaaaacaaaagtatttgtgtgcatgtgtatataatatatatatatacatatcatatctatcacacatcacaatttatgtatacctgttgaatgtatttatcatgagattttacaccagacacaaaggcagataaacaggcattccatagcagagctttagatcacttacaaattttttgaataacacaaaatctcattctacctgcagtttaattggaangatgtgtgtgtgagagtatgtatgtgtgtgtgtgtgcgcgcgcacgcangcctngagcagtcagcatngcacctgctatggagaagggtatncctttatnaaaatcttcctcatttggatnngctntcagttggttttcaatttgctcactggccagagacatagatggcagttcttatctgcatcactaatcagctcctggattttttttttttttttccaaacatggggtttgacacacctacggggatttttggtccacaataacgcggagaagtttggttggtaagtatcgcctcaaatataactggactggtatactataggggaaactttccaaacacgcccttagcatttttatactatttaccccattggtcgcttagagtttctttaaaaaatgtttgttggtgaaagacacgagatacccagtattgcttaaggttgaagagaaatgtgtgtccgtgtttggtaagggaccttccaagtttttggttgtaaactcctgggaccagaggttgctgacttttaaaaaaatttattttatattataaggacctatttattactcggaagata

SEQ ID NO: 714644 - DNA, 378 bp, Homo sapiens
  misc_feature (363)..(363): n is a, c, g, or t
  misc_feature (373)..(373): n is a, c, g, or t
ttgggtgttttgcttatttgttttgagatggggtcttgctctgatgcccaggctgcagtacagtggcacaatcacagctcactgtggccttgacccccaaggctcaagacatcctcccatctcagctttctgagtagctgggaccacaggcatgcactaccacagtcaactaatttagtttttgtagagaccaggtctcactatgttgcccaggctggtctcaaactcctgggactaaagggatcctcctgcctcagcctccccaaagtgctgggattccagggagtggggccaccacacccagcctcggggaactctataaatcaacaagacagaaattcagacattttatttcaggttctngcaagtcttnttcat

SEQ ID NO: 714645 - DNA, 176 bp, Homo sapiens
ggaaaagctactactacgaaattcgcggcccgtcgacattagaagtccctaagttgggtattgtgagtccctaaggccgggcgcagtggctcatgcccgtaatcccagcactttgggaggctgaggtgggcggatcacgaggtcaggagtttgagaccaacctggccagcatagca

SEQ ID NO: 714646 - DNA, 248 bp, Homo sapiens
cagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtcttcaaaacaaaacaaacaaacaaaaagattttattaaagatattttgttaactcagta

SEQ ID NO: 714647 - DNA, 295 bp, Homo sapiens
  misc_feature (236)..(236): n is a, c, g, or t
tggagactgagtttcgctttttcacctaggcgggagatcagtgacctgatctcagcttacggcaacctctgccctgggggttcaagtgattctccggcctcagcctctcgagtaacggggattatgggtgcgcgccaccacactgggctaattttggtattattagtagagagggggttccagcatgtgggctaggccggtctctcctgacctcagggtgatcagcccacctgggnctcacaaagtgcggggattacgggcgtgagccaccttgcccagccaacgggggactagg

SEQ ID NO: 714648 - DNA, 344 bp, Homo sapiens
  misc_feature (250)..(250): n is a, c, g, or t
gatgtaggcgtatgggtgttcattggcgataccggcgctgaggccttggctacgacccttttccagcaggcccgcggctagggccgaggaggacggggctaggttcaagagcacgctggcgcacagcgggccggcaacgacagggacttgatagcgttcatggaggacctggagagaatggaaaggggtgccagacagttaagccgaatacatgaccgcgtagcgccggcttgctggcgaagaggtccgntgagacgctaaaagcttcgcgggcaagccctgctcctacaggttaggtggcatttttgagatcccatttccttaactgactggcaccggcgaca

SEQ ID NO: 714649 - DNA, 680 bp, Homo sapiens
cctgaagatgtggcgacgaggctaagagatcgttgtgacataaccactgtcttagtgatgagagtgtgaggagggtaggagatagaaaggtatgggggcaacaaaagctctgggggcccatatgtgacctgggcacgcggacaagatgctatccacgattgtgggacacttggctgagtaaagtcggttgccacgtgaggccagtagctgtgatgaggtaacaatacagtgataagttgacaaatccacattggcagtacatttgggggacctcaaaactcgataggacgcgaactccggcgtcgattgtagccacaattgtggggctttcccagtaactgtggccaagtggccgggaacttagttgtcgggcgtcacggtgcctttaggcaggccaccggcccttctccaaagtcacttgggcggtttccccactcggaagggaaaacaaggggtgtggcaactcccgataaaccaaagtttttaaaaacaccaggaaataagttctctccctatccattgggcgccacgtcccaaactctatgttttgctggaccggccaggagtgggatcccagtgcagttccccttggactcctttgggataaggacccacaaaggaccggaccgtggttcagcgggcggaatcaccgacaccctccctattagggcacgaaatac

SEQ ID NO: 714650 - DNA, 751 bp, Homo sapiens
gctgtccagtgtgagcccgacccgagctccagtagttccgcccgctggtcatcgcgccctttcccctgccggtgtcctgctcgccgtccccgccatgctgtctctagacttttctggacgatgtgcggccggatgaaccaagccggcagctcttattatctcagtctccataatttttgggcaatagtagattgggtctctattcgggcactagttgatctggcaaggggttaagatgggtaataactggaagtgaaagtccgattgtaggtgggtgctcagtggcagcatggaacctgcatttcatagaggagatcttctctttctaacaaatcgagttgaagatcccatacgagtgggagaaatgttgtttcctacggatagcaaggaagagagattcctatagttcaccgagtcttgacaagattcatgaaaagcaaaagtgggcatatcaagtttttgaccaaaggagataataatgcggttgatgaccgaggcctctataaacaaggacaacattggctagagaaaaacagatgttgtggggagagccagggatttgtttccttatattggaattgtgacgatcctcatgaatgactatcctaaatttaagtatgcagttctcttttgctgggtttattcgtgctggttcatcgtgagtaagacctgcgtgctgtctgggaagatgccatagtttcgtactggcggtggagccatactggctggattggcggactggcgaacaccg

SEQ ID NO: 714651 - DNA, 1032 bp, Homo sapiens
  misc_feature (6)..(6): n is a, c, g, or t
  misc_feature (279)..(279): n is a, c, g, or t
  misc_feature (301)..(301): n is a, c, g, or t
  misc_feature (346)..(346): n is a, c, g, or t
  misc_feature (375)..(375): n is a, c, g, or t
  misc_feature (379)..(379): n is a, c, g, or t
  misc_feature (448)..(448): n is a, c, g, or t
  misc_feature (455)..(455): n is a, c, g, or t
  misc_feature (457)..(459): n is a, c, g, or t
  misc_feature (581)..(581): n is a, c, g, or t
  misc_feature (607)..(607): n is a, c, g, or t
  misc_feature (663)..(663): n is a, c, g, or t
  misc_feature (692)..(692): n is a, c, g, or t
  misc_feature (712)..(712): n is a, c, g, or t
  misc_feature (758)..(758): n is a, c, g, or t
  misc_feature (777)..(777): n is a, c, g, or t
  misc_feature (779)..(779): n is a, c, g, or t
  misc_feature (797)..(797): n is a, c, g, or t
  misc_feature (870)..(870): n is a, c, g, or t
  misc_feature (872)..(872): n is a, c, g, or t
  misc_feature (874)..(874): n is a, c, g, or t
  misc_feature (878)..(878): n is a, c, g, or t
  misc_feature (886)..(886): n is a, c, g, or t
  misc_feature (949)..(949): n is a, c, g, or t
  misc_feature (963)..(963): n is a, c, g, or t
  misc_feature (1029)..(1029): n is a, c, g, or t
ccgcanaacttcatactttctcaaaagaattcacatttgctaaataaatttctaccctaaagaattcatagctgaaaaaccacttcaatatatgcacaaaagtgacttttctgctaaaggaaccatagtagaaaataaaaagtcagaaaatactataatcaataaaaaccaatgagtctaataaattacaaatgtcattaaattccattcccataaccattgcaattagcaacttttctatatatatttcaataatgccaacaaaatctgccaaaagtnctcttaagggttgccctgagcnaaaaatggcttctcaccttcagaaaacagcagccctgccacagtncttcatagccaattacgtcattcatcgcnaaanccatcactacttacagccttgggcagccgatggagagctttctggtcacctccgaggttcctccatttnctgaccncnnntctggactcaatggatctctccttccaagagctatctgctctacttgggttcatctgcttacagctccaacagagaacaaatgctcatggtaatagcctggagagacttctagcactaagtnacaagattagaaaagagctgagagtngtgctgcttctccctgccactcagcagtgaggattgatagtcgctttcatcatctnttactgacacagggagggaaatgcaagcnttaatctaggaagaagagtncaagaggcttatagctccacagagggtatttccaatggaataaatnttggttctcagcaagtgtntncagattattgacacagtnagactcatgactagtgcgcaggatgtactgaatgcacctgtctctatagctttgctgcgaaacatatactgcnananaggnagcgtccnagcatggtgcacagagtagagctgctatagtacacacagattcaggggaggcaagagagtcgncaagagaatatatnaaaggagctgatctgcctaagacacattgctctcattctgagatcttcagaagcaaaagcaggtanatc

SEQ ID NO: 714652 - DNA, 237 bp, Homo sapiens
aaagagagagagaccctgtctcttaaaaaagaaaaaaaaaagcaagctgttttctatctatagtggatatacaattatacattcccaccagcaatgtataaaagttcaagtttctccaagtccctggcagcatttagtgttacagtttttttaattttaactatctaacaggtaagtagtgatatctacggtgatttcaatttgcattggcgatgtctaataatgttgacagtgtcc

SEQ ID NO: 714653 - DNA, 92 bp, Homo sapiens
aaaaaaaattttttccccttggggggggggggttttttaaattcctaaaattaaccccccttttttttggtggaaaaataaaagttttttta

SEQ ID NO: 714654 - DNA, 1795 bp, Homo sapiens
cggtctggctggtgtgctggttggttctggtcggcgtgtttgggagtacgcacggttgttggttgcgtgtgtctgtgttcgtgtggcggtgtgtgttgtgctccggtggggtgtctgttggtgttctacttgtgggtgtgtgtggtactctgcttgtggtggttgtggccccatgttgtgtggtctcgtcatgtcctcggttggtgtgctcgccccgcggtcgggtaatgttgggcgggtgcctgttgcttgtgttggttgtggtggtgaacataagagatggtggttgtcagcggggttctcttccctcccgttgtgtgtggttgcttgtgtgttgctttctcaagggatggggcaactgtgttgtctatgcgcctttggggtgggtctctttctccgttgatgtttcctattgttgggccgtgtcttggtgggtatgcaccgcgtggcctttggggcacgcccactggtggacaaggtgttcaaggggtgtttttcgcccagtcctcctggtggggctttcgtgttcgtctcttgggtctagttttccctgggagggcgttcctgcccccgagatggttgtgtgctcctctaaatcgtgtgctgttataagtgtttgttgccagaggggggtagtcgattgtcctgctccaggagtttgtgtaattcaatatggggaagtggttctccactagtgagcaaccagccatgtgtgcccacaagggggtgttgtgcgtctgttgtattatagaataggtagggtaggatagtagtgtagttcgtatcaccaccaggggggatggggaagttctcccgtgagagaggttgatgtgttgccgcagtgcggtcccagggacttcgcccccccgtatttctacagggggggggggtaaccaacagctcagtttgtggtgtgtggggctactaatatggcactaggctgcggacatgctgctgctagactcaagcaccctatgtgttgtgctttgatgcagagggtaccccacgtgtggggggggttggggaccacccctctctgcgtagcgcccccgccgagatttatggctccctgtgatggtatcgtccccagcgtgctgggcctaaggggtggtttgccgcgcccacgcccacgtgtgccgtggtggcgcacccccgctggcggtcccagagttcctcggtcgttatagcgagggtctcacacacgagggcgccccccctgggcgctcgcacacacaggggagagagcctgtggggcgccaccgccgctggtgttctgtctcgctctgcgcgcatcgagaggagctatttgcgcttctcaccacacacaaagtgggttcaccccgtggctccagcagtgtgccacactcgctcgtctaacacccacacggcttctgtcacacttgcgtggacaacaaacacgcgggagcgtgtcttcgtagctggggccctcgggttgggataccgcggcgaatcccctgcgtggaagaaccccgcgtgacgatggaccatcctgccacgcgatgaggggatccccgttttcacagcaataccgctgcatgtgcgtcaattgtttgcagtttgcttccatttcacaatgatcgatcacgtgacctggggggaaggggaaggacgcacccccgtcagccccccctgaacactgcacccaaatgccctgtgcttttgctcccccctttgttatgtaagccaatgctgtataatgagcaccaaaatccaccctgcacccacctaaggcaaagccccttctaccacccaaacaaaaattactaaaataaac

SEQ ID NO: 714655 - DNA, 943 bp, Homo sapiens
ggcagacactgaccattcagacgcctcggatccagctgccatggctgccctccatgtgaagttcttctgttgtgtgtgtgaaacttgtgaagatgaactgtgtgctgtgacagcagagtcatgggggagctcatctgtgcactctgaactgctggccaaggttgcctggactgaaacacgcaggttggaatacgatgacatacaccccatcacatgccatatactcgagcatatcgacacacgggacagaaaagctacataatccacaatgatatggcatgtgagacttgacgacagacaaacatggcataccaaactgtgtacaaaaaatggagggccaaacgacagccatgagcgagaaagacatcaacgccaccatggccaactggacagcaaaagaggacactgcaaggaagcacaaacgagtgagcgatgagatcacaatggagaagaaaacatcaaagacgcacagcaccagagacaagttgctacatcagggagagaaagcaacaacagaacttggcaaggccgtggacctctcgggacgcacacaggacaaccaggacgaggcaccccagtacgacatccattgcgacaaaaacacaggggcaacttcacgccacaaaaaaacactcaagacccatgaacactacgcggtggacagcacactccgacacacaacactgaacaacgggggaacacagaactgggcacgagctcacacccgtcgcacagaaacagggtatcgtgatacacaccagaccgcaggcacaccaaaagggatcacgtacgcaccggcagtacaaccgatgaccccgcggcaccgttggaacgcaaccaggcgcaccagcccacatggcgccctacctaacggccacagatgaatgagacgccaaatcggggagaacctgtgagccgacatgaaatggcacacggagacccc

SEQ ID NO: 714656 - DNA, 345 bp, Homo sapiens
gtcgacgaaaaggaatatcacagagcagacagccctgcctctttctagaggtcagagtcagaaagtaaaaggccaggcacagtggctcgtatctgtaatcccagcactttgggaggccgaggctggtggatcacctgaggtcaggagttcgagaccaacctggccaacatggcgaaacctcatctctgctaaaattacaaaaattagccgggcgtggtggtgcgcacctgtagtcccagctacttgggaagttgaggcaggagaattgcttgaacctgggaggcggaggttgcagtgagctgagatcacgccaccgcactccagcctgggcgacagagcgagact

SEQ ID NO: 714657 - DNA, 190 bp, Homo sapiens
caattttctcggtattatgcctattgtctaatatcgaagaggaatgatacgcatatgaatggactcggtggtatgtctatacagtctatacctagatcactcacttcgcatctatttctctcggatattatgacactatatgtcctaatatcagaagagaatgatgcgcattgaatggatctcggtggat

SEQ ID NO: 714658 - DNA, 446 bp, Homo sapiens
  misc_feature (254)..(254): n is a, c, g, or t
aaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttttaggctcaggagaagctctacaaggaatatctgcagatggcccagaatggaagcttccagtnagggggcacaggcctcacttttttaaccattgtggactagtggctgctgaaaaaaacagtgaccatgttctaacaaaacatatcatgtttacaataaaccttgggtcctaaattaagagttgtgttcatgtaggttcgtgtcgtcgttggctctgagacattgataataaatttttctcaacagtgaaaaaa

SEQ ID NO: 714659 - DNA, 1130 bp, Homo sapiens
tagccggttgtggtggtgcacgcctgtagttgcagctatttaggaggctgaggcaggaggatcactggaacccgagaggcagaagttgcagtgagctgagattgtgccacggcactccagcttgggcaacagagccagacgtccatcttaaaaaaaacaaaaacaaaaaggagggacaagaggccaccagaaagctccttgttccaggtctgggcctcccctcgggtcacctcagttctcccccattcattccattcatttcacctcacttcacttccacctcacctcatttcccacactctcttgcagccccttgacttctcagctaagccattgcctggactcgctaacgacattacgacgctcccccggccactcaagggccagttcccactctccgaggtggcctctctcagaactttggcacccgggagtatgcacccccggggagccccctctaaaggcgcccccgccacgacaggccaccaccccctgcgcctcctctgtatcccctctttcctggggcgcctgcccttcgcaccggcagcgggcccccccgcgcctgctgtgccccccttgccacgcgccctcggggctcacccggcgcgcccttggcgccaggggccctctccagcgcgcgcccattcccccagggggcgccccgcgcccaccaccacacgctcgccagggcccctcctggcccgggcgccccacaccccctcaccgggcggcagcagcccaaccgtggcgccgtgcgccagcgcgtcgtgccccctgtgcggcacctctggcccagggggcttgtgttgggcccccggcgcgtcgtcacactgcccccccccgcgcctctcctcttccacggcgcggcgccaccccacgccccccgtgcggggcaacaccacacccgcgcacctcctctccaggccgcggcccccacctctcgccgcctctcttgcttggcgggccccccccgtggcaccccatgtcgtcaccgttgtgccttcccccaagtctttggcgccccccccctcttctgggcgtgcccctcaccacgccggtgtgacgcgcccttccccgcgcccccgtggtacctctctcacctgtggcgccacccccctgtcccgccgcgc

SEQ ID NO: 714660 - DNA, 290 bp, Homo sapiens
gtttacatcacaccacaagagggatgtaccatatatggtatgagagatactggtgtaatgataagagaatataaaatgatagaattgaagtcatggtcccacacctgcataaaagtaaattccagtattaaatgttaaaaacgagagagcgagagaaaaaaattagatgtatgtgtgttttacgtccttgagaatgaatgtcttctaaaatcaaaattatcaaacagaagagcttataaaaaggaataaacctaacgtacctaaaatgtaatttctagtgcccatttcaa

SEQ ID NO: 714661 - DNA, 129 bp, Homo sapiens
catcctctcccagtcgagcaatcacctgtgcctcccctccccctttttttgcccctgtgtggttggtcaaggagggatgtgaagggaaatagggaccccccgagcttgtccctcctgcctcagtctttc

SEQ ID NO: 714662 - DNA, 1374 bp, Homo sapiens
  misc_feature (546)..(546): n is a, c, g, or t
gggactgttctatgcatctggactggaccagattaagttcacgcagagtgctctgtagtgcatgagtgtggaggtagagacggtctgcttgtcccttcttgcgtgctggaggtcagcgaggatacagatattgccctcgctgcctccgggatcgggaaaagcttgcattgacatgtgacgatctctgtcgagtcactagtcgagatgatacgatactcgaatggtcgaatagcctagggcatcatggatgctcctgggatcccacgctgctctgggctattggagcacatggttatctagactacgctcctaggactgcctgtgacaacatctccggacggtggggctccgcaggcctgttgctagcgatggatgggtgggctacgactcgcctgacttgctcctagttgcaggttgggcgcgcatcgtggcaggcatcacatgacgggggccttagccttggtggggctcgcttcgtggaagggcaacctagggcttatccagaaggccacaggcgatgcacaaatcttagtcgggagtccactntctcgattcagtcccgctactgaaggttgtcatggagcccaaagtcaagctgtctgatgaatccggtcgaagtcacgtgtacgcaatgggaaacaaaagctttgagacgattttgccttgttgccagggcaagagagggatgctattaatttttccaagaaggaagggtggccgcgcaagcaaccgcacgtctctcacgggctttggaacgatggtgggggcatgcctggtcgcgtgtcggtggccaagaggacgcgatcaagtctcgcctgaaatggggccgtggggggtgttcgaaaggtaatccagttcacccacctccgacggatgaacgacgttccttgtaacggaacgttgtgcacgggaacccttggatcattccagaagtagagggcgggcagccccggggtgctgttacatggctcgcaccgccctcccattgaatgtacgcgtcatggcaaatcataactgtgcttagactattccctgtttggcgacccgtgtagtacttgacccaacagggaattgtccgagcaatgtcaacggccgcccattctgcagaaaaatggttccccggcaacttccgtgacttgggaagggagtagacccgaggggacatattggcttgtctgaaaaaggcaaggcgaccgacacggacagtttccgcgagcggtgcacctctatgcggtctgcccctttctctagggctcagcaaccatgttggtgtgcccaagactttgggaaggcgggcgaccccaccgtggcaggacaagctcaacagggccacgacagttttgggaaaaaagcgccggggtggcaaaaacgccg

SEQ ID NO: 714663 - DNA, 923 bp, Homo sapiens
gccgggaggacgcagctcccaccaagccagctcccccagccccaccgccaccgcaaaactgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccgggctgcccttgcccgtgcccttctgcgtgaggtgatcaagtgctcgccgcatgtccgcggacccctcagccttctcctacgctccatctggtcacccactgacccctggggctccatgtagagctgcccgtgccgtcctgtctggcacgcatcatctccgagacctggcttccctcatctcctctggcaagcaccccagctgtgctctgagaggcaagatagggttgcatctcccaaggaatgtctggtccaggctccacgttcccgtactcagagcatgccaaggaccccggtgggccctgtcaccatggtggctgccctgcccatggaccccataaagctggcatcgcttcagcggagtgaagcatggagcagttgtcccacggggacaggtgggctaccggagagtctgtggggtgccacatgccaggagggtctgtgttgagaggaaaaggtctgggatcaggttcagggggaaggatacggaaaggtgttccaagtacaaggttgcctcggatagggcatactatcggggtcttttacccagggaagcacgtgaagtctggcaggggcagtaacagggtatgagaggaagacacgtgttgacgggcggaagaagtgcgaggcatttatatggaaagcagttgtaagagagggggttttacttgcatgtgaggtatgttacctctgaagagcaga

SEQ ID NO: 714664 - DNA, 456 bp, Homo sapiens
cctaggactagcaacatagtgtatggaagagagcatagacaactgcaagttcagatattaatctgtatcacaaggttattcgattgggtcatagctatagggagtaagagatccccccccacctcagcgctccatccacacacatcaggtgccccccccacacccttacatccatctgcccactcagcacagtcaagtcggggtagatacagcgttatggagaacacacacccaaagcaggagataaaaaggccagggttatgaccatagtttactaggctaatcttttttacatttcctaggtattaatgctcacacctccttatagcctaggaagaaagtgaatgcaggaggccttcttttcatagcctttgtagtattgtctaccttcctttcccttcctccacacctttcctactactccgcagcccccccccccccccgcacccccccccc

SEQ ID NO: 714665 - DNA, 1002 bp, Homo sapiens
gaagggacccttacccccggctcttctcctgacctgccaataaaaatttatggtccaagtgaaaaaaaaaaaaaaaaaaaaaaaaaaaacatttggggccgcctggccggaaaaatttttaaaaccttggctggggcgccgcgggccccgtgatagctaatgtcgacactgggtcgcataagccgtgtttccatagaagagacaacccgtggccacgcaacccgatggctcggctctctccccccaatataaaagagcgccgggggggggtaacccggcaggcgtgtctggaacaaactcccaagaaggatgctgggaagcgacacatacggcgatctttacaacacgcggtggtcacacggacagttcaaaatatgaaaattacccccgcgtcgggtgcgtattattgatccggactactatataaggtggcctagtgcatcaaaatggtccccaaatgcaaggcatacgcgacacagcgacacactggcgtacgacgcctgctgggaccatccattagtaacccaagtcctgaccagaaccctcgttcgagagggaacgcagcgaagcaaaccctaatcagtacagggcaccctgtacgggagcaagccatgcaagccaacatcatgcttcaaacgaccaccacgcacgcccttcattcacatcaaatgcagcagagctgtgataactcaggacgcacaaaaacaccaaatagaccaaccgcgcacctctagccacgcaccaacgcaccgccagtaggcagtgccagccaaaactaccgcccgccaaaaaggtcatcaccgctcactagaatccggcgcaccgtccacaccgggcatcaagggacagcacaacagcgaaccaccgccacggccacgagcgcgcccacgacccacccccgcgccaaccccacacgacaggagcggaacacacacaacacgcaacaacacagcacacccaccacacaccccacaacaagcaccacacaccccgcccaccaac

SEQ ID NO: 714666 - DNA, 235 bp, Homo sapiens
agagttcccaagcttacgaggatcatgccactccttacaggtctgcaaagtttctgctgaaatgtttcagttgatagccttttgggtatttccttgtgtatgattctttgtttttctcatgcttcctttaggattctctctttaacttttgccatttaattgtgatatgtcttggtataggtatgtttgggttcatcttgtttgggacccctcgtaagcttgggatcctctgatc

SEQ ID NO: 714667 - DNA, 344 bp, Homo sapiens
  misc_feature (69)..(69): n is a, c, g, or t
  misc_feature (116)..(116): n is a, c, g, or t
  misc_feature (119)..(119): n is a, c, g, or t
  misc_feature (151)..(151): n is a, c, g, or t
  misc_feature (156)..(156): n is a, c, g, or t
  misc_feature (183)..(183): n is a, c, g, or t
  misc_feature (190)..(190): n is a, c, g, or t
  misc_feature (195)..(195): n is a, c, g, or t
  misc_feature (199)..(199): n is a, c, g, or t
caataaagccctacccagtgaactttggggatttttgagatcagggtcctaccaagaccccagcccaantcaagttacagcagcagcatttcccaagcctgttgaccccagtcacntcncccatcagcacatggaaggcccctggtatggnccctnaaaggaagggctggtcctgcccctttnagggggngcaancatnattgggccctaaaacccaaaggctgtgtaaaggctcctgctccccctcccatttttgtaaaaaatggggttgctccagtgttggagtaggggcaaagggagggacccaaggtccctccaataaaacaagctcatggcaaaaccca

SEQ ID NO: 714668 - DNA, 961 bp, Homo sapiens
tcttcaacttgggatattttatggaaaaaagtacacaaaaaccactgaggtacacaagcccaggtaagcttaccaagcaagccccctcacaccttttggtctgaaaaaagcttgacttcttggcagcaattgtctcgcccatctccagcagcagtactcctcagtataactgggtccctttccctccaggctcaaaacaaaatcaaactctcccggggtcaggggctggatggataatctcgtggcgagtgaagagacaccatatttttaagggggcccaccagtagcttggtgacgcttgatgataggattggacgctcagccagggggaatgaacacgtttcatcatccgaacaaactgtacttccaccatgggacccacttagggttgctcctcttggctacacagtgggtcataaggggggcactggttttccctcaaaacgtgtgttgtgcgctcggggtaacgccctcttccacgactcttcctgagtcctgacgaatgccgtggctctttgccgttgctacggggtacccaaacagagagccttctttctcccccagacttcagaggggcctctaaagggaacgttcccaagccgtggtataagtctacgaaacaaccattcccaagctatgtgtgccttgtatggggcctagacgcattgagagaacccctccaattgcttgaaacatctgccccatttcttaccacccgttttctctctagaggcgggacccctcctggggccttcctgaaagtttcagctcacggcccacagaggggcttggcttttcagcaattccttttgccacaccaggttttataggtgacgcttcgaaggtcttactcgaaagggggtctggaggccccccactttgatgcgtaaatggcctcaccccgtgatggtccaggtatgggggccgttccccgaaatataccccctggtatggcagacca

SEQ ID NO: 714669 - DNA, 330 bp, Homo sapiens
gtttccatttatcccctcatgaaaacaacaatttggaaaaccattcaaggccaggtgtggtggctcacgcctataatcccagcactttgggaggctgaggcagcagatcacttgaggtcaggagttcaagaccagcctggccaacatggtgaaaccccatctccactaaaaatacaaaacttagccaggcatggtggtgcccacctgtaatcccagctactttggaggctgaggcaggagaatcacttgaacctgggaggtggaaattgcagtgagccaagatcgtgccactgtactccaacctaggtgacagagcaagactccttctca

SEQ ID NO: 714670 - DNA, 842 bp, Homo sapiens
  misc_feature (248)..(248): n is a, c, g, or t
  misc_feature (252)..(252): n is a, c, g, or t
  misc_feature (598)..(598): n is a, c, g, or t
  misc_feature (601)..(602): n is a, c, g, or t
  misc_feature (698)..(698): n is a, c, g, or t
  misc_feature (709)..(709): n is a, c, g, or t
  misc_feature (716)..(716): n is a, c, g, or t
  misc_feature (728)..(728): n is a, c, g, or t
  misc_feature (735)..(735): n is a, c, g, or t
  misc_feature (738)..(738): n is a, c, g, or t
  misc_feature (745)..(745): n is a, c, g, or t
  misc_feature (749)..(749): n is a, c, g, or t
ttttgaatattaaatgagatagccattaatagattaatgtataagtgtctgaaatgtattagcacttaacaaacattaatgctctctcttccatctaatcacatgcacacatgcccacgcacacacacacacacatacacacacacacaagtggctttaatcagtaacagaaagtgaaatgttgatgaatcctagttttttttaattgcaaagtgtgtgaaagccaagcatacttgcagaaactgganattntttttatttactcagagacaatactgactttaaagaaaacaaaatatctaaactaacaatggaagcataaacatcgccctcaatgatggtcattgtggtgtccctgtcttcagacagtggccacctctgtgctttaacctggaccaaagcctctgaattctgccgcccttaatggtgacaggcacctgcaggatagcctaagtccccaacaccagcatggcctccaggttttggcgacaagattcctctcatcagcatgtctgcaacgctcctttctcttaggagatatgttgactcattatacctattttaataaaaaggcaaatttaagccttaatttgtattntannataaattattttaaggcatggacccactagggaattagttacaaatggtttttagtggtacacatttaatgaacatttaaccaaagaaagaaaatngctggtatgcntaattcntttttttaaccngctggtnttnaatccantcgnccttctctttaacacttggcttaaaccctttttcggggtgggcactcccggggtcccttggttaacaggttgccctcttttcttcccaggggt

SEQ ID NO: 714671 - DNA, 134 bp, Homo sapiens
gaggcaggttcgtcctcaaggcattgttctcagccaaaagccttccacttgtcctgtgcatctgcactctggatggatacctgatcttgtagggcccgcaaagctgctgcatgttccaggcgctccccctgccg

SEQ ID NO: 714672 - DNA, 181 bp, Homo sapiens
  misc_feature (114)..(114): n is a, c, g, or t
gggctggggaacccccttattcctggcttacttactgcagaacgggaaggaaatgcttgtagatcgctataggagcctctgcaataggctgtcccggagttaacccggtacccncctttgcacagtatgcacggaaacaagaccttgaagggggataaggacttaggcccagtactaccgc

SEQ ID NO: 714673 - DNA, 662 bp, Homo sapiens
cacgcgtcgtctagatcgcgagccggccgcctttggggtttttttcaccttttattatgattttattatatactctctttaactagaatttggcaaggtaaaatatggaactaagacccaacttatatttttcctaagttcctaccccataggaccaggtctattattgaacaattggcttgatgcacaattaatccgtgactcaataaaatactttacacaagactaaggcagtgtttagtggtattcctataaaactataaaaaattaagattcccacagatggaccctcccccccttagactatcatatacaactgggggactctactgggtacagactgacaacaaaatgggtcaaaacactagtatactacacacacatatacgtgctagacacagtgcgcgaggttcgacagtataatactatatgtaggcaccaatgggagggtacaaggggatgacggatatgacatactcacctattttggggaaaacaaacaacaggtgtgggcaatcatccaattttacaatgtggtgatacaatatacacacaaacctcctcttgccaaaccctcttgtgaggtctcgatgggccacagtccaacctttccccgtggaaacaagcaacgtgggtcactagggggcaacacatgttgagac

SEQ ID NO: 714674 - DNA, 126 bp, Homo sapiens
  misc_feature (1)..(1): n is a, c, g, or t
natactgttggttctaaactaaaccatctgcagatgcaaccattgtttctgctaaatccaatacatccgccccaacatattgacactagcagcagcagcaggcaaacaaatagtcagcacgcaggg

SEQ ID NO: 714675 - DNA, 192 bp, Homo sapiens
tttttttcccgggggggggggggggaccccccctccccgggatatttttttggggaaccccgaaaagaaacccccccccttttttaatttgggtttttaaaaaaaaaaaacttttttggagcccccccgggggggttttcccggggggtgcccccttttaaaaagggaaaaaaaaaaaaaattttttgggga

SEQ ID NO: 714676 - DNA, 366 bp, Homo sapiens
ttacgaagtgaataaggctgtcatagtctcagagccctccagaattggatgtattttggagattattaatttcagttctccctaattaccctgataaagaaatggaggtttaggtaagttaagtgatggcatgttttgtgtcctttataatcttttgagtcaataataaggtgattacaacacacaaatgaacattattaggcaattaaatattattaggtaattgaagctttattaataaattttacttaaaatcaatgctttgttctacttaacacagtttttccttacttaagtatgcctgtttttcctttgtctgcaaactcaacaaatctggtttagacaatagattcttacacacaaaaa

SEQ ID NO: 714677 - DNA, 821 bp, Homo sapiens
  misc_feature (629)..(629): n is a, c, g, or t
tccttggttttccccccgcgttcacaggcgcaggttttcccctttcgatcttgacacaccacagtgtgttggcgttctctcgcgtcatcccccgtggggcccctactccccgttgtggccccaaatcgggaaaactttatttgggggggccactcagggaggtcccccaccatgcgggggatctccacttttggctccccacccaacgctgctgttccccgcgtgttccccccttctctctcataggggtgtggtccgctccaccccactgtctcggtgattgcttaatagagacattccgcaaaaacagataccctcgggttgtcaacaagatcatgaccacggcggtgaacacccccggatacagtgtgtacaacgtgacagggagtcgcacaactcacaaagtgagaagaacactgcaggggggtaagcctctacaccccccgagagccaggcccccccccccccagagaccgactttgtagaagctggggtcctaccgccacagacaaaagtccccccatgggagcgaactcagtcgtcgcctcacccgcggcagtaccccacaacatctggtggcgtcatgtgcaaaaacgtgacctgacccacagcggacgacagcttcttcntctccccgccggagaaaacgggtgtccccccccaaccccgcccagcacaaagcaggagacacctcaaatccaggcgggcccaccagccgaggagccgggcagccaacagcggcacgaccgcggtcagacagacgatccagacgacgtcctgtgacccgcgtaaaacaatttgacccggcccccacaagcaca

SEQ ID NO: 714678 - DNA, 755 bp, Homo sapiens
  misc_feature (279)..(279): n is a, c, g, or t
  misc_feature (303)..(303): n is a, c, g, or t
  misc_feature (306)..(306): n is a, c, g, or t
  misc_feature (332)..(332): n is a, c, g, or t
  misc_feature (335)..(335): n is a, c, g, or t
  misc_feature (370)..(370): n is a, c, g, or t
  misc_feature (421)..(421): n is a, c, g, or t
  misc_feature (449)..(450): n is a, c, g, or t
  misc_feature (460)..(460): n is a, c, g, or t
  misc_feature (472)..(472): n is a, c, g, or t
  misc_feature (476)..(476): n is a, c, g, or t
  misc_feature (515)..(515): n is a, c, g, or t
  misc_feature (521)..(521): n is a, c, g, or t
  misc_feature (528)..(528): n is a, c, g, or t
cacctggtattatttttcttactggaaaagttagtattaaaatctacagaactacatattgtgcctccttggtaaatacaacacatctaattaaatgtagacagatatttcaaacatcagctgaattcacttaagtttttccaaaacctcagttaaactgtgaagctatggaatttttttttcctggaatttttcccctttgattcacagtggtcccatttatatctgcttctagcttagtgctatgtgtgagatatgtgtgtgtcgggtttgtttttngttttttttttttaaaggttggcnaanttaaaaggggccagaaaaattgggcnccnggcaaacgaataaagataggatggggaaagaagtngctaagtgtgcttagtttaataagtaattccttctctttttcagagaaggncttacagaaaatggtggtgcttagaatnngggatgcatntttaccctccanaaanctaaaaattgtgtgacccctttcatttacctgaaaagtngagaantggttcngataggataaggagggaggtggccgaatgaaatgtaattttttacctaatataattaattgagggaagatacgactcagattatcaggcttgaatccctgtgtgcggtaagttgatccacctggggaggggttccataattttgaacaaagaaaaaaaaaattgtgggggcaaaataaagtggggggaaagaaggaaggttaagaaaggtgcaaagggggacagagt

SEQ ID NO: 714679 - DNA, 124 bp, Homo sapiens
gataatcagacagcagtgggcaagattacacttgcaagacgtctggaatgaggaggcttttatcctcatggtcctgtaacttcactatttgaaaagctaagtgtgagggacctagagttggaat

SEQ ID NO: 714680 - DNA, 210 bp, Homo sapiens
caacgccgatgggtccttgtccctaacgccattactccattctttgtgtagtttttagattccagagctggcatcaattttggcatttgactagctctgctatttttcaagcccacctcaggatgtattcatgctcttgttaaataaaatatagtttagtagaataggaaaatattttctgtaaaaatatcactccacccatcgcgtgtg

SEQ ID NO: 714681 - DNA, 321 bp, Homo sapiens
ctggccagccctttacatagccccagtgaaaccaatgccggaatctgacacggtcattacccaaataaaaacctaaagtcccgcaaagccttctgacaactctccaagcccatgccgtcgcgaggacacagaccacaccagccatcccttcgcccccacccacgagccaacccaccgcgaccacatcttgccctccagcaccatgcaccgcattctgtaccatccccccaaaagcctcgatcaaattacgagttttaatactcaaagtcatttatatcgtgtccctaaagcatatacaacaaatgtacgtatcactcagga

SEQ ID NO: 714682 - DNA, 609 bp, Homo sapiens
gtagaaattgaacctggccgccatagatatagtccccccagggaagatggaaaattatgaacccagcattatatagccaggctaacccctataccttcgggcataatgagattgaactagagaataactttgcacaggagagcccaagcttagacccccgaacccgacgagctacctaagacagcttaaagagcacacccgtctatgtagccaaatagtgggaagatttataggtagaggcgaccaaacctaccgagcctggtgatagctggttgtcccagatagaatcttagttccactttaaatttgccccccagaaccctctaaatccccttgtaaatttaactgttagtcccaagaggaacagctctttggacaactaggaaaaaaccttgtagagagagtataaaaatttgacacccctagtaggccttaaagccgccccccattaagaaagcgttcaagctcaacactcactacctgtaaaaatccccaacatataactggactcctcacaccccattggacccatctatcaccctatagaagaactaatgttagtataagtaacatgaaaacattttcctccgcataagcctgcgtcagata

SEQ ID NO: 714683 - DNA, 263 bp, Homo sapiens
gacctacttacggaactagaaaatataaggaggagcaagaaaaactagaacattcatttgcagagatgccaactgaactaggggcagtaaaaaccagaatgaataatgcagaagaacgaatcagtgatatggaagatagactaatggaaatcactcaatccggtcaacagacagaaaaccgaatcaaaaaaactggcaaagcaatatcaagagacctcatggagatcaatcataacagcaggcctaatctcacgctataatca

SEQ ID NO: 714684 - DNA, 111 bp, Homo sapiens
cttcacgcaggctcagccactccaatctagtgcatttaggacgacaccttacactggactcagctgtttaatcttggatgccctcgacccatctagaagtcggtgcggggt

SEQ ID NO: 714685 - DNA, 1841 bp, Homo sapiens
  misc_feature (1210)..(1210): n is a, c, g, or t
ggcgccggggcggcgcgggtgggctgtgtgactagtgagtcgatgttagtgtgtctgtttggtttgggatgtggtgccgtgtcgtctgtcgtgctatacgtgctgggcgtgtggcttgctcttctgttgttcgtggttcgatcggatcgtctgtcgctgcttgctgtctgtctcttgggtctgtcgagtgtgcggcgtgtttgcttgtaccgaccgcgggtggggccctgttgctctgggggtcccacggtgggtgccacacggcgcggtttttgctcgccgccccgttgtatgtcgtcggtttcttatgtttatgtagactccctctgtgggctgccgatttttgccgcacacgaggggttctgcttgtgggcgcgggttggttgggtgtagttgcagctttctgtacagatctcgcgtggtttttttctctgcgggatatccgtagattgcgggtctcgctgctggtctctgagaatagttggggccctactaataatcttgttggagtccgtttgggtgttaaatatagattaatcttgggtcgccggcatgacgacaaggcaaaacactgtgcctccggtaaaaggtgctaaccccccggtggggggtaaagagcaccccgccccggaccaagagaccaagtgctgtggggctcaccgatataatggctcccgctgcccccgtggtttatttgccggcgctcgctcctcgttgttgtatcccccgcgcccgggggggttgtaaatagtatggtccctgtctactttctcggtctttttaacacagtggcctctccggggggatgcgtcgctgtggggcgcccttttttctgaggagggaattttttttgcgtcctggtttagtgtccaacagaaaaatggttcttgtgcgcactgagagtcctgtgcgtgtactacttctcccggcagtgtagttgtccatcgtggccacacctctgttccacacgaagaggctttttgcgttgtaacgcgcggatgtatttttcgctcgcccccaccgcggatgatgtttttctccactagatgcgtcggagcgcctccttcggagtggggttttgtttcacgaggcgggcgcccccgggccccatcatctcggcgggtgtgtcggctctggcatcacagcggagtgggggtcttatttgttccggatatagaggcggttaacacccctcggcgtgtgggtggtntctctttttttccgaagaaggagttaaccccaacaccctcgtgggtggggcacacatggccacacgcgctattatagagagagaggttcacacccactggcacatggggcccccacacaagagacactctccacgctttggggctctcccccggcgaagtatccgcggggagagatagagagagaggctttatatagtgaaagggcccacgttttttattgggccgtttttggtatggtaaatgttctggtataaatatactgttggggtgttataattttgtgtgaactcttgttttgtgtatagaaaagttggttgtattaagatattgtgttgccacagttgggagactctatagttcacttccacttctgttcacactcacggagtgaaatgcgaaaaggtgagctgttcaccacgagcctcacgtgaatgtgaggcacctgttgctccacggaagtgacccagttgctataatatgcacgaaagggaatgggtgataactttttgctttctcactgaatgcacatgtttctgttatgttaatgacttggtttgggtagcctcttaaggtactagagttgataaaagtgtacccgggtccctttgccaataaaactggttatgacct

SEQ ID NO: 714686 - DNA, 174 bp, Homo sapiens
atgtgcagtcgatctagaggaccccctcctaattagtgggggagacaagagcctaacaaatcatcatttgaaatggtggtagtttccatgaagagtaattatagagtgctatgagtaacataaagggtgctcgtctagtccccgaggttggtgagagaaaccgtcgaattcgag

SEQ ID NO: 714687 - DNA, 177 bp, Homo sapiens
tgtaggccagcgagtacgagctactctctactagacaaaggcagtgagaaagactcggaattttatcatttataacaagaaaggggaaaaaagaaaaccttatattgctttcaaaaatacctgtgcaggtggccgatatttaaactatactgagtcaacggtgcaggtaaaccaccc

SEQ ID NO: 714688 - DNA, 1273 bp, Homo sapiens
ctgtcatttcctattcactacgtcttaagtgagacaattatagcagcaacaacgaatttctaggatttacacctggttaaaaacacgttcgacgtgacaatccatacagtgcaccaacaattcattacattaaatgaactatgctcactttaaacaattcgattcgtttaacgctagcgttgtaggtcggtgccctgcctgtatgtcccagcctacttggcacagcgctcggagatgtgaggatctgccttacacggttcaggaagtttccatgcgctagtgcgttgtagtcactttgttaccatgtcgacatacccacctgctctcccacggaccggtgcgcactataaccaatgaccctggcctcttacaaaattaaacaactgcaaagtataccaacattggcacctgcttatcgtggctcctctcactactcgggcttgggcgaaaccattgctcactccaatagacagctacattgtaacttacctcgtctcttctggactcctccctcaccaagccactataaaaatcccctgtaagcacggtacacagtataacgctcccacccttacagtcaacagattgtactcaaactaattgaggaaacaacatgttctaacacatccccccaagcgcttcatcggctgccatatgcgccacgggtcattccactctaacttgggctaccacgttcaccctacgtttccaaaaccgtcatcacatcaaactgagccccttcacaccatacgacaccctcgacactacctacttcggggccctctcctcgaacgttccattccaacatctgcacccacctacacgaggaccgaaaacttactctgggtcacgcactccacttcatactacccgcttcacccctcactcaaatattaccaacttttgccttggtcaccttatctcggcaaaccattacccttctagaaccctttcaatcctttcttgcacaccatcaatttcatcgtcaccctattttttttgggcaacagcgcaacaaaccaagatgcttgatacgctatcatcaccgaggggtacattcgttacacactcttcctcaacagcttatcacttatacaccccaccacgttaatctccgctatatatacatcggccactaacacaactagggtagtatgataaaggcaacgtatacaacaatctttacttgatgcgtgcaaacccattataatatgtaccgccatattaaagccacgtgggagcactcaatgtgtatctactaattcggcaatcg

SEQ ID NO: 714689 - DNA, 730 bp, Homo sapiens
  misc_feature (119)..(119): n is a, c, g, or t
  misc_feature (226)..(226): n is a, c, g, or t
  misc_feature (241)..(243): n is a, c, g, or t
  misc_feature (249)..(250): n is a, c, g, or t
  misc_feature (253)..(254): n is a, c, g, or t
  misc_feature (259)..(259): n is a, c, g, or t
  misc_feature (261)..(261): n is a, c, g, or t
  misc_feature (266)..(266): n is a, c, g, or t
  misc_feature (271)..(271): n is a, c, g, or t
  misc_feature (290)..(290): n is a, c, g, or t
  misc_feature (292)..(294): n is a, c, g, or t
  misc_feature (313)..(313): n is a, c, g, or t
  misc_feature (318)..(318): n is a, c, g, or t
  misc_feature (330)..(330): n is a, c, g, or t
  misc_feature (332)..(332): n is a, c, g, or t
  misc_feature (371)..(373): n is a, c, g, or t
  misc_feature (378)..(378): n is a, c, g, or t
  misc_feature (380)..(380): n is a, c, g, or t
  misc_feature (382)..(382): n is a, c, g, or t
  misc_feature (391)..(391): n is a, c, g, or t
  misc_feature (399)..(399): n is a, c, g, or t
  misc_feature (402)..(402): n is a, c, g, or t
agcgggcaggatccggagctggtgctgataacagcggaatcccccgtctacctctctccttggtcctggaacagcgctactgatcaccaagtagccacaaaatataataaaccctcagncacttgctcagtagttttgtgaaagtctcaagtaaaagagacacaaacaaaaaattctttttcgtgaagaactccaaaaataaaattctctagagataaaaaaaaanaaaaaaaagggaaannngccagnntgnntatantnggagnaaaanttcctcgtccccgggggcngnnnaccccagccagggtcaacncgacnccggataaaccnanagacagcatctgagcacagaaagtcatcaaagcctattnnnggagnanangacgaagancaagaatnaantgaaagtctgagcccagctgaaaacactgatttgggatgctctgaagaaagatagctcgcggcatcccaagctggagaaggcggcactttctggcgaattgcaccgtgaagcccctccggaacctgcagcgggccggcagatgacggctgcgctgagcacagcacccaatgtgtgctggggaagtcaccgagccggcttcagcgagtgctttgaacgaggtgacccggttcctgtccccgtgcgagggcgttaatccccgaggtgcgcactcgcgtgctcggccacctggccaactgcttgacccagatcattgccatgacctacccg

SEQ ID NO: 714690 - DNA, 359 bp, Homo sapiens
cttgtttcctgcacttcctcacctttctgcactttcatagaattgaagagagttaagggcgggctctggcttagagtgtggcttaagggaatgttgtgactaatttgatcacttatccagaccacaaaaatctcttccagcagggcgcggtggctcacatctgtaatcccagctctctgggaggccaagttgggtggatcccctgaggtcaagggttcaagaccagcctggccaacatggcgaaaccccgtctctactaaaaatacaaaaattagctggctgtggtggctcacgcctgtagtcccagctactcgagaggatgaggcacaagaagtgcaggaaacaagatccggtaccga

SEQ ID NO: 714691 - DNA, 749 bp, Homo sapiens
  misc_feature (18)..(18): n is a, c, g, or t
cggcagtataggccgtgntaatcgcattccagcggtccttcagactgcccggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagttatgagaaggtgtgcagcaatgacaacaagacctatcgactcttcctgccacttactttgccacaaagtgcaccctgtgagggcaccaagaagggccacaagctccacctgggactacatcgggccttgcaaatacatccccccttgcctggactctgagctgaccgaattccccctgcgcatgcggggactggctcaaggaacgtcctggtcaccctgtatgagagggatgaggacaacaacttctgactgagaagcagaagctggggtgaaagaagatccatgaggaaatgagaagcgcctgggaggcaggagacacccg

SEQ ID NO: 714692 - DNA, 403 bp, Homo sapiens
  misc_feature (18)..(18): n is a, c, g, or t
  misc_feature (337)..(337): n is a, c, g, or t
cggcagtataggccgtgntaatcgcattccagcggtccttcagactgcccggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcntgctcccctcatccccatggagcattgcaccacccgttttttcgagacctgtgacctgggcaattg

SEQ ID NO: 714693 - DNA, 502 bp, Homo sapiens
atatctacttatttttattcctaggccatttatctatcactgatgagccttcatgtatgtactttaaaacaaaatatatacaaatcttgcactggtttgaagattttagtaatgaaaagttacccaatcggttgtcagtatgttatctagaaaccaatcttagaaatgtgtgatgacgtttttttctttatagctgaaaagaaattattctgtgcctgcttttactttgtccttgtatagtcctataatattaagtgaagggagattatttagcctcatattgaatttccaaaactgatatatgtgtttgccattttttaatgatggagagaaaagttcgttatcttactttgataagtttgacataggatctatcacttctggaagcttacggtgacagttgtcactagaatgctagccattagatatatgcaatgaataactcggttacattaataaactgtcttgaagtgctgcagacagtaactcatggacaccaaat

SEQ ID NO: 714694 - DNA, 275 bp, Homo sapiens
gggggggggggtttttttcccccgggaaaccccaagggggccaagggagggggggttttttttttccctccctttggggctgccccccccccccggcccctttggggttttttttgggtttttgggggggcccccccggggtttttttttttttttcccggccccttttttggctttttgcccttttttggttttccgggggccccccttggggggggtttcccccggttggggggggccccccttgtcccaaaaatttttttttttttttttta

SEQ ID NO: 714695 - DNA, 818 bp, Homo sapiens
  misc_feature (119)..(119): n is a, c, g, or t
  misc_feature (132)..(132): n is a, c, g, or t
  misc_feature (134)..(134): n is a, c, g, or t
  misc_feature (163)..(163): n is a, c, g, or t
  misc_feature (169)..(169): n is a, c, g, or t
tggcagggattttccgccaccacctcctcttcggtttcctctgcaccatcatcaaattctcctacttccacctggacaggattagctcgactagatacctcagtcacctctgccacagnttcttcgaaccananctgtctcatcaggcagggcctcttgctgnacggtncaagcctcccggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagttatgagaaggtgtgcagcaatgacaacaagacctatcgactcttcctgccacttactttgccacaaagtgcaccctgtgagggcaccaagaagggccacaagctccacctgggactacatcgggccttgcaaatacatccccccttgcctggactctgagctgaccgaattccccctgcgcatgcggggactggctcaaggaacgtcctggtcaccctgtatgagagggatgaggacaacaacttctgactgagaagcagaagctggggtgaaagaagatccatgaggaaatgagaagcgcctgggaggcaggagacacccg

SEQ ID NO: 714696 - DNA, 913 bp, Homo sapiens
tagaggccctgtgtccgtcgccgattactccgatgcagatagcagatcggtaaaggacaagtcgacggttagagggaactgcgaggcactttgctgtctgcaatcgaagttgagggtgcaaaaatgcagacgtaataaaactttaagcttggatgaagcaagaaccagtactccaagaaagcatcatcaagcagtcaccaccagctagcagcaccaccagcgagcacagcagcagccgccatcaccgccaatacctgcaaatgggcaacaggccagcagccaaaatgaaggcttgactattgacctgaatcaatttctagaaaaccagtgagacgaagaccttcagcccaacgaagccgtctatttatgtgggaacatctttcctcccgaccatcacttgaggacgaaatgcaggaaactatttgaggacaatactggaaaggcaggcgacagtctatcacttccataacggactcacaggattatcggctcttatcccgcattggaaagaccacgaaccgctatgccgggcagactttgcgcacaacgtgtgcaggcttggaccaatattgcccacataccgatgccacacagcaagctgcgatgtgcgcctttggccatgcacaatagatgcgaatcccctatacgaggtttacgacaaacccttcacatacaagataattgatgattccaaagcggaaaccatggctgagaaaacaacagacctatatcatcctggcatgagttacaggggcacaaggctaacgaaggaagggcctagataggacccaatatgttaggaactggagtcagaacagaaataggcagcacatcccatgtgcaaaacagcggggaattaggatatagaaggattatacttccagggcggaacaaagcagaggcatgcactccg

SEQ ID NO: 714697 - DNA, 196 bp, Homo sapiens
cgcccccaaagtgctgggcatacaggctgtgctgcaccacaccctggccccctatgccttacattatgaaaatgtcctcttcggcctcatcaccaggtatatagcagcgactcaattgcactggctgtcctggaaaggggctcacggaaagcctgcatgccaggctctgacaaggagaagcatctgccattccttg

SEQ ID NO: 714698 - DNA, 251 bp, Homo sapiens
  misc_feature (33)..(33): n is a, c, g, or t
ggagatgagccggtaccgtatctctaatattanggacaaatgcagtcccctcccatgctgggagtccctttttcttttctacctagccattctggtaccagcatcgccagggtgcctcttcctcccgctcgtggccagcccggctggttttgtaagatactgggttggtgcacagtgatttttttcttgtaatttaaacaggcccagcattgctggttctatttaatggacatgagataatgttagagata

SEQ ID NO: 714699 - DNA, 691 bp, Homo sapiens
  misc_feature (18)..(18): n is a, c, g, or t
cggcagtataggccgtgntaatcgcattccagcggtccttcagactgcccggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtgtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagttatgagaaggtgtgcagcaatgacaacaagacctatcgactcttcctgccacttactttgccacaaagtgcaccctgtgagggcaccaagaagggccacaagctccacctgggactacatcgggccttgcaaatacatccccccttgcctggactctgagctgaccgaattccccctgcgcatgcggggactggctcaaggaacgtcctggtcaccctgtatgagagggatgaggacaacaacttctgactgagaagcagaagctggggtgaaagaagatccatgaggaaatgagaagcgcctgggaggcaggagacacccg

SEQ ID NO: 714700 - DNA, 847 bp, Homo sapiens
gatggtgcaaaggtgggtctgcagacataatttaggcattgaaggagctgtggttgtaagcactctacaagatgggttatccgaaagccgtcatgttctttatagaagctcatcataattgaagtctgtcttcgcaataccagactctgcaagtgatggatgtaccagggaatagtcttgtctgcaagggagattgagaagaaacttgagatgaggaaggggaacagtttgtgtgaaggaacatagtcgatgtgtatcttagtcgcttctaaatggttgagagatgggcctccgtgggggtagagagtgggcaactgcggtgagtgagatgtgaagatattgggaaaatggatcagtgtttgctaactcagataagaaggctgagtgaactagagtctaagtaatggcatgtactggctaggtacattaccaatggcttgttaattagatctggtagatagagtagaatcctcagtcggtgcattctttgcaaggctaatgtgatcaatcactgtggaatatgggtctcgctattggaaggttagaaattcttcaggttggagttcaggaaagggtttagctctgaagaaacctccctttgggtacttttgagaaatcagagatggagatatatatgatatgtatccatacattttatcgtcgagaaattgatgactggaaattacactagttggcaaatagcgtgggatagattggtaactgaagatgggtgtgacaatctgttttgcctatgctctggggtgaatagagctgatggtatagtactggtttgcggaattgcatacaaagtgtgcattacaacgtgtaatatgggtaataataggtc

SEQ ID NO: 714701 - DNA, 144 bp, Homo sapiens
tgactctaagaggatcccccctgtggcggcgtgcgcgccgagtggcgatcatgcctggccagcgccaggccttgggctggtcggggttgacctgccagcgcctgtgccaccgccgcgatcgaggccgcgtccggcgcgccctgg

SEQ ID NO: 714702 - DNA, 707 bp, Homo sapiens
tggtgtaaagatggcccatggtccccgaatgggcctagatcccagctgtgctctggtggcctcagcctcttcctcaacctcccagtgacctatctggctccatgccctctccacctaccccagtcttctcccccgcctcagccccatccgtgtcatacctgcctggggactgtgttgacatgctttaacaagtggcctggcagagaaccatcctgggacaactattgtgatgtgtggactacactgcctgtgtgagtgaagagaattttgtccaaatacaaatgacacagtgagaccctgcctggtagagtgtgcttggagggtgtgtgcaacaagtcacgacttcagagatgccaccgcctgctggagctgagtgcggatgctggctggacgagctggtggtatcacaatgcagcaaggaggccccaggacctcttccagatggcttgtgctcatgattcccttgcactgctctgctgcccctgccaggcaccttcgtggccctcctgtccttcccctgtcctgctggtgcacctagagacggccccttgcggagtgtgcctaactgtgtgcaagctgttgaccctggacacaggatacacagacggtgtgcaagctgggcaactgtgaacttgccacaccgcgctacagtggggttaggccttgtgtccactgtggccttggtcactatgaagcagactgaatgc

SEQ ID NO: 714703 - DNA, 220 bp, Homo sapiens
cttcactggtcacatatactgagtctgatctcaaaaagcagtattaaaaggccaatttctaatttaatgccacaagaaatttgctgtcggcataccacataattaaagaccagctggcctcttagtatctgtaccatggacagaccctggaaattctgggcggtcctctactgacagtttttgtttatcgtaatatcctctgcgttgagatcaggcatgt

SEQ ID NO: 714704 - DNA, 374 bp, Homo sapiens
  misc_feature (19)..(19): n is a, c, g, or t
  misc_feature (48)..(48): n is a, c, g, or t
  misc_feature (162)..(162): n is a, c, g, or t
gtccagggccggggtcatntgtgacccccactccagcaaccccacccntgagtgttctctgtggaatgagaggtccttttggcgctctgtgagggggaagaagggcttccctggtcacgtccacctccctgcaggggactcacgagagcacacagaaaaccntggaggccttgagtaaagaaatctgtgaatcccatcacacccaaccgggcccagcctccttacagcatggaaccttttacaaaggtaaagtcagctaggcacagtggctcacacctataatcctagcactttgggaggccgaggtgggtgaattgcctgagctcaggagtttgagaccagccttgccaacatggcaaaaccacatctctatt

SEQ ID NO: 714705 - DNA, 369 bp, Homo sapiens
  misc_feature (323)..(323): n is a, c, g, or t
  misc_feature (355)..(355): n is a, c, g, or t
  misc_feature (360)..(360): n is a, c, g, or t
catattcagataatgctcaagttataattgtctcataaataatatagcttacactttaatattttgtttaaataggcttccaaataacactcacatgttgtaatgattaaaaatcttttaagccacttttaatctgtaggtcaaatcctcatcttgctcctctttgcttccttccccctccccctccctctctctttttaactctatctctgaaatttatttactgaagaaactgagttgaggtcttggcaaaatccatacctggctggcaatgtgtagattgtttcccacatgtggcctttctggcttggtttccggaatgncccttgggtttcctacaaaattggggaaattnggatnctaaaaggt

SEQ ID NO: 714706 - DNA, 416 bp, Homo sapiens
  misc_feature (315)..(315): n is a, c, g, or t
  misc_feature (370)..(370): n is a, c, g, or t
  misc_feature (377)..(377): n is a, c, g, or t
gatctgcctgcccaccaactggtgatggaaggttacaagtggcacttcaatgagacggtgctcactgtgtggtcggcaccaactactgctaccgtgtgggaatgtggcagcatcttggagctggacgagcatctccagaaagatttcatcatctttgagctgctcccaagagcacggggcatccctccaagagccgtgccgctattcctgtgacccgccggcctgccctcacctttggctcgacatgtgcttgcatttctagcgagctggcgtgggggctgtctggttgtgtcccaagaggtgttgaggtaggtnttgagagctgagactagtcatgtctctctttccattacatgagttcatatttttnttttctnttttgtgttagtaatttggaaatgaaattataaggaatg

SEQ ID NO: 714707 - DNA, 191 bp, Homo sapiens
attcgagctcggcacccccacgtcgcggctggcaggacgacgtccgaatgcagtgtggtggacgtgttgcggaaatccgcggtccacatgaggtcgagttagcgggcggggtgtcgtcgcgcaacggatgtcggtaggacgcttgccttcaggtagctcggtggcgttgacgtcattctcgcagccaagca

SEQ ID NO: 714708 - DNA, 426 bp, Homo sapiens
  misc_feature (71)..(71): n is a, c, g, or t
  misc_feature (101)..(101): n is a, c, g, or t
  misc_feature (111)..(111): n is a, c, g, or t
ggccccggcatcggtcctggggctcggggcaccagggctatggcttttcaccaaagtgctcaactcgtggnctggatcaaaaaaaagatggaggaggaggnctgagccccnatttccctaggtttgaatccaaagagcagtgtggaaaaaaaaaaccaaaaaccccctgccccgttgttgataacccctaagggttttttttaaaatttctgatgcagaaagcccgggggggaaattttctttccgggagtccccttgatggcctttccctgaaacaacccaaagggccccttttttttttttgggggttgcaggggaaatagttatcaatctctagggggccctttccttttcccctttgaaccccttggggccttgaaaataactttttcccaataaagttttttgagaaatgcccgggggcca

SEQ ID NO: 714709 - DNA, 802 bp, Homo sapiens
cacaaagacgtgtccaacagtagacctcattaatgcggagcatgagcgggagtcccgtaagcgcaggtctaagcgtccttattcgagccgagcgggggcagaccagggaatgttctaagtaacgaccacgtgtactaatgggttgtcgtcacatgaccatgtctacttttgtaactaatcttacttcgagtagttaagtagctccactcattaatggtctggacggctgattggcaacatggactaggttccccgtaagtagatcggtgcaccgcgcgaatgatggcgtttgacggaaataaacaatcatcaagcttctgacgtctgagcactcccttctctccttaacatgctcgtggcgtcggagagtcttggctgatagatgggacggtcccgtggagagcaagcgcaaccagggggtgtgatatcaagggtccattaccacccgtgcacgcatattgagtccggggggacatctaaactttcgccagcgcgcgtggaagcccatcccggtgagtagcactaatcctaattcgtgcctccctttagccacgccataaggccacgggatattgcttcgcggttctatatgcgggttagggtgagcgccccaaattcgaagagcagaatcgcctaggtcgaaacaaaaagccgaagagttctatttccaaaggatatttaaattaaagggcccacacttggggcgctcacttaagacccccaaatcaaccaaaagcgggctccgcgatccgtctcggggtcgtcgaaatccgggtaccgtaaatgcacaaggctggttcgt

SEQ ID NO: 714710 - DNA, 356 bp, Homo sapiens
ctcgcgaacgtgttatcccctagccccccctgtcgggctagtcggggctgtcgggctagtcgggccccgactagcccgacagactttggatcctggggcgagatgaagggaagagggttgtttttggtttcgtgacgacccttgctcttgaccttgaagacgaagtccctactcccacatcctgccttgtcacggttccgctcccactttccccatgcgcacatgttgagtggcacgcctctccatgctctcattgttatatgcaacacgcctgagcgccctgggagtgctcgtgtagtgagtgagtcattccactgtgcccctgaccctgcccctgttctgggcctagtctgggg

SEQ ID NO: 714711 - DNA, 941 bp, Homo sapiens
actgagcggttgtggccgcgttgccgacctccagcagcagtcggcttccttctacgcatatacccgggagtaggagactcagaatcgaaatactctgtctccctccgccttcttgttttcgggttggtgagaaaccttaccgtccacacatgatggtccgagctccgttgccggcaagacggttcctcgctccaatgacctcccgtgtattcacttgggaatctcaaccgctcttgtgggtcagaggatctgatgtgtgaggctatcttttcgatcgctatggcagtacttgtgggctgctctgttcatcagggctttgccttcgttcagtgtgttaatgacgagacttgcccgggctgctgtagcaggtgaggattggggtgattgtttggctcggtccacggttttagatattaacctggttggcgacgccgaaatgtgcaaccgttgtgaccatgctggtgttgaaatcgttcttgcagctggagtttgttctgcggtcagtgactgaacgcccttctcggtgccctctactcagctcctctttgactgggtctatgactttcgacgggctcttcatgctgggatgtacaggtacccccgcatgtgtaccttcgtccttcctggtattgcccgggctgagtggccctccgacaggtctagcgtgttgtcagggaacccttccacgagggggcaaaggtggttcaaatcaatgcgggagagggggggatttacaaggtcggacaggggcaggggaagtcctcagacatgaagaagcgctgacgcataaaccaaaggggtcaccgggaaaaatgagagaggagagaaaaggagaggcactaagagaaatcaaggagagaacgcaaaacagaaaattaacaagaagaagaaaaaaggagacgagaaaaggggaaaaaaaaaaggaaacaaagacagaacaa

SEQ ID NO: 714712 - DNA, 327 bp, Homo sapiens
  misc_feature (230)..(231): n is a, c, g, or t
tcctgccctcaggtgatccgcctttttcagcctttccaagtgttggggttacaggcatcagcccttttgcccggctgggatcattttttccccacatgtttgttcaataagcttggggtgcaaccccctacatggattttcatagctcctcctgtagcctgttgaatatttatgtttagccaaccttttcagcataaaggtcctgcccaaaccccccctggtcctaaatnnctctttttggttttaacccggggttgcttttcccaggttgttgggtgggtcccttgcaggctgtccccctttacaagaaataaagtgtcctttgca

SEQ ID NO: 714713 - DNA, 790 bp, Homo sapiens
gacagtcgctcttcctcaggcggggccatggcgggacaggaggatccggtgcagcgggagatacaccaggactggctacccgggagtacatggagataatcaccagcagcaatcaagaaaatcgcagatttctcaactcgtccgatctgtcttgtcgtccaggattgggcaacactaaaggagaaatgtgacagccctgtgcaccggagaatagagtcacatggaacgctcgggtgaccaacagggggagaccattcaccttagaacagtgccggtgttgttgtggaggaagtggctttacacaacacaggccacatggaaaagggcccagaagcctaaagatctttcctttctccttaaagagcaacaggctaatctggtatcttttccccacacagtttgtgggccttggggctctgacaattcgtgggggtgggcgggtgcactgtgggcacgaccgttcacgaggacaccggtgggacacccacggttaggcattttacacctttcaggacaccatttatacctctactgggtaatggtcttgggacattagaggcaaaaggctgggaccctgggtgaggtcttctcacttaattatattttcttctcaaattctaaagtgcaattggcttgcggtctgaaagcttggtcccacctggtggagcggggctgtcgaactctcggggtcgacagtttgtcccatctgttgtagacgctggtggggatcattgggggcctctcactactttgtggttgttgagtgatcatctattcacttgaaacaggg

SEQ ID NO: 714714 - DNA, 86 bp, Homo sapiens
  misc_feature (17)..(17): n is a, c, g, or t
  misc_feature (19)..(20): n is a, c, g, or t
tgtgccacctgggacgngnngtcttattataagaaactctttggcagtggaacaacactggttgtcacagataaacaacttgatgc

SEQ ID NO: 714715 - DNA, 293 bp, Homo sapiens
  misc_feature (3)..(3): n is a, c, g, or t
  misc_feature (128)..(128): n is a, c, g, or t
  misc_feature (134)..(134): n is a, c, g, or t
  misc_feature (231)..(231): n is a, c, g, or t
  misc_feature (290)..(290): n is a, c, g, or t
agntagggtaccgttcattcattcattcagagacagggtcttgctctgttgctcagacaggagtgcagtgttgtgatcacagctcacggcaacctctgcctcccaaactcaagtgatcctcccacctnagcctnccgagtagttgggactacaggcatgtgccaccatgcctggctaatttttaaaaaaattattgtagagatgagatctcattacattgcccaggctggntttactatttttgggtagagacggggtctcaatatgttgcccaggctggtgttgaactncta

SEQ ID NO: 714716 - DNA, 755 bp, Homo sapiens
gctcctctccctctccctctccctcctctccctctccctactccctctccctctccccacggtctccctctccccacggtctccctctccccaggttccctctccccaggtctccctctccccaggtctcctctccctctcttaccacggtctacctctgatgcccgagccaatagcttggactgtactgctggaccaccaaggttccgattcgggggacgatacaacgatgcacacacgcgttccgcgccattgttcccaggtttgggcaaaaaatatgatgacccaatttaccatgcacgattttggagaagccagccggttacctaaaaggtgagccaccgcaggtatttggaaccgaccccactgggacaaaaaaggggaaatattatgggccccacacccggaattatgggggcacccagagtgtgaagaaaagagttcatatgtattgggggccccacacgatgatggcgatagagtaccaaggaacgccgaggaaatcacaacctcagcgagtaaagacccaaaaaaaaagccagtgcgaaacgcacaccccgaacgattagggcgaggcaaagaaagccacgcacgcttatgggcgcccggacgaatataatcacgatcagttacccacgacggggattaggagacaaggcgtatttaccgagaagtagcgaactgcagcacagatgaagagcaagatacgaatcaatagtactagcatacaagaacaaacataaggggcgaagagc

SEQ ID NO: 714717 - DNA, 207 bp, Homo sapiens
cgtgtggtggttgcagttgaagatcagcttctgagcccctgcgtgtttaggtgggaggggaacctctgagcgtaagtttcctgccacagtgcactggtgtaggaaactgagcatgctgtagcagtttctacgagaagtcggggggtgttgtggcaacattgttctctgaattcatgtggaaatggctttatcgatgccactgtccca

SEQ ID NO: 714718 - DNA, 951 bp, Homo sapiens
ggaggcggccaccgtggagagcagatcgcggcgcctgaacctgctagttcagagccgcgatgtccggattgaggtcctcgtgacgaagctggccccggagcacatgacctgtaagatgcgcgaggatgtgatctcctccatacggaactttctcatctacgtggccctcctgcgagatcacgtccagttgcatcttagacgtgaaattgtggaacgatggcatatgaccgcatgggagccatcacgaatatggacatgcgcagattatggacgagcccgggtttacacagggtccgacgtccttcgtctgcacggtgagataggccccagaaccaggtgtaggaagactcttcgagtggacgtaacgacttctgcttgttacgagacaagttgtggctctggtagctgagcttgaaagttaaatgtataacaactattggggaagtatgagacgagtgtcgcgtgattcgtggtgtaccctttatcctctgtgactgtttggcctcctgacaattactggtataatttgtaatatacatgtcagaactccgttttacataggcacagtattgggggagctgtgtctgacatgggactgtctgtgtcagtgatctctgtatacttttattctgccagaggtgtatttgcgacgacgctctcatgctatgtttcggtggacatcccgctacaaggcactagtgactttaaagccggagggtcagtaatcaggctaccgttttaaataaccatttcttttccacccacgccacaaaaagaacaacacttttcgccggcccggcccaagatttaaaccttttggggcggccatttgtaaattgtcgtggttccaggacacgcggcggggtccccccaaacgccggggccccggaacccggctcggatgtcccccgccccgtccaccccgcaaccaccgcatgcaactcctgcacg

SEQ ID NO: 714719 - DNA, 900 bp, Homo sapiens
tcctctgtgtgtctctactctagatgcctaggagagtctagatacttctaaaagctcctaaagcttatattccaagagagatgactatctgagttcgtgtaggtctctaccgcacaggattacattaaagcttgttatgacgttatatgtttccaggtgggcatggttgtatttcccagtttaacagtgcagtaataggggcatgtattttattatatttaagggtgggttaggagtatcctttgctggagactgagaaaggggtgtagtttaagttccatcaggtccagtacagtactaggagtcataatactttataatcaattaaataagatagaaccactgagagaataatgtattttgttaaagtggagaaatgtggtttgcttttttgagcttgcgctttttcagtatttgagcatagggagataattgttttataatacaaaagtaaccacttggaattttaaagataatgttatgtgtgtatgtgaaatatatatacatatatatatatatttcctaaacagaagaaaagatagctttctgttacaactggtatcaactcctcttttctaattgctgtgaaatggcaactgttgataaattatgtgatgttttaaaatctaaatgggaagtaaaatatatcttgattttacccagcttaatctgtaaagtagcacttaaatatatctgatagcaacacttaagatatctgctggggattactttcctatcatccatatgccatttgtgcaattccaaacatatggggtgcttctgaattcctgatgaatggtttaggctattgaaaattgggataattaaacttaggcattaaaaattctgaacttaaatgggtcatgcctataatcgtgggatcccaaaattggcccttgg

SEQ ID NO: 714720 - DNA, 323 bp, Homo sapiens
gaagctatctgactactctagaattgggaaattatgaaatatcaaagatggttctaaaagtcgatttctacattttatttcctgcagtgtggatgattatggctgtcggaaacgataagtcaacatctaagacattaacgtcaagtgaatttataaggcgctgaacgataggcacttaaatcaattacagtgcagcaaggtatggtatttacaacattactgggtatacgtagcgcagagtgacgctgacagggctgatatttgcagcagtcacaaaggtgacaaagtttacgtcaactttgtgccaaatgatgcgtcattac

SEQ ID NO: 714721 - DNA, 171 bp, Homo sapiens
ttttaaaattttccccagggggggggggggcccctttgggccccctttttccccgggggttttgggggcagggttttttttggcttgggggcaaaaaattccgggggccccggggggcccccccccccccccttttggggggcggggccggcccctttttcccaaatggga

SEQ ID NO: 714722 - DNA, 168 bp, Homo sapiens
gctggtcctatttgtccggcgcgcaggacaactgcatcgtgtcccaccaatcaagatgaccgtgtgcagccccgacggccccggtcggccgtctgccagtgccgcgcgctgggctctgggcatggctggtcggctgctccagcgctgacctccaacgtgtctgctgct

SEQ ID NO: 714723 - DNA, 449 bp, Homo sapiens
ggatccaccagagccaccccctgcagtacatcggtcataaatgaaccatgcactcatattgtttacaaattggtaccagtgcctccaatgaagcggaaatgagaacgcagagggagttcgtatcacaaattgggcatggagtgtgacggcgagagatccaagggtgagacctgcattactgaatcggaaccagaatctgaatcggaactgatacaaatgaaaagctggagagaagagagggaagacagaccccacccgaagacaatatggagcgacgcaggaaagaaagcaagaagggaatgaaatgatagcagagagagaacaagatagaaagaaagaaagcatagccgagaagaatagcaagtaacaaaaatgagaacagaaacaaatgagactacaacaaatcacaatgcaaaaagtgaaagaggacgctataggaatcacaaatg

SEQ ID NO: 714724 - DNA, 215 bp, Homo sapiens
agttgatctagaggatcccttggggctcattcaggggatttctcactaaaaggcaatctcaacggaaaaagaccctcggggaaatcctcaagcaagatctgcccgggtgcatgctcggaggaagggacggggtgagggaggaagggaggtaacggtgaagaatcgtgtcctcatcctaacccccaaaagctttccgggcctctttaggggaaggg

SEQ ID NO: 714725 - DNA, 264 bp, Homo sapiens
cctgattgcagccgctgaggtagttggcagctgctggtgtgacccgggaattcctgtcaccttcactcctaccacctggtgtctgacacgcctcctgggcagctctggtgaggcctcttgaggctgggaatccagactaggaatcccctctgccacatgggtgactgcagtgactgggcgttggtcacactggtcctggggatggaacagcacctcctcttccagctgtgccccacagaattcacatgggataatgatgctctc

SEQ ID NO: 714726 - DNA, 167 bp, Homo sapiens
tgaccagcgcgctcgcatcaccaatcagttctcattcggtccaaggcttccaggtcgcccgggcggatcatcggcatgcatcatgaccagcgggccattccggttgcccaatagctaggcatcattgcgtgccaggccgacccaggttcccaggtcggtcgattttc

SEQ ID NO: 714727 - DNA, 1322 bp, Homo sapiens
gcagcgccgccgctgcagtgtgtcgtccctgccctccccggcccggggtgcaccccgcaaggctccgcgactggtgtccctggagcatgggaggctgcgtgagcgtgagtggctggtgtcttggcaggagctgcgtggcagggagggcgtccatggctgcagccaacaagggcaacaagcccacagagtccggagatatccgctttgcggcaagccaacgatgcagacaggatcccacagcccaacgtccacttttgatgagatcgctgcatgactctggtggtcatggtcacgccaggagagatgacagaagacttactggtacaaggtatggcttcctgaagatcctgcacaaggtatgagattaccttcaatcatgacccccagatgcacaggctgagcacaggatgtccagcgaggcaccatgtcccccaggccattgcaaccatcaagacgtcctcacagccagtggatgcacctgtcaccctgcacggttaataggtggtcacagttgttgagatacactcgagaggcacaaacgagggcggatacttccaagaaggagcatactgatagccctgacgaaaggtggcacactggcaacaccagaagaaagaggccgatgaacggcagcgccaggccccagacagatccaaggggagccgagacacccacaggggacacaggcccacagtactgccagagacatggacggctcaaaagatggatgcaggagacagcacggaagccaggagacacatacaccgaacctacaagaagaccacaaaggcgcaccggggacaaccggacatatcgaaagctgaagaggccccccgtgcaggggccaccacgtgacacttgggcactcactgggaagacaccacttcaagagcagaatataaacagaacaccgaacatattgggatgccgcaccacaaccacttgacgatacagctggaaagctactgctagcacacaatcccaatgcaacccacacatcaacaacgcgcggggaaatagacatataacgagaccgaaatgaaaagagagacgactcgaaaagacaacgcaacacaacaacaccagacgcgaacaacagacagagaggaagcaagaacacaacaccacaacaaccacgacaaccaaacagacagacacaacagacaacaggaaacagcgaagacacggagaagagaaaagagaaaccacaccgaacaagagagggaaccaagacacacccgagacgtaagacacgcaaaacaaagcaaacgagactagaacacaaagaaccaagagaaacacgacaaagagagagacgagag

SEQ ID NO: 714728 - DNA, 421 bp, Homo sapiens
  misc_feature (15)..(15): n is a, c, g, or t
  misc_feature (49)..(49): n is a, c, g, or t
  misc_feature (153)..(153): n is a, c, g, or t
  misc_feature (224)..(224): n is a, c, g, or t
  misc_feature (416)..(416): n is a, c, g, or t
tagcctagtcccccnagatcctgtgatttatttttagggccccggggcntccccttgtcatttgtcccaaataaaaacatgtctgtgagggcagtttgtaatgtgtaaagaaagccatggtttatttcctgattatattttctgattttattncttatttggtctcttctttgcatagagaccaaataagaaaaggtaaataatgaggtttcaccatgttggcnaggctggtcttgaacgcctgacctcaagtgatccacctgccttggcctcccaatgtgttgggattacaggagtgaactaccgcgcttggcctgtagtgtgcttttcaaaaacatgatcttactcaattatatcacagaataccacaattaataaaaggcccccaaataaatatagttaaactcataaataanatttt

SEQ ID NO: 714729 - DNA, 1206 bp, Homo sapiens
  misc_feature (193)..(193): n is a, c, g, or t
  misc_feature (1206)..(1206): n is a, c, g, or t
gatatagcttaaagtggagtgactgacactggagtggagtgggaggcgtgagccacaggatggtgcgcatgaatgtgggcatcgtgaatggtagacacggagttggtgtgtacgagggaaggtcacgggtcggtgtgacctatcgagaggcacctgggctccgtcgtcgcccggtgtgctctgtggtgacaangcagctcagagggtcacgacggtaccgctgtcagcagcgaagagcaattccgaggatcagagtacccggatcgttgggccttcctcctggtgacccacagcgttgacgctgggtgcttggatctgatgggaaccccttggacctggataccaccttattcacgcgtagggaattgaaaagctcgtgactttcgtcctatgctgccacatggtggccctagtttacccttgctagatgccagtaataacctcgatttcgcaacattcgtcactccgcttgtgggcgatgcttcctgcgtcgaacgggagtgccaggggctttctcggcatgaggaattatcattgacagaagtgtgaccccgcaacaaccagtgaactccccgttcgaacccgaggcctccgagtcggacgaaacctagcggtgtatctaaaagagccaaattactgactacgggccttacttccggcggacgcgacttaacaaatcatttgggcccccaaccccgtcccacgggtgccttgagaggatgggttacccatagacgtggacctttcacccagatgtgcgtagcgtgttgaggttccccaacccggactctttccccgtttggcagagcgaccccaactacaagatcccctagagggcaccaaaagaccctgtcttcctcaactaccgttttcccccacgatttggcccgggcacaaccaaccggggggcttaatcatgccggggcagaaccatccacaattcaaatctggtgccccacgggccgctgaatcaacttcggttgcccgcctattgcccacattggcgtaggatcgagtgtgaccccgacacttgaaccgggcacaatcttttcgattggccctgtggataccccgtcacctttcaactttccgctttgacacacgccccaagaagggtggcccatctttgggacaattatctgctcattcccttcaaaacccatttgctagtcccttaaattcgataccagaccttaagcggttcan

SEQ ID NO: 714730 - DNA, 356 bp, Homo sapiens
  misc_feature (109)..(109): n is a, c, g, or t
tcctacgtgcagttgcccatgggcaaaccttcccgttccccgatttgttttcccaaaaaaacgagagccctgaagggagcgctgccggcggcctttttcagcatgcttnaggaggaaaggcaccaaaggcaaaacaacgacccccggggggggggggtccccaactggtttgggtttttacggggtggccaacagggacgcgccccaggtgggcaactttggcaaaacaacgacccccggggggggggcatccccaattggtttgggccgttacggggcggccaacagggacgcgccccaggtgggcagctttggcaaagcagtccccccccctaaataaaaatttttttgcagca

SEQ ID NO: 714731 - DNA, 297 bp, Homo sapiens
ctcgtacgatctgaagacgcagaaatagaagaatgtggcaaagctttctaccattcttcacaccttactacacataaggtaattcatactggagagaagcccttcaaatgtgaagaatgtggtaaagcttttaaccacccttcagcccttactacacataagttcattcatgttaaagaaaaaccctacaaatgtgaagaatgtgagaaagcttttaaccgattctcataccttactaaacataagataattcattctggagagaaatcttacaaatgtgaacaatgtgcaaggctt

SEQ ID NO: 714732 - DNA, 417 bp, Homo sapiens
acgacacctactgctgcatgccttggggcatctgtttgcgttccacacattgctgactatgacacacggacctctggagttcaagatgctatacagtgttctccactctatgagcctggagaccctattcaatgttgttccctggagtagcagccattacagcgttgaacatcctaagcatccatcacagaggtggcaattctgggcgtagatgaggacggtggctaccctctggatttggatgaagctgtaatgtagaggacccctctatgggagcaagtagtcgtatacactatagttccttacggaatgcctaaccaggatactacagtatgggtgatccagtacgacacagagtccagtgttcacaactaacactgaatacctagagctacttgtgagagtcatggggttctc

SEQ ID NO: 714733 - DNA, 337 bp, Homo sapiens
gtcgatacccattcaaagcaatcgcaggtgtaacctcaccgggaaccctcacacagcgaccatttccacatccatggaggatgccggcattcctcagccggtaactcctcaaagctatttagaaaagggcctgggatgaagtagggatcggcttcgggagtatacggttcactgaagtcaaccaaggcgtcccgtccatattggctgcgggcgtcccgtcagggggattgtacacaggctgagcattagtcatctgaatccttcagggggcagaggacacacggcatgccccaggcctctccatacagacggcagcactcggggtccgagctcgaat

SEQ ID NO: 714734 - DNA, 626 bp, Homo sapiens
gcgaattcactagtgattgtgagctgagatcgcaccactgcactccagcctcagaaagggagtgagacctgctgggaagcatgtctccagccaagaccagagacaggcacttcaaagaaggaggggttagggtaggagcttcatgctcaatggattgactaaacatacacattcaacaggttacatgaggagctatgaatattcatgaaagtggttctgacacatgcatattgaacaaacatgcatgcaacatacaacccatggtcactttggggtggagacttaacatttaaatgtattataattaggccctatatggcaaaaggtcttttcaggacacaaagacatgcaagtgcaggagctctgtaagccagccagaaccagtccatgatgggtagtcaccttgtcaggaaaaagttactgaaatcagtcacttgtccaaccaaagctgtagttatggctggtggaacagtggttggaggtcagttagtcagcatctgatgaagctgaaaatgttttaatattgcttatctcaaagccgtgctggacgggttgaactcggtcacaatcaattccgaggcgccaggcggcgggacatggagttgggccaatgccatagggtcgat

SEQ ID NO: 714735 - DNA, 140 bp, Homo sapiens
  misc_feature (33)..(33): n is a, c, g, or t
  misc_feature (79)..(79): n is a, c, g, or t
  misc_feature (96)..(96): n is a, c, g, or t
  misc_feature (127)..(127): n is a, c, g, or t
gacaaatgttctcctgctacacctctcatattnacacatttccttgcctccctgttacatcttcacggttctctgttcnagcgagtaccccaattncctggctgcttctgtgagtttttcatctatntttttcaagaaat

SEQ ID NO: 714736 - DNA, 132 bp, Homo sapiens
cgtctggtatacagactgtattgtcatctcgtgtgtgacgcacttgtcctctagagttgggaccgacgctcgggtcgcgtactagttacatgcgatctcgtcgtttcggattaccagaaatcgtcacactaa

SEQ ID NO: 714737 - DNA, 1543 bp, Homo sapiens
  misc_feature (791)..(791): n is a, c, g, or t
  misc_feature (842)..(842): n is a, c, g, or t
  misc_feature (960)..(960): n is a, c, g, or t
  misc_feature (1104)..(1104): n is a, c, g, or t
tggcgcgcaccttacctccgtctaggcttgtgttgttcactatcccacgccttgtgggtttgtttggacaactccttttatgatgagttgtcgtacgacacctgtggtttggtacaaaactagccgttggagaacccccctgtgatggattccactggtgatctctctccgctcccgcttgggggaaatatccccgcgtcttatattatactccttttccctgatgcggctagtgaacttgctccccgccaacattctgtgtgtgccccctatacaagtttctccgttttttgttgagccctcgtcgggggcccccccccatggttggggcacactttgtgcgctcgttgtcgggctccccccccttccgtggtttgggaaaaagtgttgtggaagtttgttcgcccctgctattttggtgccaacgcgttgttgtttcggttcccaagccccactttccccgccctatttgtggcgaccccagacccccttgatgggggaagaccacgggaaatgtctcccaaatgtggtggtagaaaaccaacgttggtgtcgtcaaaattaaggggtataaattatgagagtcccctttatcgttaatggttggtttaccaagaggagaattgttccccccccccgcaccagtcccctttgattggacctgggaagtgttcacagtggagccgctctttgtggttttgtgtgggttataacggagattttttcctcccccctgggcctcgagactttataggccccacttttatgagaagcccacccccacgcgcccncgctgggggagagcgcacgctggagaccactgctcgctcggagactcggtntttctctgttgggagatctcttgtgtgttccacgcgggacacacatgtggggtcgacacacatggcccctctgtatatgttgtttatgagaggggttgtgacaatgtgagatgttgtntttttggcgccctgcacatgtgagagttctctgtgtgtccccgctctttcttctcccgggagtgtcacacacttccccaacacccacaggggcgcaccgctctgttatactcacaagtgtgtgttctctgcccctcacagagtnttggtgtccacacaggagaggtgcactcccacacctcgaactctgtgatccacacagtggcgagatttgggaataataatcttgagaaaaactcttctgccttcagaccacacacacttggagaaaaagggtgttttctcttttccctcgcacacagctaccactcctcaactcgctcttgagaactctccacacagtaatgttctaagtgcaccctctttataaaagtataaccattttcagagaaaaatgaggagttgcccttcccttgtaatgccgcctttctgtacccttgagctatccctgagaattgccaagggagtttttaatataattcaataatgttaccaaagtcacgccactcttccctgttgggtcaattattgaatgtgctgttaaattaagtcgtttgccatttaaaaccaggtttgccccccca

SEQ ID NO: 714738 - DNA, 209 bp, Homo sapiens
ccatgccacacgatatgttttccatcactaaataggttgaacacattcggtacagtccctgtcttagtatcacgtgtaacatacatgtactctccacccatacatctgtgcatttactctttaggtgcctgtctcaaaaatttgtgtgcattcttatctctttccttgtgaactgttgtatcctgttaatgcatattgctctgtgactc

SEQ ID NO: 714739 - DNA, 363 bp, Homo sapiens
gcgtcgactgcgctgccaaatccgaacaaaggcttcgtaaatggcctcgacggtgaatatcgcccgggcctgactgggccgcttgagcgttaggcgcgaggcttgaggctatgtgcagccggcttgcggaatgatccgaacccgttcttcatggtttgccattaagctggttccacccgcaatcgtcgcagagaggagtctgattatgccaagtgccagcacggtaacacgactgatcacccgcaagaacgacctcggccagagccggatcgaaacgcaggaacgtgccctggtggtcggtcccggcgaggcgatcctcaaggtcgaacgttgctccctgaccaccaacaacatcacctacgc

SEQ ID NO: 714740 - DNA, 599 bp, Homo sapiens
  misc_feature (207)..(207): n is a, c, g, or t
  misc_feature (355)..(355): n is a, c, g, or t
gaggagagatgttgtcgccttaaaaaaattatttaaaggcatgtgggggggtcagggggggtgggacacttcctttgtgttatcctggggggtttgtttccccattgtccccaaggtttgtgtggaaacggtgttaatggcttaattgcggtggtgcaggcacaaaaaggcctgggcacaattgcggtgattgtcatggcccgctcncgggacattgtgaaagccatcgcccgcctcattgagttttataagcacgaaagttgtggccagtgtcccccatcccgtgagggtgtggactggataaacaaggtaatggccctttttttgaggggggatgcccggccggccgagattnactccttgtgggagatcagcaagcagataaaaggccatacattttgtgtttttgggtgagggggccgcttggcctgtgcagggttttatcccccccttttggccggggtttgaggaggggatgcaggggtttgcccaaaagcattaggcccgggaggttgctttttagcccccccccctggcctgtttttttgggtttatccatttggaatgttggacaataaagggggtgttgccccccctca

SEQ ID NO: 714741 - DNA, 223 bp, Homo sapiens
tttagggcctcgaactcctcacctgtgaatgagggacctgaccatggcatccctgtgtccacattactcgaacagcagaagcaaccaggctggcacagaggctcacacctgtaatcccagcactttcagaggccgaggtgggtggatagcttgagatcaggagttcgagaccagcttggccaatatgatgaaaccccgtctctactaaaaataggaaaacaaa

SEQ ID NO: 714742 - DNA, 291 bp, Homo sapiens
atcaccagaaaaggcagacagctggccaacatggtagaacaccgtctctagtaaaatagaaaaatgagctgggcgtggtggcgggcacctatatcccggggactcaggaggctgaagcacaagaatcgcttgaacccaggaggcagaggttgcattgagccgagattgtgccactgcactccagcttgggtgatatagcgagactcagtctcaaaaacaaaacaaaacaatcttcatatgtaggcatatcctttctcaatcctgattttattttaatgttacctttttccc

SEQ ID NO: 714743 - DNA, 81 bp, Homo sapiens
ccccgcaccggggcaggtgctgccaacccccacactcactcgactctaggcaggccccctgcaatgcgagcgaatccactc

SEQ ID NO: 714744 - DNA, 248 bp, Homo sapiens
aaaaacccccctttttttggaaaaagggggggggaggggttttttaagcggggccccccttgggggttccccccccccccttaggggaaaaaaggttttgggtttccgggggcccccccggggggggaaaaaaaaaaaagggcgggggttcccccccggggggggggggaaagaacccttttttgggggggggggggggggttttttttccccccaagggagaaacccccccccccttttttttttta

SEQ ID NO: 714745 - DNA, 610 bp, Homo sapiens
  misc_feature (31)..(31): n is a, c, g, or t
  misc_feature (94)..(98): n is a, c, g, or t
  misc_feature (103)..(103): n is a, c, g, or t
  misc_feature (113)..(113): n is a, c, g, or t
  misc_feature (143)..(143): n is a, c, g, or t
  misc_feature (146)..(146): n is a, c, g, or t
  misc_feature (155)..(157): n is a, c, g, or t
  misc_feature (163)..(164): n is a, c, g, or t
  misc_feature (173)..(175): n is a, c, g, or t
  misc_feature (194)..(194): n is a, c, g, or t
  misc_feature (196)..(196): n is a, c, g, or t
  misc_feature (198)..(198): n is a, c, g, or t
  misc_feature (203)..(203): n is a, c, g, or t
  misc_feature (208)..(208): n is a, c, g, or t
  misc_feature (217)..(217): n is a, c, g, or t
  misc_feature (225)..(225): n is a, c, g, or t
  misc_feature (246)..(246): n is a, c, g, or t
  misc_feature (266)..(266): n is a, c, g, or t
  misc_feature (274)..(275): n is a, c, g, or t
  misc_feature (278)..(278): n is a, c, g, or t
  misc_feature (297)..(297): n is a, c, g, or t
  misc_feature (303)..(303): n is a, c, g, or t
  misc_feature (339)..(339): n is a, c, g, or t
  misc_feature (341)..(341): n is a, c, g, or t
  misc_feature (350)..(350): n is a, c, g, or t
  misc_feature (389)..(389): n is a, c, g, or t
  misc_feature (395)..(395): n is a, c, g, or t
  misc_feature (430)..(430): n is a, c, g, or t
  misc_feature (439)..(439): n is a, c, g, or t
  misc_feature (460)..(460): n is a, c, g, or t
  misc_feature (468)..(468): n is a, c, g, or t
  misc_feature (489)..(489): n is a, c, g, or t
  misc_feature (507)..(507): n is a, c, g, or t
  misc_feature (516)..(516): n is a, c, g, or t
  misc_feature (519)..(519): n is a, c, g, or t
  misc_feature (550)..(551): n is a, c, g, or t
  misc_feature (563)..(563): n is a, c, g, or t
  misc_feature (574)..(574): n is a, c, g, or t
aactctaaaaaacatcttttccacgcaaatntttttaccagaaataaataaggcggcattcaatgaaccagtctgtcttcttcctaaggagctnnnnngaggntctgcctctnccacctacgggctgggatccttcagctctnaangaagggttnnnaaaggnngggggtaannnttgtaggaacacttttttntngnttggnacttncagcttgtnagcttggnattgcatttacaatttttgangtttgttctagatatatttnttttcagnngantccagcttctggttcctantccagntttttcatcatgggttctttcttccctctctaactntnaagctaggntgataagctccttattcttagttaagaggattggttgtncaaaanggaagcttgtgttaggtacttttttttcttttccnccttggttnaggggctgaggggctggttcntgcttganattggtcagcgggtggtaagntccatggtcttcttccgntcttcacgntgntccttccagttttcgttaggctcatacgtgnntttgatgatggncacacgcttanttaggtttagggagttggggaagagcaggtagaagt

SEQ ID NO: 714746 - DNA, 781 bp, Homo sapiens
gtctctgggtgttttagggaatacccgggcaaaaaaaaaaaaaaaaaaaaaaaaaatgtgggggggcgggcgcccggagaaaaggcttatccataagacaaataccggttggggcggcggcgggcgccgcgaggacagggaaacggtgagaaacaggggcacaggacgcgtggtgcccataggagagaatctccggggcccggggacataggggggaggggggatgtggtataatcacatatatacaaaaaagcgacacgcggggggggagagaggcggagagcgggtttgtgtgtatagagagaaattcacaagagagggaagggttgtcgtgagtgggtgtcggttatatgtgggagatgtgtgtattccaacgcggggggaggtcgcgacaaatgtgagaaaggagtcggacgaaaatatgtaaacatatctaaaagcgcccgcggacccggggggggaactggggactaaaacaaagaaaaaacaaaaacaaaacaagaaaaaaaaaaacaacgaacacaacaacgcgggcgacaaagccgaagacaagacaagcacggggactacaccaacaccacacgaacactgacgaaaagaaaaaagagaacgcagcacggacgaaaaacgaaccacaccaacaggagcccacacaccccgccaaaccggcacgcgaaacacgctgacaccgcacaccccccaccgagacagagccacgccaccaccacacccgaacccaaccagacccacacgcacacaccccacccacaccaccacccac

SEQ ID NO: 714747 - DNA, 592 bp, Homo sapiens
gaagtgattttatctaatacagattttttttttgggggacagaatttcactttatcccccaggctggagtgcaggggcgcggtcttaggttactggaacccctggtgcctgggttaaagggattttcctgcctcagcctcctgggttgctgggattacaggggtctgccaccacccccagctaatttttggatttttcatagagagggggtttcaccattttggccaggctggtcttgaactcctgaccttgggatccacctgccttggcctcccaaagggttgagattacaggggtgagccaccgcacccagccagaaatcatttctatctccatttcatattgaacaaaagatggggaaggaaggtttcactttttatttcagggtctgaaacaggaggagggctgttcataccaaggtaaaaagcaagggactggtttgtcacttaacacctttccaaagggtaacctaaatgatctttaagggggagacaacaaaagcttccggacaggggtgggaaattaagtttatttggcgtaattaacagaggaaattttaagcttcctaaaaaaatttgggtacttgtatcct

SEQ ID NO: 714748 - DNA, 382 bp, Homo sapiens
  misc_feature (9)..(9): n is a, c, g, or t
  misc_feature (176)..(177): n is a, c, g, or t
  misc_feature (181)..(182): n is a, c, g, or t
  misc_feature (192)..(192): n is a, c, g, or t
  misc_feature (219)..(219): n is a, c, g, or t
  misc_feature (255)..(255): n is a, c, g, or t
  misc_feature (265)..(265): n is a, c, g, or t
  misc_feature (278)..(278): n is a, c, g, or t
  misc_feature (283)..(283): n is a, c, g, or t
  misc_feature (296)..(296): n is a, c, g, or t
  misc_feature (300)..(300): n is a, c, g, or t
  misc_feature (307)..(307): n is a, c, g, or t
  misc_feature (347)..(347): n is a, c, g, or t
  misc_feature (349)..(349): n is a, c, g, or t
  misc_feature (371)..(371): n is a, c, g, or t
  misc_feature (376)..(377): n is a, c, g, or t
  misc_feature (380)..(380): n is a, c, g, or t
aggagaaanaaccagaaactgtaacttcagtacatttcaaacggaatgtccctcaggtcaattagaaatgcaagacaaaatagcttcaattccgtttttttttcctttaaaaatacttgttttctgtacaagatacactacagtaaacactggaaatcattttatccctttctttnnttcnnattttttttnttcataatgcggttaatactagatttntttattcatctagttaatctgacaaaatattaaganaatttttacnagagaagggctancttcnccttggctttaancctngttttcnctccatttttttccggtttaatgttcccccgtgtgtgttncncgttctcttgggtttctttttnttccnnctncc

SEQ ID NO: 714749 - DNA, 652 bp, Homo sapiens
aagcagcggtatcaacgcagagtgcccattacggccggggaggcttccgcgagatcttcggtgggggtacgggtgatttacgccaggactgctgatgcagttgtgggtatctcgtcctgcagactactcgtggaccctggtcacggattcccataagtgtaccaacaaacagtagtcagaagcggccactggaccttctccagcggaggaaacgcaacggcttggggcaaggaatttgcggggcttggaacgcccaaacgcggcaaaattttcagattgcaaacgcctgttggcccaaaagggggggacacaaggggtttcttccgaattgatccacgtctttctttgagcctctatgaggaacactgacacctctgcaaatactatgagacacacggttattggccattctgtccggtgtttaagccagccaattggcccaaagggaatcctgggttggtgcggttaccgggccttgggccccttgctacttttcccacaacggcggtttcccatccttcgttttaaactttacacaccctttcacggtaattgcgaatatcacccccatgcgattacataattgcctcactttgtgccatttttgggcctgcaacaggtagcactgcactttcaagtggtactctacgtc

SEQ ID NO: 714750 - DNA, 373 bp, Homo sapiens
cttactgggaccatgctcatggggtcggaaaccgggtgccggcctgacggtgtatcccttggcattggcgccatcgatcaacaaacctctcgtggctaccggtacagtatcggttacgccacctgtccgaaccacgaagaacgcgtcaaggtggtgaaaatactcgatacgacgaggattcgggggaccaactgtcagaggagttccagcttcatcctggccagtccaccgacgccttcgtcgtacatcacccggagggcaactatttcaatgccacgtgagacgcacacagcgaccgccgaccgttttttcgccgctatcttgtgggatttcgacggtactctagtcgacactgagtcccgggaggtcgagg

SEQ ID NO: 714751 - DNA, 670 bp, Homo sapiens
  misc_feature (25)..(25): n is a, c, g, or t
  misc_feature (32)..(32): n is a, c, g, or t
gcggccgcctactactactaaattngcggccngtcggctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaa

SEQ ID NO: 714752 - DNA, 134 bp, Homo sapiens
  misc_feature (39)..(39): n is a, c, g, or t
  misc_feature (69)..(69): n is a, c, g, or t
aaacatagaggattggtcagtaagtgcagcaaaccaccnatggcacatgtatacctatgtaacataccntgcacattctgcaaaagtatccagtttgtttattttttgttttttgtggggttttttttagaaga

SEQ ID NO: 714753 - DNA, 664 bp, Homo sapiens
  misc_feature (64)..(64): n is a, c, g, or t
  misc_feature (68)..(68): n is a, c, g, or t
  misc_feature (89)..(89): n is a, c, g, or t
  misc_feature (100)..(100): n is a, c, g, or t
  misc_feature (117)..(117): n is a, c, g, or t
  misc_feature (120)..(120): n is a, c, g, or t
  misc_feature (125)..(125): n is a, c, g, or t
  misc_feature (130)..(130): n is a, c, g, or t
  misc_feature (150)..(150): n is a, c, g, or t
  misc_feature (167)..(167): n is a, c, g, or t
aaaccgccacagtaaccaccttcttaaaaccacatgtaaaatcctcctatcgaaaattaaatanaccnctagaatagtccaaatatcanctgtgtagcancaagatttgtgctcttnttnagagnccaanccaaagcactcctcttaaancagaaaatgaaaagaancctcatctaagattctgttcaaagcttagtactcgtgccgaattcggcacgaggatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaa

SEQ ID NO: 714754 - DNA, 458 bp, Homo sapiens
  misc_feature (25)..(25): n is a, c, g, or t
  misc_feature (32)..(32): n is a, c, g, or t
gcggccgcctactactactaaattngcggccngtcgatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaa

SEQ ID NO: 714755 - DNA, 99 bp, Homo sapiens
atggggagactgagtgaccctttgcttggatttgtgtcatgtggatgaaacagtgtctacctcctagtagcatgcatggaagtgtgctaacagttttcg

SEQ ID NO: 714756 - DNA, 340 bp, Homo sapiens
  misc_feature (48)..(48): n is a, c, g, or t
  misc_feature (80)..(80): n is a, c, g, or t
tttgccccgggggtggaatttacttcagatacggaacccccctaacanccggtttccaggaggaaccaataacttttggnccggccaaaacagagttggggaagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaa

SEQ ID NO: 714757 - DNA, 227 bp, Homo sapiens
gaggcttagctttcattatcactgtctcccagggtgtgcttgtcaaagagatattccgccaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaa

SEQ ID NO: 714758 - DNA, 605 bp, Homo sapiens
tcacggatcttacttcagaaatcgcggtcctgcatcatttcacggatccattgggtctaggacgcgccctcggcgtgacctggctgtcaccctcatcctgcagaggaggagcaccatggcgctcaaacagaacctcaacctgtcgatcttcgtcggtggtgagacattcgcgtcgaagattgccggtaacttctccgaggccattagcgatcccacctcgctgggtgccctcgtggcgtcggccctggccctgttcgtcattaccttcgtggtcgacgcgactgcccggttgattgcggcgaagggggttaagcgacgagcgccaccacccctgaccacatcacccaccatggcgacaacacgcccggacagctagatctctcccgcccgtctggtaaacggactatcaagagcggctgcgcctcagcattcatgatcgtggccaccgtactggctgttatcccactggcctggctggtcaacgcggccgtccggcgcagcatcggatcactattccacgcgtcgtgtaggaccactcgatggatcctccttcgacttggcgagcagggcgcatccacgctatcgtcggaaccttgaaatggctt

SEQ ID NO: 714759 - DNA, 702 bp, Homo sapiens
  misc_feature (106)..(106): n is a, c, g, or t
  misc_feature (137)..(137): n is a, c, g, or t
  misc_feature (141)..(141): n is a, c, g, or t
  misc_feature (162)..(162): n is a, c, g, or t
  misc_feature (173)..(173): n is a, c, g, or t
  misc_feature (190)..(190): n is a, c, g, or t
  misc_feature (193)..(193): n is a, c, g, or t
  misc_feature (198)..(198): n is a, c, g, or t
  misc_feature (203)..(203): n is a, c, g, or t
  misc_feature (223)..(223): n is a, c, g, or t
  misc_feature (240)..(240): n is a, c, g, or t
cccagggccgtataataacttagccacagtatcttctataacattcatcagtaacccttctaaacccatgaaaaactcaatcctgttcctatctgaaaagtggtanttctccattcatacccgggaaaattaaatanaccnctagaatagtccaaatatcanctgtgtagcancaagatttgtgctcttnttnagagnccaanccaaagcactcctcttaaancagaaaatgaaaagaancctcatctaagattctgttcaaagcttagtactcgtgccgaattcggcacgaggatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagaccagtagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaa

SEQ ID NO: 714760 - DNA, 461 bp, Homo sapiens
  misc_feature (271)..(271): n is a, c, g, or t
  misc_feature (280)..(280): n is a, c, g, or t
  misc_feature (283)..(284): n is a, c, g, or t
  misc_feature (303)..(303): n is a, c, g, or t
  misc_feature (306)..(306): n is a, c, g, or t
  misc_feature (319)..(319): n is a, c, g, or t
ccccacagctactggaatccccgctgttgctccaggccaagcttttggttgattaatgagggcatggggtggtccctcaagaccttcccctaccttttgtggaaccagtgatgcctcaaagacagtgtcccctccacagttgggtgccaggggcaggggatcctcagtatagccggtgaaccctgataccaggagcctgggcctccctgaacccctgggttccagccattttattgccagcctccttgtggaccttttggcccccagcccnttccccacncanncccagaagggtcccaaagntgncccccctccaggncctaggcccagcccctcagcctcatttggagccccttaagaccagtcccccccccctttttggcctcatttgaccctgctccgcatcctgctgtgtgtcctgttccatgttccggttccatccaaataccctttttggaaca

SEQ ID NO: 714761 - DNA, 162 bp, Homo sapiens
gcggccgcctactactactactactgctcgaattcaagcttctaacgatgtacggggacatgttggggtttcctttaccttttctataagttgtaccaaaacatccacttaagttctttgatttgtaccattccttcaaataaagaaatttggtacccaaaa

SEQ ID NO: 714762 - DNA, 246 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactcgagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaa

SEQ ID NO: 714763 - DNA, 151 bp, Homo sapiens
tggtaatagccgtgggcgtttgataggatcttaccatgtggggggatagattggtataacggaataaggtggataagactgtgttggtggcgcaacctggctgggcgatcctcgtggaccggccgagccggtcggaccactggcatggtcc

SEQ ID NO: 714764 - DNA, 1131 bp, Homo sapiens
  misc_feature (74)..(74): n is a, c, g, or t
  misc_feature (77)..(79): n is a, c, g, or t
  misc_feature (83)..(83): n is a, c, g, or t
  misc_feature (99)..(101): n is a, c, g, or t
gggaacatgttatcacactcatgaatctgctaacctcaacgtgggcattttccttcacgatatccataatccanacnnntctnacttggaaaacccctnnnatgcaatggagtgtgcattacatttggaaaaaaatgtgaatcagtcactactggaactgcacaaactggccactgacaaaaatgacccccatttgtgtgacttcatgagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaa

SEQ ID NO: 714765 - DNA, 376 bp, Homo sapiens
cgtcgacggaagaggttttatatgatggagaatctttttaaagtaaagattaataatttttagttgtgtgcctgcacatgtggggtgtgtgtatgtgtgtgtgttttgagtgtgtctgctacagcatgtgtgtggagattagaggaggacttatcaatagataaaatgaaattatactcatcaaatgtgtgtgtgtatatatatagattgcaaagactctactttggagttagagttccacccagggaaacaaaatgcccagagagaacaacaccacagatccacagaagttcattaccagtaaaacgtaagattaacaaaaatgaaggtgtgtcaaaccaggtcgacgcggccgcgaatttagtagtagtaggcg

SEQ ID NO: 714766 - DNA, 1121 bp, Homo sapiens
  misc_feature (32)..(32): n is a, c, g, or t
tctagaggatcccccaacgcatgtgccgctcncccaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcatgagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaa

SEQ ID NO: 714767 - DNA, 901 bp, Homo sapiens
acgagaaacatcttcaagatctacaagacatttttgatccatctagaaacatggcaacgtatagaaatattcttagctacgtcaaacgtatgcagcctccaatcacttccacctcttccctgttgtcacacgaacagactactgaccctttctaccatgaacggaaactgacctccaaacgatacgactggctttcagtaaaccctttggacacacgttaacgacactgactttccaacggacacactccgccaacgttgatctcgacattgcactttactggcttacacactggaacaccaagctcatgaatgataacggacacaagaacgggtccaccttgaagttcccacaggcacacgccaccaaccattatccaagaaacccatctggcctatggacacttaggtcaccgaagcacggcacgcgtttggcctaccaacccacacacataacaaatgagagcaaaccggcccaagcaaaggcatccctcacctggccacataacccactgtgccccccaaaggcaacaggcacattaaattcacttgcaagcggcacttggcaccaccaaaaaagtaggctcacaaatagcgacaccacgcgcctggaaacaccaaccacgacataacttcctatttatatccaccaaaaggttctcattcccggcacactggattcacgacaagcgctaacccaaaacgacaactctgccccaaggctggcaacgttacaaactgtgttatccgccagactggcacagtatggaaaaccttagtaatccccacgtctttacaagccaatactgattgggcgtggcaaatgagcccccttctgccacacacgtataaatttgccagaacttaccgcccgcttagtgacacccccacgtacaccgcca

SEQ ID NO: 714768 - DNA, 223 bp, Homo sapiens
ggatatttggatagctttgaggatttcgtggaaacgggattgtcttcatataaactctagacagaagcattcccagaagcttcattgggatgtttcaaattgaagtcacagtgttgtaacagtcccctttcattagagcatgttttgaaacgaatctttttggtagtatctgggaagtggtcattttggagcgttcctcaggactacggtcctgcaaaatgtt

SEQ ID NO: 714769 - DNA, 287 bp, Homo sapiens
gtcagggcgagtgagtaaggggcctccgtgtatgaggtacggagggagatgaaccatacaggagactgagaggatgtctagggcataggagaaaaaccgtaagagtatagagttctggaagtcacgtgtggaaagtgtttcacggaggaaggtgtgatcaactatgttaaatgctgctgatagatgaggaggaagtataaccaggttagcaaagtggagattattgatgaacttgaccaaagcatttttgttggtgtggtggaggcacaggcctgactgaagtggat

SEQ ID NO: 714770 - DNA, 1208 bp, Homo sapiens
  misc_feature (187)..(187): n is a, c, g, or t
  misc_feature (492)..(492): n is a, c, g, or t
  misc_feature (565)..(565): n is a, c, g, or t
tcaagtaacggacaaatataggaaaccagaaggagggagccccgaggctgtgggacaaatctctgtgggtataccccttccccaacagaaacagggggaggagggtggccccttacagcccttttagtgggtcgatttcgggccccccttgtgctcactctgtggtgtgcgagaaatctccttgagngaggcgagggccccaactctttccctgtgggaaccgtggggatagctcggctcaacccaagcctgtgccaagtgcccccaagccccttctttccccaaaaagaagagttattcttgtggggggagggagaccgggtggcgcaagacaccacggacgcgcaatgtgacgagatgtagacacatttgtgccgcgctgtggtatacgccaggcacgccaatgtgcacgggaatgtgttcagaacaacatgtggaccacaatgtggtgacacaaagaaacaccaacaacaaaactgtgtgtcacacagnagggactacgttgtgggtagaaaacgagagaggagaacacatagtgtgggacccccaagaacacctgtgtggnggggcgcagagcggaatcgagaccgcacacgagagggcggcgggttgtggaagaacgcggcggccaagggggtgtgagcgcctcccgctggagataatcgtgggctgtgcccccacatctgtagacgcgaagcgggggggagacaaatggtgcgcttagacctctggggggagagaacacgccaaaaaggataggggtgtatacggcggcaacggcaacgcctccaaatgaacacacacctttcaacggtgtggcgcgtgggccaaacaagggggggcctcatttgtggggcgcccactccaacacctttgggggacacgaacaataaagggtgttagaacagtggggcagttcgttaccaaatcttcaagcaccaacatacaatatgtgtggttaccgtctagaagaaattcacaccaagggggcggcgagaaggcgggcaccaggggggggggtctttgtctgtgccccaccacgcctggaaacaaaagcgggcgactaatcggggggaaactaccaacccccctaacgggagaattacccactgggatatgcaccaaaagagggcggcgtctttttccacaaaccatcagaattagcggggggcacatacggcagacaaacaattgtggcggagcaaagg

SEQ ID NO: 714771 - DNA, 977 bp, Homo sapiens
  misc_feature (19)..(19): n is a, c, g, or t
  misc_feature (85)..(85): n is a, c, g, or t
  misc_feature (106)..(106): n is a, c, g, or t
  misc_feature (176)..(176): n is a, c, g, or t
  misc_feature (260)..(261): n is a, c, g, or t
  misc_feature (264)..(264): n is a, c, g, or t
  misc_feature (275)..(275): n is a, c, g, or t
  misc_feature (283)..(283): n is a, c, g, or t
  misc_feature (318)..(318): n is a, c, g, or t
  misc_feature (353)..(353): n is a, c, g, or t
  misc_feature (392)..(392): n is a, c, g, or t
  misc_feature (412)..(412): n is a, c, g, or t
  misc_feature (415)..(415): n is a, c, g, or t
  misc_feature (419)..(419): n is a, c, g, or t
  misc_feature (423)..(423): n is a, c, g, or t
  misc_feature (429)..(429): n is a, c, g, or t
  misc_feature (433)..(433): n is a, c, g, or t
  misc_feature (439)..(439): n is a, c, g, or t
  misc_feature (459)..(459): n is a, c, g, or t
  misc_feature (465)..(465): n is a, c, g, or t
  misc_feature (467)..(467): n is a, c, g, or t
  misc_feature (548)..(548): n is a, c, g, or t
  misc_feature (563)..(563): n is a, c, g, or t
  misc_feature (615)..(615): n is a, c, g, or t
  misc_feature (632)..(633): n is a, c, g, or t
  misc_feature (638)..(639): n is a, c, g, or t
  misc_feature (807)..(807): n is a, c, g, or t
  misc_feature (822)..(822): n is a, c, g, or t
  misc_feature (874)..(874): n is a, c, g, or t
  misc_feature (877)..(877): n is a, c, g, or t
  misc_feature (905)..(905): n is a, c, g, or t
  misc_feature (973)..(973): n is a, c, g, or t
gcaaaatgggtcgtaagtnaaagacagaattgaacactatcctctgagtgtgtgtggatatgtctctgtataggcaagtgtctgngtctatagatacttttcgctnttttgatagtgattaaagcgccactttagtgaatggataaagtcttattctaataatgcgaaaaccagantcaaatacgccccgagtccaatgccctccccgccccagcctgcctccctccatccctcccggaaggccgcccccccgcccccannaangccagggcctnagacagcnccagcattcctactgagaacccagggatggatgcnggctcttatatccctctgacctataccccctgggngaagagcctctcgggcgagggggggggcaggaggagtcntgggagtggcgcgtcagagnggnggantggnacctgngganacctcngcgggagggtcaggtgctgngagggngnggtgttcggggaccatggagacttgaagcggggcggggccctccgaggagtcagcggagagaagcgtatgagcctttgccntgtcttccatctgcnttgcctctccaggctctgaagcaacctgagatgtcatgaaggggggggaagnacaaagtgcttcagggnncgganngtggatgttttcattttctttggcctcaggagttcttactggcttctctggtggttctggattaggagagacctctagggaggtcctaggacttgcagtcccagtccccaaggaggccctagggctggtgggtgaacccctccagaggctgtagggctggaaggtatntccctgaggagggcntggggcttgcagtggctctgggtggaggagggcctactaggggggtgctganggnctctggatagaggctctcttcttttggntggtcagatccttcacttgcggtgcgggttcggaggactacttctgtggcagatgatgaaggctgccngaag

SEQ ID NO: 714772 - DNA, 138 bp, Homo sapiens
  misc_feature (4)..(4): n is a, c, g, or t
  misc_feature (23)..(23): n is a, c, g, or t
  misc_feature (123)..(123): n is a, c, g, or t
  misc_feature (125)..(125): n is a, c, g, or t
cagncccatcatcccccctgctntgagcgctcaccctgttgaaggctcagcccctcaaccggtggtcattctgggggaggaagtggggtcccacagctctccgccaccggaataaatccctcntnccccagtcggaac

SEQ ID NO: 714773 - DNA, 141 bp, Homo sapiens
gtgagctgggatcctgacagacccaggcccccttcccatcaccctgtgtgggagggcgcgccccagcaccccttccctgtgcgatgagaaagcaccttccttaagaccaaagaaaggctctccctctgcctgagggagtgg

SEQ ID NO: 714774 - DNA, 205 bp, Homo sapiens
gagctaatgggcagcagtcagctggggtgttctgagggatgctcatctttatacacgtcctcccctcaatgtaacttttggctgttttacacagagatacaggtagaccccacagaggagaaggaggggattcaacagccttaatgtctggtagcagtgagatttggtgattgtccggggggatccctgggtttccctgggtacc

SEQ ID NO: 714775 - DNA, 359 bp, Homo sapiens
cagactgaacgtagaagcacgcattacagcatagcaccttgagttatgccctagacccctgcaagaaactaccctacaatctcatagcaccatggggcgtacagacttgagatggatctccagtggaagtgatttgtcggatgaagatgagacatttgctcagttacagagagccaagttctagagaaattttaccagctatctcatcagattgttgaataagaagcatgatacggaacactgtcctactcattgattcagaatcccgctcatcaataccacgtgcagtttgcctcggatgtcagacagattatggaaagactgatagatcctagaacaaaatcactagagaccatttg

SEQ ID NO: 714776 - DNA, 423 bp, Homo sapiens
aatctgatcactcccgtagggatgcatagacggctagcatgatgacttggcttgttaaagtcgcagacaagggagccagtcctcaattgtataatgatatccacttacttggtttgtttgtctatttttgagacggagtctcgctctgttgcccaggctgcagtgcagtggctcactgcaacctccgcctcccaggttcgagcaattatctgcctcagccttccgaggagcgggattagagacgaccaccaccaagcccggctaatttttgtatattcagtagagatggggttcaccatgttaaccaggctggtcttgaactcctgacctcgtgacccacccgcctcggcctcccaaagtgccgggattaccggtgttaggcaatgcggctggcctgttagatctttatacgcaacaccttcc

SEQ ID NO: 714777 - DNA, 259 bp, Homo sapiens
tcgaggcaggtttgtacttgacgcagaatatgctcactcaatgactgacatgcccaccacgatttccatcttatcacagtatgctttatatcttgtaagatattaaatatttgttctcctcacagctcaaatgtcatgcaatttcgatctcagatgtgggtcagatacctataaatctcctgaggtagtcgttgaaatgacttttttttttcttgagacagagtgtcactctcaaccatgctgaagtgcaggaaacaag

SEQ ID NO: 714778 - DNA, 102 bp, Homo sapiens
tgtactattgagggaagctagatgaaggctctatgagaacacgcattatttttgcaccttgtctataagtgtcaaattacttcagacagatcacccttcgtg

SEQ ID NO: 714779 - DNA, 106 bp, Homo sapiens
  misc_feature (104)..(104): n is a, c, g, or t
tggtaatctttattagtatatgatcatcctcaagggctcacttgctagccttttaaacaaatttctaacaaatttacagttcatttaaaaggtaataaataccngg

SEQ ID NO: 714780 - DNA, 182 bp, Homo sapiens
agatctgccagactgtacaggtagcccacactgcacggggtggaggcacttatgtaggtctgtatgataagctggcagtacagctcgtcccgcagaggtcgcaggtcatagccctgatctagtaggcatgcccaggaattattaggaatatgggtcagacatgtgactccagatagcatgca

SEQ ID NO: 714781 - DNA, 813 bp, Homo sapiens
ctgggcgtattaggcgcggtgctcgcgttgtgctgcagtcggatagtctggcggtggtgttcccccccccggtgtgtgcggattttttggtgctcgggcgggggctttgtctgtggccccgtgtgggtggtgtggccccccccccccggagtggcgggcggtggctgggtttcacccccgcgcggcagtactccccggtgtgtgcgggctgcttggggggcctgggtttgtgtcgcagtccgcgctggggtgtctttgcggccgctccttgtggcgcccccccgcggtggtgttctcccgcaggttgtgggccgccccgcgccttcaccctccggggggtctctgtgggtgtcggcgtcctctccccaatagtggggcgccggcccgctccgccctttttgtggtgcgcgcagggggcgggcgcttccctcctgtggtgtttctctcgcctccgctgttgccccgcgtcgtaggtggtatgccgcccccccccgttctttctttctttcccccgtggtgccctccccccccggggggcgctctttttttgtgtaagatgggggcccccccccctgggggggcgtggtgtttcccccccccgggttttttttatgagagggagagttctggctcttccccctcccgtggggagaggaagttggttttcgtctccttcctttttttctctctgtgtgtgggcgccccccccccgcgccgtccgtctcgcgttgccgcggcccctctccccccctccccccccccccccggtttttaacaaacaaaaaacacaccccccccctgggtctgtttgta

SEQ ID NO: 714782 - DNA, 603 bp, Homo sapiens
gggattacaggacatgagccaccgtgcgccggcccgttgaatcctgcttttgtaaaacaaccttaggattttgatatatccagcatatggacaaatccatacatcacagaatgcagatccgtcgtgtccagtgtgctaggtgcggtcaagatggaaactgcctgaatagagcgggcgtttcctcctggggtgaccagcatgttctgcagactagcagatgatgcgctgtgccaccattgtagagggtactaaaatgccgccgaatggtacaccttaaactggtcagattttatagttatatgaacgtcccttccatacattatttgaggctgggcacggtggttcacacctgttatcccaacagcttttggaggccgagatgggtggatcatctggggtcaggagtttgagaccagcctgaccaaagtggtgaagccccgtctctactaaagatacaaaaaggttagctgggtgtggtggcgcatgcctgtggtcccagctactcgggaggccgaggcaggataatcgcttgaatccgggaggcagagattgcagtgggcctgggtcatgccattgtactaaagcctaggtgacagagcaaat

SEQ ID NO: 714783 - DNA, 397 bp, Homo sapiens
  misc_feature (68)..(68): n is a, c, g, or t
  misc_feature (98)..(98): n is a, c, g, or t
  misc_feature (106)..(106): n is a, c, g, or t
  misc_feature (113)..(113): n is a, c, g, or t
  misc_feature (166)..(166): n is a, c, g, or t
gttgttgtataaattaattacaaaatgactaatgttaattttacttttattagagatggtagaaggantgaggatctggggaggagaaaggaggaaantggaggantgtgaangtggttatgttttttttaatggagagaaaaattaattggatttgggcactccntacatttttccacctcctgccgcccccgtgagccaatgcagggagatttttttgaataatggaacattttcctgttttaattagatgcaattttgcaagcagtttttatgatttagcaagtccattaaaaatggcatttgttttggtttgacacttgaaagggggtccacagagcataaacattggaaattacttgtagggagagacaatattaaaattccccagcctgga

SEQ ID NO: 714784 - DNA, 372 bp, Homo sapiens
gtcgacggagggtagatcacttgaggtcaggagttcaagaccagcctgaccaacatggtgaaacccatctgtactaaaaatacaaaattaggctaggcgcggtggctcacacctgtaatcccagcactttgggaggctgagatgggcagatcacaaggtcaggagatcaaaaccatcctagctaacatggtgaaaccccgtctctactgaaaaaacaaaaaattagccaggcatgatggtgggcacctgtagtcccagctacttgggaggctgaggcaggagaatggcgtgaacccaggaggcggacttgcagtgagccgagattgggccactgaacccaggaagcggagttgcggtgagcgtagattgggc

SEQ ID NO: 714785 - DNA, 125 bp, Homo sapiens
cacgaggactcactcttctatatctacggctcacatttttttggccacaggcttccacggacttcacgtcattattggctcactttcctcactatctgcttcatccgccaactaatatttcactt

SEQ ID NO: 714786 - DNA, 194 bp, Homo sapiens
aaattgtgggtactgtggatacaagttattttctacaggtagactgagataaactgaaaactcaggtgctggcatcaaactcgtagtcccatagtcagggttaattacacacattgttaactattggatgaagaatacatggtattgattgtgtgcaaagcctcccgacggacctccggggggatgctctggta

SEQ ID NO: 714787 - DNA, 195 bp, Homo sapiens
gagatccccacgttggcctggtctgacccaccggtccctcaactggctggctcatttcggagagatggcctcaaaggtccgcctggagtacacagtgaccactgagccaggagctggacactagctggcatagtgtctgagaaagccagggtaccgcaggctcgaattcgcttatcatcgatccatggctgcttt

SEQ ID NO: 714788 - DNA, 1109 bp, Homo sapiens
tttcagaacagctgtctgcaggcaacgacctatcatgttgaccctctggaggagagcgctgtgcgagcccctcggcgtgattccagctccgactgccctgatgcctattatatacacatgcggttctatccatactgtgctgtttatctgtgatattcatcgttgacaaccatgtctctcagacgaggcccaaggaccaccttggactccttatcacgacgcacccaaagcacccttcagaccaagcttcccaatgcctgtgaactcactcaccattcggacaagtagctcaccgtgttacacccttcccttcatagtatacacagaagtttaagttaagaatgagatatttatgaatttaagcatggatcagtacacaggacagagagcatcacgccagggccttgaggacaggctgaccctccgtaccccggggtggcagtaggggctgggagcacccatccgacaggacagagccctccttacagaaagtgcagctcaagtcttaaagacaccaaaacatgagccatgggcacgcagccgactacccgggccatggcgttcacatgcagggcagggggcggcaccgctcccctgatgactgcatcccgcactccctgggggacctgacctgtggcaggcacggaatggggggcccccagagcccaggacgagaaggagccagcggacgacaaagcagcaaacaacagatagctccaacggtagcccctgatcgaagtcttgccatcagaagtcacaggcccatgtagctaaagcgggcgcaatagtaacaaaggacatgccaactggaggcaacacagaaagtaaccaaaaagacgacgagaaagaacaagcgagaccgggagaaccctgcaccagaaaaagtgagaagaggacgcaacgtggccgtcgcacacgataagatagaaaccagacacggagaggaccagaacaacaagacagagaaggaaaaacaaacaaatgaacttagatacacacaaaagaaaaaatgacaaaaacaaagagagaagaacaagaaggggaagaacaaagcaaagaaagagaagccaccaagaggagacgacggacgtcctctactctcgtaaaaa

SEQ ID NO: 714789 - DNA, 395 bp, Homo sapiens
aaggtatcgcccaacactggtggcatctgctcctgtgacagtgaatctgtagagcaaaatttctcttcaaccgagagcatctgttcccaatggaggcacaccacctaaaatcagcaaaactgtacttttatctactaaaagcatgaaaaagagtcatgaacatggatccaagaaatctcactctaaaaccaagccagctattcttaaaaaagacatagcagtaaaggaaaagattcctagtcatcattttatgccaggaagtcctaccaagactgtgtacaaaaaaccccaggaaaagaaagtgtgtaagtgtaagcgtgctactcaaaatccaagtgttcatacatgccgaggccaacgctgcccttgctactctaaccgcaaagcctgcttag

SEQ ID NO: 714790 - DNA, 135 bp, Homo sapiens
agcgagcgcacggtatgttggacccacctgtgtagtctcagctacttgtgatggctgaagcaggaggctcactcctaggaggtcaaggctgcatgtgagctatgatctcaccactgcactccagcctgggtgaca

SEQ ID NO: 714791 - DNA, 223 bp, Homo sapiens
  misc_feature (151)..(151): n is a, c, g, or t
  misc_feature (218)..(218): n is a, c, g, or t
agcccctgaaaccactgtcctactctgtttctgtgagctgtgacagttttagatccacatatgagtaacatgcagtatctgtctttctgtgcctgggtcgtttcacttaacataatgactttgggttcatccactgttgtcacacatgacnaggatcatccttcgttttcactagctgaataatattcacgttgtgtacacacaaccagcattgtcantctaa

SEQ ID NO: 714792 - DNA, 465 bp, Homo sapiens
  misc_feature (28)..(28): n is a, c, g, or t
aaaccttgagccctgattcgggcacggnagaccccaaatggcctatggacggggccatacttgagggctctaagaaaaagagaactcccgagccacgaaagctgaagccaaagcgaacgctcaaaacgccaaaaaggcaggggtgaaaggtgaccacagcccctaagagaagaagatccgagcgggacccacctaccggcggccgaagacacagggactccggagacagcccaaagaggcaaggaagagcgcccccaggagaaacaagcttgaacactatggtatcatcaagttaccagtgaccactgagcctgccatgaagaagatagaagacaacaacacacttgagcccattgaggacgttaaagcccacaagcaccagatgaaacaggctgtgaagaagctggaagacattgatgtggccgtcaacaccctgattcggccagatggaggggcattgttcgc

SEQ ID NO: 714793 - DNA, 1381 bp, Homo sapiens
  misc_feature (705)..(705): n is a, c, g, or t
tcctggctcaccgggactaaaatggaagcgttttgggggtcgcggcccggatttggggcggggggtccggccccaggacagtttttaccgcatttccattccacttccgcgattcctttcagtggactccgggcgttcgttgcacctttacaggaggtccaattcagcggcggaacccagaaaccccatgtggttgacccgggacctcagtctcctcgggcgtaaagttccgagggccggagtgtggtgattgccgcaaactgtgcggggactccatagggctctccttgggcctcgttctcccgaaacattcttcttcgcatttagtgcgagttcaacaacagttaccagtgcgtggggtgccctcgtgggcgacatacgctgatttctccagttatttgtgaagcagagtttctgcggccaagattggggtgattggcgactagaggagagccttttcttggggagaaatattggtgaccaccagcgctatatataggctccctatagagacgcttattctcattctcatgggggcttagacccaggggggccaatttgtaccaacgccgggcgcgccctcagaaaagatttgacacccttttgtgggtggaaaccacccatggggctctactcggagaaggggcaataatcggctagattggagaagaagaagctctccccctcgggtttattgttggcgancatttcgccttcgtgggtgtgtaccgccatattatgaaaggcccccttttcggttgtgggccccacttgcgtcttattgggggggcaatatcttgtgggctcacagccctctgtgcttggcaggacagaaatgtgtttctggagaaagaaagcacaacgccagatgttgtcataacagggcccaaagaactcggaggggccccggcggaactataaggataaagaaacgcggtctgcagtgtcgacagatagttggcgtggaacaatcaccccggagaaattgcccgcggttttataaccaaacccggcgtttttcaaaaagttccggcccacttgggtccaccccgaaaacgaggatggttgttgtggcaacatttagaccgggagcactccatgtgggtgtccctcaaacgaagagaaacacccccaactggggcgaataagtttggccccccacaatgttaatccaaggccggcgtctgcggcaaacttcgacaaattatccacgaatgtcgtctttattcccccgaaaatcgttggagaagtttcttggcccctcaaactatttgagaacctcttggaaaacctgtggtgtctgattctccaacggaagattacatcatcttttctttcgtggtccagacgcaacacatcaacattttcttcccacagatgg

SEQ ID NO: 714794 - DNA, 158 bp, Homo sapiens
gacagatccatacacggatcccctcttctccgaaaggcaacatccctgccccccttttcccaccagggtagtctgtacagagattatactacgatattattttttccttttcacttttctcagagatggggtcttactatgttgccttgcggagaaga

SEQ ID NO: 714795 - DNA, 206 bp, Homo sapiens
  misc_feature (17)..(17): n is a, c, g, or t
  misc_feature (81)..(81): n is a, c, g, or t
  misc_feature (84)..(84): n is a, c, g, or t
  misc_feature (122)..(123): n is a, c, g, or t
  misc_feature (199)..(199): n is a, c, g, or t
gtttttttttccctccncccccccgcccttttggctttttttaatccacctgtgggcccgagtgtttattagatgtttttnccnaaaagatttagaaaattgggttttcctgccgataaccnnccaaatctttttgttacgtaaaaaaagccgttttttttttgcttgtgccccccccgttttagtgatatttaagggnttgggga

SEQ ID NO: 714796 - DNA, 137 bp, Homo sapiens
  misc_feature (53)..(53): n is a, c, g, or t
agtattcatccttctcaggcatcagtcagggcaggctcatgcaggtgtgcccncatatactagtattcctagaagtgagatggtacatgctagtataatatttatgtaaatgaggggcaactcgaaagccccaagcg

SEQ ID NO: 714797 - DNA, 446 bp, Homo sapiens
ctctagagtatccccctggcaccacgcatgggaggtaggaatagatacattaaggttaaaatatagtatataaagaatagactaaaggtaaatggaaattctgatgtatatgctgtagttcaggaactctgctatcttacctgtactttaccaatagttctatgacaagagatcctaatgccagaaatagaggtcaatcacaggatttctccattaaagctgtcactagccattattactatccccaaatgagacatgactctagtacatttatagcaatatctgaatgttattaatttcttatgaatttcattattctcttgtcatatataaggatcatagagcatttgccccataatgattttgatcttttttttccaagcaatactatgtcctacagaatgccacataaaatctatgatgtctatggctataaaactgtgaag

SEQ ID NO: 714798 - DNA, 883 bp, Homo sapiens
  misc_feature (164)..(164): n is a, c, g, or t
ttccaggacaaccgtgtgcattgtgtgcccccaatactcgggggccagaaatgattgtgtttccccacggatcgtaacaaaagccgctgccccacactctcacccgcgttcggtatggtgcgggagccgcacccttcttttacccacccgcctggtggcgggcnccctccatcggaccctctctcgtatagacaccacgcttccgccgtgagccaaacttctcttccctctcgggagtggctctctccagggggggactctcctaccctccttgtaatctgtagccgccggcttttctaccccccgcgcagggtctctcatgttgcaacgtgctcctctctcgttggacccaccccagcgcgccacctcctacagcaaagacgccgcccctccctccccccggcgaccccacacagacagggacgaccacctctgctgacgacccgctccactgctcgctcacgagggccgaaagcacccaaccacctgtggcgagtagaacatccccacagataaaaagaactcccccgcccgacgacacacacctccccgcgcggttaaacgcctcccccgggcacgcactctcacccgctaaatcaggctgacgacgtgcggcgccccaatcactcggtgccagagcggaaacgtcccgcttgtcagcacacaccccgaggccggtgcagagcacatccgcgcgacgcacccccacacagatgggccccctcggggcagagacctcgccccacccggacagggaggaccgtatgcaagatagcacaagaaggctagatgcgcgggatgcgcgcattcggattccatgacgagcgaatatggcccctgcaccgccacaaaaaacacctttccccctttcccccccaaaaca

SEQ ID NO: 714799 - DNA, 170 bp, Homo sapiens
  misc_feature (8)..(8): n is a, c, g, or t
  misc_feature (12)..(12): n is a, c, g, or t
tgtccacnaagnttggagtcatttataacactatctcttcctcactccatgttcaccaaatccttttgattttactattatacaagctctcaattccatctacttctctcaaccctcactgccatagatatacttcaggttctcatcatctttcatctaaactaccacag

SEQ ID NO: 714800 - DNA, 136 bp, Homo sapiens
gctgcggcgtacctgctgagtccagaacccccaggggccatggcaggaggccgctgcggcagccgctgcgtttctgcaccatttccgaggacgacgcagcccgtcgagcccccccactgacaccggccgccccagc

SEQ ID NO: 714801 - DNA, 265 bp, Homo sapiens
tattctaacattatgtctggggctagatgtcagaacccacgtaatgacagaagtcagtggtaccagcctaatatagtggtttgttatttataatgatcaattagcgtataaaattgcatcatctatttagttcaggaggatctttcatattcatgttcatccttaagatctcgaccgccaggtgcttttataaaggaaacattttttagagacgtctgagctcacttttacatggtggtgcctacggccgttaatgttagagata

SEQ ID NO: 714802 - DNA, 295 bp, Homo sapiens
ctggcaattgatcagccattattaaagggcacattggatccactcagaatcttgacaaacccgagtagttctccctatccccgtatctatgcctatgattactttgcgcgtgtatggggctaaacctctggcgggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaa

SEQ ID NO: 714803 - DNA, 453 bp, Homo sapiens
  misc_feature (32)..(32): n is a, c, g, or t
ccattatgctaactgaattagcccccattccngaaggccaaatactgtaagatctcacagatgtgtggaatttcaaaaagcccaaactcacagaagccagagtaggatggtggttgcccagggcctgggacgtgggggaaatagggagatgtttggtgtctgttaggaagaatgaataagctctggagagctaatgtacagcatagtgactatagttaatagaaccgtattatatacttgaaatttgtgaagagagtagatgttaaatgttttcactaacaacaacaacaaagataattgtgaggtggtggatatattaacttgattgtggtactcatttcacagtgtatacatatgtcaaaacatcatgttgcatactgtagatatataccatttttgtcaatcattcctcaataaagcaggaaaaattattgcattttccacatcaaaaaa

SEQ ID NO: 714804 - DNA, 1368 bp, Homo sapiens
gatgactgaacactagagaacccacctctttactctcaggacacggacaactctaggtattagaacaagtcacagcagacgatactgccagactcacagtgaacgaaaacagaacgagttcacgacgacgtccagagctcatcgcaacaggcggttctagtcagcatatcacacacaagcaaacttgatgaaacaaaggcatttcaagcaaacaggcagtcaggaacccaaaaccacgtcctgttagcaagaaagtcaaaagttatagtgtggcatacaaactcaagcactttccctgccaactgtgttctctatcatgtgtcaatagcatgcaacatcagcagaacccacttcattgtgtactaagggaagggacaatcatcagtgttaagcaaacagtctaaagccagcagcatcatggccaaagcaatccaccagtcggacagaacacaagagcaaaccaggcctcacaacagcaagtccaggcagcctcatgggcaaaagggtgcgcttccaagcccacgcatatccaacaaacacagcacaaggtcaatggacacacgcacacgggacatattccaccactccattcatagaagcgacaatcccagccaaaaggggaccctttgtacgacctcggggtccataatagggaatggcacaaccgtacaggacgcatcaaggaaagaacgacacgggagccattacattcgggcatgggtcaacacgctgggatcacaaaaccgcaacaacaagagctccatagggcattccaaagaggaaggcgcgatcttcacaagtgacgagcatttcaagcaggcaaagcgcggaaaagaaaaaacacaaaaggaaaaatggccgacacggacctccaacgacaaatatggaccgtcccaaggaaaaaaggggacagttacccaaggtatcacagtaacacaaattacacgagaaccatcctaacaacgaattgggaccaagcaactcacccgaccgggtgtgccatataacagcaaacacactgagacccatggagtagacaacagaggccaccccacgtggggcagcggtaggctggaacacaactaccccgggagtacacgggaaaccccaccgtgcccttacgacacgacacaacagcgaagagataatgacgcacaagttaccacatgcaaactacatactagcgaaagccaagtaggcgagaaaaaagggtcccacaaacaggcaaacggccccggtgaaccgtgagccgccacctcgacaaccgggacaaccacaaaccacgaaacacaacaacacccacacaacaaaccaaatacaccacaaagagagggtaaaaactagaacgagagagaacacacgaaaagc

SEQ ID NO: 714805 - DNA, 1134 bp, Homo sapiens
  misc_feature (261)..(261): n is a, c, g, or t
attctagaggcgaggcggccgacatgttttttttttttggacgaactttttgttttttctggaaacgggggtctcgtggttcccattggcccagaaggtggagttgcaggggcatgtgactcacagctctcatgtgcagccagttaactccttcgtggccttaagccttcccaggttagtcttagaaacttacgggtgtgtaccaatatagtgcccgtgcgatagttttcttctccatttttgtgggtagaagaagacggnggggctcccttttttttttcttgtgagagagagaggggggagctctcccgcctcgtgtgtcgtgcgcccagacagggtgtaaagatatggcgacacccgactgggcacagtgggaaactctggggggggcgtcgcacaaagacaagaggactatctgtgtgctctcttcaaaaaaaaacacaaacaacaaaaagaagcgcaaacactttttgggagaaaatgtgagattgtgcgaaaaatgtgtgttcgtgggaaaactatggggcggatgtggggcggggggaaccaggttttacttgttatatatataggcgagggggcggagactcttctgtgggtggggcaatggggggaaataaaggcgcgtctttttttgtataaagagggcgatataagagatctctccccatatatataaaacagcggggggggagtgtttctccctcttcttttattatattattagatgagggtaggacgaggagacagcgagtcagcgtggggctatactggagggaataaggggaggtatgagagaatgagagtgatatataaaaaacaaacatgaagttaccccacggtgggttcataagggggggggcgccacaggggggtataacacacgtggcgaacaaattatcccgccggatggagaaattatagagaggggcccatgggagaatattttttccaacacacttatgaccagcagggggggacaccccatctagtgagcgagaggcacaattaggtggagacccgccgatgagggacgcaaaaacaatagcctgctaagccgcttatgaacaatcacttctggattcgaattaagcaccgagattttttctatcccaccaccacctgactatgttg

SEQ ID NO: 714806 - DNA, 155 bp, Homo sapiens
cgctgctggattagggtctccccgaccgacctggtctcagcaagtggtgcccattcatgggggctcgaatacaggtcaaaggatcgctggagcaacgattggagaatgtggaactagctggaggacacctgagtactcttaaagcaatccccgtg

SEQ ID NO: 714807 - DNA, 989 bp, Homo sapiens
cgttggaccagtatgtgaccacgcgttcgccagcgtcgatcagcaaaagcatagtcttgcagacaggagctctacaaaacaactatgagttgctgccactggtatcaaccatcgcctgtaaatgtggtaggtagtaacgttcagcttaaggtcagcacgccttccatttccagtttggctcaaccccagctaccatatactcaggcggtcctccagtgcaaagtccccttccaggggcaccaccaacccaacagttacagtatggacaaaagcaaccaatggtttctacacagatggccccaggccatgttcaaatcagatgactcaaaatcctgcttcagaagtatgtacaacatgcagccaattcttcaaacagcaatgtcctccggacagccagttctgcaggagtaggagcaggacaacaacagtgattcctgtggactcagccacagggtatccagctgccagtgcagccaaagcagtcccagacacaactgaaggggcatctgtaccagcctgtatggccaggctaccggcaccacagtgtctgcatgtacctacctgcagtcagattgcaaatattggtctggaaagacaaacatactatttgcagtgagccagccctctacaccagggttccaacctttacagatctattcagcagggtgctcctccaatttacgcaaggtgatccaactgcttcaaactgggataattcatcaggagtcaaatagtgattcacggcttctcaaaattggtatgatccaagtcttgtaatgtggatcccagcaaagagtagaccgtagtatgaatgtaacagagaggatgagtaagttagcacggaatccatgaaagaaagttgaggcttggaagtttcaaaagtcacaacaaagacctgacaatgaagagagaaccgaaaaatatgagaaaacatatacaaaaatccaaccgggcagtaatagaaacaaaaagagtaccactctcagaga

SEQ ID NO: 714808 - DNA, 351 bp, Homo sapiens
  misc_feature (28)..(29): n is a, c, g, or t
  misc_feature (177)..(177): n is a, c, g, or t
  misc_feature (269)..(269): n is a, c, g, or t
gggaaactgaaccagacctgccgccagnnccgagcgcgccgccagcctgtgcatggcgcaaggccactacgaggtggacctggaacacctgttcctggcgctgctggaaaagcccgccagcgatttcagcatcgtggcgcgccgcagcgcattcgaggcctcggtgctcgaggcgancctgaacgccgaaatccgcggcttcaagaacggcaatacccgcacgccggtgttttcgccgcatctgccacgcctgttcgagcatgcctggntgatcgcctctctcgacacgcagaccacccgcatccgttccggttcacctgttgctgggcgctgcttcaccgagcccgattt

SEQ ID NO: 714809 - DNA, 440 bp, Homo sapiens
aaaaaaagaaaaaagaagaaaaaggaaggaaggaaaaagaaagggaaaagaaaaaaaaaagaaaaaaaagaggagaaagagagaaaaaagaaaaaagaaaagaaaagagaagaaagaaagaaagagagagagaaagaaaagaaagaaagaaagagaagagagaagaaaaaagagaaagaggaagaaagagagagagaaggagaaaaaaggaaagaaaaagaaaggaaaaggagaaaaaaaaagaaaaggaaaagaaggaagaaagacaaaaagaaagaaagaaagaaggagagagagaagaggagagaaaagaaagaggcacaaaaaaagagaaaaaagagaaaaagaaggggggtatcagggtcactctctatctctctctcactctctctctctctctctctctctctctatctctctctactctctctctactcgtg

SEQ ID NO: 714810 - DNA, 736 bp, Homo sapiens
cccgacactcaattaaggctaggtacgaggcttgggttgcgccgtcagcgaggcaagtcgcctggcccttcttctccaccaggaaagctaagagtctggacctgcatgtcccagcctgaagcagaggtcctcagggtcaccagctgccggggaccccgagagctacgcctgtgctgtggacgctactgacgcacggatgccagttcctgcccggcacgagtgcccacgggcgtgctgcctggccgccctggcacgcacacgctgacacacgcggcgcggggagccctggccgaggagcacggccccacacgcctggcatccacacacctgctcccctccctgctcctgacccaacgagcgacccgcgccccccacacgcacacccgccgcacgcgcaccgcgccgacgcgcacagacacgcactcccgggccctgcgcttccactcgccccatcaccctggcgaccgcgcatcgccccccccggttgcggccctgggagcctcgccacgcccagcggcacccctggcgacccccaccccgggcccccccacacgtccccgttcgccttcctccccctgccgccctagccgccccccgcgctgccacaccgctcccactgctgccaccgccttcttgccaccgcccccccccgctcgcccccctacactcgcttcttctgcgcgccaccccccttcttcctatctcctctagcgccggcctcctcccttgccccccg

SEQ ID NO: 714811 - DNA, 510 bp, Homo sapiens
  misc_feature (90)..(90): n is a, c, g, or t
  misc_feature (104)..(104): n is a, c, g, or t
tagaggatcccttgagcacgaatgtacgccgggcgctgcttgagttcttcggcggcggtgcccagcacgtgcgtctcgcccagcaccagngcttggggggtgcngtccacaggcaggtctgtcgcttcgatcggcaccttgtcgcgttctttttccacactctgcgccagcagcgcgggggacgaaagggtggcgataaacgccaacgatagatggctgagcctgaattgagacgacatgtccacaaagtcctttaggaggggcgattgaacgagagtcgtctgaattttttcgtgcatccagcgctcttcatgcgccgtaatggtattgattctcaaacagaagtaaattgcatttacaatctatacactttccttaaggctctggctcaatgttttcaaggctgtcggctgtgaagggcgaggtttaatcggtatgttctttgttacaaacgcgcaaaaaaaagcccctccgggcagactgatgcgcaatcacattctggtggctaaa

SEQ ID NO: 714812 - DNA, 381 bp, Homo sapiens
gtcgaccgggatcaggagattgagaccatctctgactaacacgatctgcccgccttggctcccaaagtgctaggattacaggcacaagctaccgcgcccggccctagcaaggccatttttacactttctgcagaaagggtacactccccagcagatttgccatgagagtacaccgaacaaaggagacaggttcatttataacctgacgcatccaccctactgctgtgtccagtttccactggctggaatggaacctcacattttgtacttgttttgattggcttagaactttttaaaaggcgtaaaggcagaggagaagaaaggaaggaggaagtaacttgtggaatgctgagaaaggcaaaaacatcttcaaatgtcgac

SEQ ID NO: 714813 - DNA, 645 bp, Homo sapiens
gagcaaggacgcccaggcgtcagcgaccctgtagaacccttgcctgagcggaactctctcagtgccatcttcaacaatgtcatgaccctatgtgccatgctgccacctgaatgttattcacctacctcaactccttcctgcatcagaggatcccccagatccgtacggatcctgggcagcctggtggccatcctgctggatgtttctgatcactgccatcctggtgaaggtgcagatggatgctctgcccttcatttgtcatcacacatgatcaagatcgtgctcattaattcatttggtgccatcctgacagggacagacctgttcggtctggctggaccttctgcactgccagaatacacggaaccaccatcatgatgtggccagggcctagcaaggcattctatttgccatccgtggccatgatctgcgctattgccagcatggctcaggagctaatcagacagtgccttcggctcaatcatatcacagactgttgctgtctatcatttagaccatcatcatgtaaccatgggcctgccccgccctggcaattataccgctactaccagcagctcacgccttgaaggacccggggtgcaggagaaacaagttggacctcattagcaacggaaggagccaagg

SEQ ID NO: 714814 - DNA, 337 bp, Homo sapiens
gcccccccccccccgggggccctccgggccctccccctagttccccgggccggccgcgggccccccgggcttccaaagtgtcacccctcccgggcaggagttgggtttcccccccccgacctcccctcgccccgggagtttagcggccgggtaggtaatgaaaaccccctgggggtcccccccttccctttccgcgctttccccccctcccttttttgaattcgccccctctttttaaaggaatttttagttttttggccaaccccaaccgggggggccgggggggggaaaaggggggaaaaaaaaattttttaaaatttaaaaaataattaaacca

SEQ ID NO: 714815 - DNA, 1083 bp, Homo sapiens
caaaatagtgggaagatgtatatggtagaggcgataatagcctacacgacgtcctggtcgtagtagactggttgtccaccacgatagaatcttagcttcagacgtgtgtgaaagttgggccacacaggagacccatctgagagaatcgccgcttgttaagattgtaaactggatctagatcgcaaagagatggatagctacgtcatcttgtaggagccacgtcaggcaaggaaaacctctgatcagcagtagcaggtagaacacagattttcatagcaccacagtagttagggcgctgaaatatgccaatggcactcaattcacacgacatagcgttgcaaaggctgctaaacgaacctagctagccacgtcgaataggaatcaccgagagagctatgtataacgtggagatctgccttcaatacgccgaaatgtggataccgaaattctatgcaccgcgtataggagagaaatctagatggttaatgatacagtgaacaatggaagaacgatgctcactccgagataagcccctgagtcgacgagttcaagaaacgacttgatactggaccaactgttagaacaagggcccatatattctacaagtgcataggtcaagacaggtccagtgtactctagccactcagctgttcaagcccagagcaatcagggcaatgacttcatcagcggcaatcgcgtctaacaggacagatggtcaacaacggaaacgtccgggccacaaatcttatactccacagagcagtggtattgcgcacagagagaagcattcaccgtcgtagtcatcaccgaggtattaagaagcgtcaaccagcctggcccccagttgaccaccatttggttttaaaacagagaactgagtggtgaacctccttaaaaccgggtgcaaaaagggttcagccattaaattcgaacatgaggatagcccttcagagattacagggggcacccctgtattcgacacttgggggctccaacggaaaggagtatcacaaggatgggtcctcgattaacctttttcacaacccaaggttgaaaacttggacgctggacccggtcgcaccg

SEQ ID NO: 714816 - DNA, 601 bp, Homo sapiens
cgtgctcgtccccttcgcctgtctgtgtgtggtatccgtaggtccggggcactttttttttggtgtgtgtgtgtgtgcgtgcgcgcgtgtgtgtgtgttgggtgtgtgtgtattgggggttttgccggggcgcggagagtgagagccgggcactgagtgggaaggaaggaagccgtagagctccccggtctcgtggcatgtgtctcccctccagcgctctcctggcctgctgcgctcctgacgcggcagacggcaggtgtgccgctgatgctgctcctcgagtggccgacgctggtgctcaatgctggagagcagcgacgaacccatttgcgcgaggccttcccagtgccctgcttggacttagcgatcgccagggcgtttggattttgcacctaactagagcccgggagttccctccaccgagccctgggcaagggcttgcagccggcgagccggcaggccgcgcggcagccggcacgtagcagaccggaaccagcagagctactccatctccagaggaggagaggcgatcgaaagcggccccagcacacgaggcctccccgcaccctcacccactccggacgctccttgcggcccccca

SEQ ID NO: 714817 - DNA, 1098 bp, Homo sapiens
  misc_feature (574)..(574): n is a, c, g, or t
ctgggttcttataatatataatccccggggggcttttcctttttatatttggtggaacgcccttctacaggtgttgtccccccctcgtgtgttgatacctccctccactttcttacccccccctccgttttgttgtgacacccccccccccattatggtggaagggatgaccctcccgcggggtgctcggagtctattctacgtgctcctcttccgcggtgagctgtttttgagtccactcatgttgccccccccgcggggataccgtgagtttttaccgcacagttggttgtttgcacccaccacgggggtacacacggcctttttttggcgccccctttttgggtccctatcttttattaggggtggcgaccccctcatatagtgagaagcccacgtgttgttgtggacccccagaaaatacccacgcggtgcttgggtgatcccgcgttctccgcggaaattttttccccgggagtgtgtcacgaaaatttgtgactccacctcaaggatatgtatatacgcgaccccctttttcgccacagagttttacacctctttcccccgcgcgctntgtgagacctctgtagacacacacgctgttctgggaaacacaggttttctcatacgcagacgtacactctgtatatgacacgagctgttacacgatgggggcgccacaaacggcgcggcgcgcctgtataacacgcgggggcactctcgcggcgcgatagaccagacacctcccccgggctgtaagaacgcccccggcgccacagagtccacagaaagaggaggccccgccccacctgtggaggaagaccgcgcaagatgggtgaaaacagcaccttcgggacatgtatctatctctacccgcagaatgtgtgggcaacatgtgtgtggcgtttacaacggcaagaaccttctaacccgagtggagatcaagaccccagatgtatcggccactacctgtggcgagttttcccatcacctacaaaccccttaaacatggccggcccggcattggggccaccccatccttcccgtttatcccttttcaaataatgggtcaacttataaaggggcacatgactccca

SEQ ID NO: 714818 - DNA, 355 bp, Homo sapiens
  misc_feature (152)..(152): n is a, c, g, or t
cgtacaaggcccgtggttgcccatgagaagtgtccttgttcattttcacccaaatgaagtgtgaacgtgatgttttcggatgcaaacgcagcgtcagggattcattttcgtgtcttagcttttatattgcatccatcatttttaattacacnctgcttcacgtcgcctatgttgaggaagtccactatttgtctgcgttttcttgcgagcatcagtttcctgtacaatagctgtccgagtggacaacactgacatattgatagtgttcttctgagtataagttacttgtagctgcactaagcagtacagatgcttgttagatggttaagtataggcggggccttgtacggggtac

SEQ ID NO: 714819 - DNA, 185 bp, Homo sapiens
  misc_feature (101)..(101): n is a, c, g, or t
  misc_feature (150)..(150): n is a, c, g, or t
atgatcgcgaggtatgctgcacagtgtctggactggacaccactgctataaaagatgcagggggccagtgcctgatcgtcaccgactgatatcccgactgnagtcccacaacttgttgtggcggctcagcccgaaggctgggcgaagaanaggatgctgaatgggcttcacccaatggtcagcct

SEQ ID NO: 714820 - DNA, 228 bp, Homo sapiens
agtaaagaatcatattagatgtgaatggtctagagacaccatatgtaagactggatttaaaaagcaatgacccttgggacctggtgcagtggctcatacttgtcatcccagcactttggtagtctggggacggtggactgcttgacccaggagttttgagaccagcctgggcaacatggcgagaccccatctctacgaaaaattaataaatttctgtgcccttttcaa

SEQ ID NO: 714821 - DNA, 228 bp, Homo sapiens
tggagatagccacttactccactgataggtgaggactgcttcaatatctgcaatactgcgtgtaggcatcggaactatatgaatggattatagatcggatgatccgcatgctgattgcgatagttgaatttagccattttaagcacagctttagctggacactcttcaccattcattcaatcactcgctcactttacagtcattaattagtacctatcatgacttcgg

SEQ ID NO: 714822 - DNA, 1146 bp, Homo sapiens
gcggcgctgtggacgggcgaaggaaagtacagtcttaggtatgtctttatcagcagtgtgaaaacggactaatacagtaaattggtaccagcagagtggggcattgctgaaaagataactgaaaatgtggaagcgactttggcactgggtaacaggcagagattggaacagtttgaagagctcacgaagaagacaggaaaatgtgggaaagtttggaacttcctagagacttgttgaatgcctttgaccaaaatgctgatagcgacatggacaataacaatgcaggctgagatggtctcagatggaccatgaggaactttctggaacactggagtacaaggtgattcttgctactgtactcagcaaaaaagactagcgtcatatataccatctgccactagagactcagtgcaaccttctgagcaaccgcatgatcttagcggtacctcgcagcacgcacgtttctaagccagcaaacgcattcacagaggtagcagttggatactgctcacaagggcattccagcattcaacaacggagaaatacagacgcgattattaccagtttccgcacaaaactcgacgtagaccctggctcctgccgcccgcgagcacaacccctacgtacacgccatgtcacaaacccaatccacatcatcggttgcacgttcgcggctaccatgtaacaaggaagccaatcaaggcatcaaaaatcggggagcaccgcacgccttcacacagacatttcacgaaaaacaaccatgttggtacgcaccctagaccataatggacaagaacgaatgaagcataaacacaaagcatcggcattaccacggcgggcagcacaactccacaggcgaagtgctgtctgagagagagcctggacctatcgaggaagtaaagcaacgtccaaaacgggtgtcaaaacaccgccaagggaaataaagtgggaggcaaaaaggtgtgtctcgaggaccatgtgcaagaaatcatttcggaaggctgagcgcagtagcggtatcaacagagtcccaggaggattccagagcaaggtagagaaacaggacataattggggcacgcgcacaccatgtgtccgatgtgatgaggatccggccgttattaactcgggtgcaccgaagtgccca

SEQ ID NO: 714823 - DNA, 717 bp, Homo sapiens
tctgagacaacggagggagcgtgccgaggagttatgcagcggcgctggagctttctgtcggactgaggctggtggaggttgaggaggttattgagtgagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaatggaaaacctggagaagacgctggcacatctcctggagaagctgcatgaacaagctggtgcactgctgcctgtgtgccctgccgagctggcgcgagaaactgaagactgtcgctgggacaatgttgcgcaaatccttcacgcccgaccacagtggtgtacggcgctgctccaagaccgcggtctacaagtgtgccacccttcaccttccactgtcaagaagatccagcagaggtgccagtgtggaagtgctcaaggccaccgagatggtggaggtgggcgccgacagacagacgagggcggcgcggatgcgcgagggaggcccggctgaccgtgcgtgcgccgtggacgcaggaccccagaacggtggcaacagcagacagtgcattgggaaggaatcagccagaaggaaggtccgaggaacagccggagcacttggcgtggaacaaaagaagcgaacaagcagagactggagacacgacacac

SEQ ID NO: 714824 - DNA, 125 bp, Homo sapiens
  misc_feature (82)..(82): n is a, c, g, or t
ctttctgcacgcacactagtttaagccacacagtggccaattcttcttcttatgacagcaaagagctggaacttccccacgngagtgtcctccagggagctacaggcctgcccaggaggtgctgg

SEQ ID NO: 714825 - DNA, 90 bp, Homo sapiens
tgatcagggctgcaaccccctagtccttttcaaggagaggacaatccaagtcaccctcgccacatggagaaacctccatgcagtgggggc

SEQ ID NO: 714826 - DNA, 828 bp, Homo sapiens
gggtggccctggggacaagagggaggagcccaggggcttacctcactgagagtgctccccagcaggcatccactaccccagggcccccacatgtcatggcaaggttgcgtagtgaatgggcctgcgttggagcagccccgtggccattgcccacccgaccatctcactatgcaattcgagttccaacgcaacatttgttcctgcctggggccaagctcttgccccaagcccttgagaggggtggtgaggcagcccacctggaccccaagaaaccccaagacaaggggggcagggggggcggaccaggggcccttctcctgtgggactctttggtttgcgtgtttacccccataagtgtgttgtgtacatggaaccaactttcaatattggtaatatatcactatctatatatataatctccttaaagactcagccatcctggtttaacacaccacggacgtggggcactttgagcattcccaccaaccccagtggtgacttttaacattccaggacctgagggccggaaccattttgtgattatcccgccttcttgcaagcgtcttgtaaggggaccatggggtggtatgtactggacgctggtgataagtctaagagtgattaagaaccgtgggtagagcgggcatgatatataataacattagggggagccttatatagtcgtgggagacagtactaaaggatttcggtagatgtaattactgtgggtactatcaggctgggtcaatgtttaacatacttttaaaagccaaagcactcaagaaaagaaaacattgtggcaccggctatcagaattatacacattgg

SEQ ID NO: 714827 - DNA, 228 bp, Homo sapiens
tagtggagaagagagacaaaaatatcttcatgaggaatgagaagatcgtcaaggaagttgtgctgatggttggaacgactttgttgaatgacttgaagagggactccacggtaggcagccgattggtaactctgaaagacgtggaagacggggctttcctcctgcgtctaagtgggtgaggctgtagctaccctgacataggagaatttccaaccggtacaaaacaag

SEQ ID NO: 714828 - DNA, 140 bp, Homo sapiens
ggcgattcttgaggatccccccttcaaagattcatgttatctcagtaacccatgaatgtattatattacatggaaaagggcaattgagattgcaagatagaattacaattactgatcaggttatctttaaatggacgagg

SEQ ID NO: 714829 - DNA, 498 bp, Homo sapiens
ctatcatatagtaaaatccagcccatgtacccctaacaggggccctctcagtccctcctaatgacctccggcctagccatgtgatttcacttccacctccataacgctcctcatactaggcctactaaccaatactactagccatataccatatgatggcgcgatgtatacacgagaaagcgctgtactcaatggcccgacactagaaccaccatgtcctaataaaggccttcgactacgggataagtccgtatgttaatatagcctcagaagtatctattgtctgacggcaggagtgtctatcgtgagccctgtattagccagctccagtccataggtcaccctactcgcgccacaattttagagagggggtccttgaccacgccaaaacagggtcattccaccctccgggtacatattcgcaccctaaaacagtcacccagtcgcgtgatacaagagtccgtagttgatgggcgccatcggggaggtagtcatatc

SEQ ID NO: 714830 - DNA, 778 bp, Homo sapiens
  misc_feature (48)..(48): n is a, c, g, or t
  misc_feature (72)..(72): n is a, c, g, or t
  misc_feature (75)..(75): n is a, c, g, or t
  misc_feature (81)..(81): n is a, c, g, or t
  misc_feature (87)..(87): n is a, c, g, or t
  misc_feature (96)..(96): n is a, c, g, or t
  misc_feature (112)..(112): n is a, c, g, or t
  misc_feature (186)..(187): n is a, c, g, or t
  misc_feature (230)..(230): n is a, c, g, or t
  misc_feature (256)..(256): n is a, c, g, or t
  misc_feature (354)..(354): n is a, c, g, or t
  misc_feature (491)..(491): n is a, c, g, or t
  misc_feature (519)..(519): n is a, c, g, or t
  misc_feature (564)..(564): n is a, c, g, or t
  misc_feature (569)..(569): n is a, c, g, or t
  misc_feature (577)..(577): n is a, c, g, or t
  misc_feature (657)..(657): n is a, c, g, or t
  misc_feature (709)..(709): n is a, c, g, or t
  misc_feature (762)..(762): n is a, c, g, or t
gtaaaagcccaagacgtcctgcttcccactgggaccctcaatgataanagggtcagtgactgagtctgaggnagnaagganagaggngaggtggancccgtggtcgaggggngcgggggggggggggggaggaagaacacagatgtgagggcgggctcaggaacacaggtcccaggtgtacaagannagtctcctgaactccaggaagcagtgacacccccgagggctgnggtgggtgggtacttagcttacagcnggctggccaggcagcccaggcttccggggctggttggggccgatgtgctggagaggcacgtgggtgggggctgtgatccgatcagtgccgaggtaggnctggagggcagggggcacgagcactgagccgtccttctgctggttactctccaggagcgcgatgagaaggcgggggacagcgcaggcggtggcgttcaccgtgtgggctaactgcagccccccagcctcggtctggnacatgaggtggaggcggcggctctggangtctgttcggttggaagcgctggtgatctctccaaagcggcctcngcctngcatccangcctcaatgtcaaacttgcggtaggcggggaggcccagtgcttgggtgggcatatccaggacccggaagtgcaagcccanctctgtcaagatctccatctgaagggacaggaactcctccagcagctgttanctctgctccagcccagggcctgtcaccccaaacatctccaccttggtgaagtngtgtgctcgatacagc

SEQ ID NO: 714831 - DNA, 252 bp, Homo sapiens
ctaattgaacatctcaaattaacactttcaaaaacgaatctctatctccagctcccaaacctgctccttcctttcttcctccacctaaataaatgccaacttcatcctggcagctgttcaggaaaaacccttggagccgtccttggcatttgtctttgtctcacatctcatattcaatcaatcaccagtcctattgtgtctaccctgagaatggattcagaaactgaccactgctcaccatgcctgtcctag

SEQ ID NO: 714832 - DNA, 282 bp, Homo sapiens
aagcaagtcaaatgaagagcaattgagcaggaaacggggggaaataccctcagagtaataagattatctcattacacttaagttttgctgatgcttcaagtttcctgagtaagttatgcgaagcatctttctctgaaaatcttcttgctgcagaacaaaccatgtttagtgtctgtatatgtctcaacttcctgtccccactggcggatgggaaaaaggacacggtccttgcttgtgttttggagtgaaagaagcattaaaggtcttgcagactttaaaaaa

SEQ ID NO: 714833 - DNA, 384 bp, Homo sapiens
ggtagctaggtcattccgtatggaggagcagagatactctggggtgggagggatctaaaggagccttagaatgaatgctgccctttaaaaagagaaaattagctgggcgtggtggctcacacctgtaatcccagcactttgggaggccaaggcaagcggatcacctgaagtcaggagttcaagaccagcctggccaacatggtgaaaacccccgtccttactaaaatacaaaaattagctgggcatgatggcaggtgcctataatcccagctactcgggaggttgagatggaagaattgcttgaacccaggagatggtggttgcagtgagcggagatggtgccactacactccagcctgggcagctgagtgagactccgtctcc

SEQ ID NO: 714834 - DNA, 124 bp, Homo sapiens
aagccctctcaggtctctccgagtcactgcttcaccgaggagtcagctgactgtatgctgagggcagatatgcttactgtgaaccttataggaatggcatcagactgtatgtcatcttttggat

SEQ ID NO: 714835 - DNA, 148 bp, Homo sapiens
ggttacaacatcccctagaggcacaagggagggagacaggcgcatgaaacttcagaacagggtcaaattccccttgactgggccgggacatgacacctcacgtggttaagaggagccagagcagctgggagtttggcaattggattgg

SEQ ID NO: 714836 - DNA, 938 bp, Homo sapiens
gcctccctaccgtgaccaagcccagccctcagccatggcatgccccctggatcaggccattgggctcctcgtggccatcttccacaagtactccggcagtgtagggtgactaagcacaccctgagcaatgacaggcatctgaaggagctgatccgatgcaaggagctcaccgattgtggcgtctggaagtcttgcagagatagcttgaagatattgctaacgggctcgatggaatgaccttgggacccggaaccacggaccaggaggtgaactttccaggaggtatgtcaccttccttgaggggccttgcgtctctgatctacgaatttgacagcccctcgaatggtgctagaatagctaagatattacgggaaagcattgtgtaagacaacccctcctgcgagggcgatccctactccttgcagtttcaaacatctcgacgtcgcgcttggggttaaattgcgttaccaattacatatctatatcaatctcgcgatcacagaatttagagaaaaagatcagaagcatacaaaactcacacacttggctggccgggtgcctcaataaatgttggcgagtagtgcgttgggaagtaaatacgcacggcgccttggtcgacataggtgcgggcactatgtgtgatcccatgggcgagtgtaagtccctgcgatggatcccacgtagtttgtcgtgtgtaaccgacaatagcgtgggtggagctaacggcggtcccgggtgccactctcgcataattcaagccttgaacgtccaggtacatttggggatataagccggaatgtacatgccaccaggttgttcaatcccggtgacagtttatggagaaacacgccgcggacaaaattgcgccgtgacttccaattttacgcgtaacagcaacatctacacagttcgttccagttggaacaacccggggtcat

SEQ ID NO: 714837 - DNA, 180 bp, Homo sapiens
tagtgtatgggtgtgtgtgcgtgcatgtgtgcactgtccatgggtgtgtgtgtgtgcactatgtgtatattcgcatgtatgtgtgtgtgcgtcgcctgagctggcggtgtgagggctcagtcctctgtcacagcattggtgaggcatagtttggcggagctcctttgccacgaactcaaa

SEQ ID NO: 714838 - DNA, 365 bp, Homo sapiens
tgtgtagtatagtagagatggggtttcaccatgttggtcaggctggtctcaaactcctgacctcaggtgatctgcccgcctcggcctcccaaagtgctgggattacagacacgagccaccacacccagactcttttctttttttttttttaaaacaaagtttcactctgtcacccagattggagtacagtggcaagatctcggctcaccacaacctccgactcccgggttcaagctattttcctgcctcagtctcccgagcagctgggattacaggcatgagccaccgcgcccggcctccattcaagtctttatggaatatctgctatgtgctacacactgtcctaggtgtgggggataacatca

SEQ ID NO: 714839 - DNA, 822 bp, Homo sapiens
ggggctgcgccccacgcagcccgtgcccgatggtgccgcggggccaggcctgtggagctgggttcgccgagtcgggccgggtggggatggcaggagcagtcccccagcaaggtgggcgggcggctggcatggtggggcgcggccggccttgcggggccccaaggcctctgcttgcgaagcttgtgcggccgcccggttctccttccctggctgcagggtgttatgccgcccgattgtctttgggcccgccgggacgctttcccaccggcgttgcattctcccctcttcttgttgccgagaaggcaaccggtgttgtgccggagcttggcgaagtttcgaagagatttcaattacccggggaaaaaaagcggattcttacttcaattattgaggccactctttcgtgaggaattcttccccccagaaaaacagcgagaccctcaggggttggtcccccagggtaaagggtctaggggcaccattctctgcagaggtttgaggaggctggtaagaggccccaaaaagggttgcctcccagatagccaacaagaggcattattactggacgcaggggaaggcttcagacctcttaaggagtggagactgcgggaccataaacagagcgctggggtgaacaaaccaaggatcaattgtgggaccaatattagttcccaggcccacaaatttcccttttccccagacctttggaatgggcataggcaccccgaagatgcgattattgcctgaaggttgtgaacacggacagattcctcagagaataaggggcctgggacataccggagccacccccacgggtagatc

SEQ ID NO: 714840 - DNA, 718 bp, Homo sapiens
ggggattcctgatcctgcctctgggggggcggcgatgcctaaatgcagtgttccttagctaaaccttgacctactaatatctttatgctctggaggcgatccatcgtactccaaagattcagggtagctcacgatctccaccagggaagggatcgccacttatcctgaaaggctatttttttgtgtcacgtacatgcaacatggacgtacacttactgacgacagtatacagaatggatatactgtccattttagactggaccttcaggaagacggttctatatatctatggtgctacactcgattcgcaccaactgtaaaaaatgaatatgcctgcctacgcgaaccatgcctctatgatacagccgaggataataatgtggaatcgagtcttgtaagcagaaacaggcattgttaaaaatgccgcactgggatgtgtataacaacaaattctgccagcttgctttttaatattggtaggctgattcactgacacttcatccacaaagtgaagtggcttattaatgtaataaaggacatgatcttcctttataattctacttggagtgctggctccctggttggtcgatctgagcacattgcttcatagagttgctctaggcggactgtccacttcaaagtgggggtcaaataatccatttatccatcatgagcgtcttgtgcaaaattaaacgccgaattttatagactcaaagct

SEQ ID NO: 714841 - DNA, 236 bp, Homo sapiens
catgaagcagtattcagtcatcaagtgatgcagagcttgtatagaagatcgactagaaatcatcttcatgaagagtgattttggcacaagtgaccgaagaacaaaacaccatagcagccaaaaattgcctggagtgttgttctatccccaagtactgtctccttcagcaggaatttacctatcccattggaaaggcaagtttgtacccaaagatgcaacagtgaataatacccaaa

SEQ ID NO: 714842 - DNA, 172 bp, Homo sapiens
gtatggacagagtcgtaatctacaaaaataaaaaaaaaaattagcaaggcatggtgatgcacacttggtggtgccagctacttaggaggttgaggtaggagaattgcttgagccagggaggttgaagctgcaatgaactatgatcaaacactgcactccaagctgtgtgaca

SEQ ID NO: 714843 - DNA, 679 bp, Homo sapiens
ccgatgacgcgtgcctggtttaggcaagattgccgatagtaagggactttcatgtatcaagatacggcgcttgggcaaggtcaggatgaccccgatcgtgtaggagatctgtatcaggtcagtgactatgaaagtatcagcgctcatcgctttcatgctggtcgactctataaaacttgcggagctatagatactgccagagcacgatcagacacgtgtcatggcgtgtacctggatgatgttataagttgatgtcagagtcaacggagttcaccgtctactaggtggcaaaggctcaacggaggcgtgcgtacacagttgttagaaatgaccgtggtcatgagctctatcactatgctcgtaaagcctacttggattcaagatcggtgtgcccacactgtgccttgaaagtagacaggccatatcctgactgtggtgccaggacttagactgtatgcagaggcactgctactgtttccacaactaggcccactaagccaatcatgatggcagacaatctacttcggattaacctaggacagaggacctgcaaccaggcaactacgcatcgtcaccctggaagcctttcttaagcgactgttaaatacctagactattgaaggccgggattaccctttcaggatcgtcacggacgaccactctccccaccttagcctcg

SEQ ID NO: 714844 - DNA, 314 bp, Homo sapiens
agcctcggattccccattttcgtttcggcgctcgaggaggaactgggctacgacccgttcacgctgtcgcaggacgcctattatccgcagacctttgccgagttcgtggcattctatgacaggtatcggctggctccatgatctcgctcggcctgctcgtccacgttggcttccacatggccgggtcggctgattcgaccgcatctgagttacggcaactcggagtccgtcccggacttgccatgtcgcgccctgccctgaccctgcgcgatccggccgagttcgttcgggtgatctgcgcgctcgatggacag

SEQ ID NO: 714845 - DNA, 248 bp, Homo sapiens
cacagttgagctttgggtactatatacattctgggaggataaagtggtccatctggtgttggaagtgttaccttactattttggttacaggatagtcgatggggttgattcaggatgtaacaaatatattcagtaccatttctggtgtggtatggtgtggtgctgtgttaggtttttacatacggtagtgtttggctgtatatgtgtggtgttggatttcaattaaatgtgctgaagggtaccgagct

SEQ ID NO: 714846 - DNA, 538 bp, Homo sapiens
gatgccctagacggacggctgatgatctatacaaaagcctgcgtattctgctccaagactggcctgacctgctgaaagactttgctgctttcctgttgcctgagcaagctctggcctgtggattatttcaggagcaccaggcttttgctaagagccgcaagttccttcggccgctggagatttgctttgcagacaacccctcacaccaccagacgattatcaaggtcctccaaggctgtgcagactgccttccccacgagatcaccgagctcaagacacagatgtggcagcttctcaagggccacgaccacctgcaggatgagttgtctatcttctttgaccacttgcgcccagcagctagccggatgggtgactatgaagagatcaattggactgaggaaaaggagtatgagtttgatggcttcgaataagtggccctgcctgatgtggaagaagaggaggagcctcccaggatacccacagcctcacagaacaagaggatacaagagatcggggtcgcaaatcatgattaggagac

SEQ ID NO: 714847 - DNA, 894 bp, Homo sapiens
gaattttcgggatctttaaggcatgttggtctcaaggggatttgggattgaagcgcagctttctgttgaggaaacctaggtgtcactttttagaacattaaaaagaaagttgtagggtgggcttttccatttaaaggaatgtgatgatcctaggttctgatgagtgataggtggtctccgtttataccctttcttcttttggcacctgtaagttccggtagtggccatcttacattctcatgtcctgctggaagtgcctagttgcctgcaaagccagctaaggcttattactttcacaaaacgaagattattctaacaacactgacgtgaccagcgctaggtcacgaaagagcaacaaccaggacgcaaagcatacctcctactacgcccaacgtcacgcttcggaggcgccaggactggcgctttggctgacgctgaagtcgccgctcacttttggattcttatggactgccgagcttagtcttccctctacacggcagtcacacgccgcacagggtatacactgcactgttcctgaggtgccctcccccaaagaatgtacctgcactcaaaccacggatctgttctccgctgtctcaaatcataaactacgactagctctagtacgcaacgactctccgaacgaacaacaacgctaacacactctccccctccccactctacaaacgatgtcccagcaggcaaaagcgccctgtgcacgccccactaatatctctcaatgacctgcctggaacccatgttccctcacatatggtggctctccaccgtttgttcgggcccatcggctcctctccccgacttaccgacactcctgccccccctccttacccaacctttccacgcttccactcgacctctccccccctccgtgaa

SEQ ID NO: 714848 - DNA, 168 bp, Homo sapiens
gctgtactatgtctgcagggcgagtaatggacgatagactatgtgggatacaggtgacgtgccgagctcctggcctgaatgaagcctcctgatctatcgctgtgactgcactaccaacactgttatgatgacgagcagaatggttatgacgatgtccatgatcagggt

SEQ ID NO: 714849 - DNA, 339 bp, Homo sapiens
  misc_feature (71)..(71): n is a, c, g, or t
caaagggggacacccccttggggggggtttggccccaaagggaggggaccacaaacctttgtcatgttaanagggtgggggggggggaccaaaaaagggggggtccccccccccaagtccttggtgggggaaaaaaaaggggggggtttggaaaaaatttccctttagttttttggcccccccccccaggttgggcagggggggttcccgcccctgggggggaaaaaaggatttttggggccccttaaaaaaaaccgaattgcaaaggaaaaagggggtttatgcccgggacaaattttgcggggggggggggttcaaaaaaaggttttttcccctgga

SEQ ID NO: 714850 - DNA, 328 bp, Homo sapiens
tcacagacgcccgccatcatgcccgaccaatttttgtatttttagtagagacggggtttcacaatgttggccaggctggtcttgaactcccgacctcaggtgatccgcctgcctcggcctcccaaagtgctgggattacaggcgtgagccaccacgcccggcatgtttccagatatttttactctctggtgtttattaaacttaacccaggcagattgagtctcagccatgttagagattttcctggattagctgccttgtagtacaatctagaatttttagtgttcaatttatttcttgaactaatcattcaagtagattgaaggaa

SEQ ID NO: 714851 - DNA, 759 bp, Homo sapiens
cctgcaggaattcggcacgagcatttttatacactattatacaccctgttcctggcttatatactggacaactacaacactacgacggaagctactacactatgcaccagatagcaactccacggcttttacactgaaacactgaccactccaatggcccctagcgatatactagacaccacacaccaacgggtcctacaacgggtccaccttgatcaccactctaacgtcacacttcgcagacgctacactactatcttaacaatataacatatccgtgtatcactgatccctaagctactatagcccaccattgacatccatatcattgacacaatctactagctactacgcgcgctactaactcctccactatttatcccgtacctcaactatctccaactatatatatcctatctaaacacaactatctttctccttgccaacgccgtctttcttctccatataacaatgtacgtatcacatacccatatgaccttgcatgcgcttgcgccctagagcgcaatagccctattcatgtccccgacttgcgactatctatctcatgaaacattcttacgcaaccttgcgcgctcttgctatccatccctggctgcctttcaaaaaccccaaaatctcaccttatgtacccaaccccatatcccatcctattcaccacgaggtagattggttacttgcgacacttacttggtcagctacattagacacgtggagagacacagcttcttctcacacttt

SEQ ID NO: 714852 - DNA, 390 bp, Homo sapiens
ccccccaaatcccccccaggaaatagggggcggggtttttttaaacccccctttaacccccccccccccccccggttggaaggaaggggaaatggcccccccccccccccccggcccccccttggggggggccccccctccccccaacccctttttccctttcccgggggagggccaagagggcccccccccctttttggggtttttccccccccaaaggggggcccaaaaagggggggtcccccgccctggattcagggcccccttcgggggggccccccccattttgggccctccccccaaaatttttcccccccccggggggattcccttggaaaaaaacaaaaaaaggttttttcatgggacaaacacacacaaaaaacacacaca

SEQ ID NO: 714853 - DNA, 293 bp, Homo sapiens
  misc_feature (59)..(59): n is a, c, g, or t
  misc_feature (208)..(208): n is a, c, g, or t
  misc_feature (223)..(223): n is a, c, g, or t
  misc_feature (257)..(257): n is a, c, g, or t
  misc_feature (278)..(278): n is a, c, g, or t
  misc_feature (281)..(281): n is a, c, g, or t
  misc_feature (284)..(284): n is a, c, g, or t
aaagggtcgggctttctaagcgaagtggccccagtgaaccaaaacatctgccaggagantgagcggctgcagtctacaaactttgccctggccgagtgaggtgtagcaaaaaaaggctgtgctgcccttaaaaatggcgcccccagctctcccgtttttggagcggaatttacctgattttttcagggctgctgggggcaactggccntttgccaattttccnactctccccctggttttcaatgaaaaaaagggtntttgtgattttgagtaaagcnccnatntgttttcca

SEQ ID NO: 714854 - DNA, 605 bp, Homo sapiens
gatgaaaaggaggccacgggagatacctgggagcactgggtgtagcaaaacaaagccactcgctgctgtcagtcgcaccatgtgctaattgaaaatcatatcctgaatcatactgagagtgatcaacttaggtagcttctattagttcagatcttatgatcacactgacgtctatctcagcgtgagattttctcagcccagctgagttagtacattctgacaatgctgggcgaccaggagacggcccacagagcacagcactgctaagtgtgaagatgggaactaaactggaaatgaaatttatactgacaatattatggcatttttaacgatcatggccttttaactttacattagagtggagtagcatcatactcaggggttagcttccaaggtcagtacatagcgtagaatgggctattaggattgatccttgaaagccctttgagcaagggtgccagtgttcggaaagctgtacatccacaacaagtagctttgcctcctatgttggaaacaagagagactgtttcttggtgttgaagaccaagtgaacgttgtcggtgtggtataggggccattgtgttaaagaaacaaaaaaaaaaact

SEQ ID NO: 714855 - DNA, 401 bp, Homo sapiens
tttcctgtaacatatttctggtgccacagaagggactatagtgcagaaacgttgacccacgggctacctttgcgtaagtgttggggtcctgtaacatatttctggcaaaccacagaaaggatgatactgaagaaacccccccaaccccaaagaaatagactgcagcactgattggacgactttgggtaagtgatggggtacccgagtaacaaatgggattgggttagaggcccaacttaggggagttggagtttctcctaagacagagtgagttagaggcccctcttaataaaaggcaaggacacttgactgacctcaggttagaggttactccatcctactctatggagtagctgtcctttcaccactttactttcttaataaacttgtttttgctttgc

SEQ ID NO: 714856 - DNA, 116 bp, Homo sapiens
gcggtcaccagaggcagagtgaagtgcggcggtcttgccggtgccggtctgggcgatgcccagcacgtcgcggccagcccggccgacggggactcgcctgttcttgaataggggtg

SEQ ID NO: 714857 - DNA, 797 bp, Homo sapiens
tggttactcattcaacaattttatattaaatgtataccatgtgatcacgagttacaacaagtgtagaggacagagtcagtatgcccttgggacactaatcgtgtccgataaagctctgagccagcaatcaaacccttttagagactcaccacttaaagtaatcatgcttgtactaatttattcagtatttccttcttccctatcacaacgaattgtaatggaagcctttattacgtccggcacaactatacacttataaactgtcttctctgctaaaatccgctggcttcagtcaagtctactttctacgtacatactaatcaacctgtgacaatcaagttttatcctggaaaacaagaaaggaccccattatcttccgtctgtccgtcagttttgagcatgtccttttctctccttgtgcccatggcttgaagtagcattggctccgacctttgtgcctcactgcattcctcttgtctcctgagactcctgggttcctacgcatgattgtctatagaattcaagctctagcaatcatgaaggaccactctcacgctggcacatactcattagcaaggcccctgcaggccatatcacataagcataatgcctcataccagaaacatacaaaaaatttgtccatgccctagtcacaattggatcaacacctaatatactatattaagtagcatagactctatctcaattaaccattgaaacaaataaggacgattctggttactaacaaactcctaccaactttagcaaaattaaaatccatctataccatccatccc

SEQ ID NO: 714858 - DNA, 127 bp, Homo sapiens
gggatgttgaggctgcagtgcgcctcgatcctaccactgtgctccagcctgggcgacagcaagcccgtgtctcagaaaaggcgggaggggtgggatattattgatgataggccattcaacgcctccg

SEQ ID NO: 714859 - DNA, 620 bp, Homo sapiens
gggtgggggtgggcatctctggtacctattggggtggggggcctctagaaaagggaggctcctaggcccccctcacccctccctctccccagggacccacgattctgcagccttaaggttgaacatgagtgcacgtcatgtcagtgctgtgggacatcctgatgcgtgccatcgtgacgtgcgtgatagtcggcgggacgcagagcacacgatagggtgtgtgtgcatgtgtgtttgtgtgagggcagcgatgtacatccagatgtgcatggatgtgtgggcattgggcaccacaatcactgggaccagagacatatatcagtaccgtgtagaggaggaaggtggatgcatgacactatgattgaggaggaggccacacagcatgaatggaatcccacaagaaggaagccatggacgcccgattgcaacccataagcacgttcccacccgtaccaccatggtaaggcgaaaggaacacgatccattggaagatgataatggagaggattcacgaccattagttgctacggggaatttatgcaatcaacacgcactaatcacccaactacatcacagtggtagcataaaacgcaaagtttacaattgaggcaaggaggcag

SEQ ID NO: 714860 - DNA, 427 bp, Homo sapiens
  misc_feature (1)..(1): n is a, c, g, or t
  misc_feature (6)..(6): n is a, c, g, or t
  misc_feature (25)..(25): n is a, c, g, or t
  misc_feature (27)..(27): n is a, c, g, or t
  misc_feature (31)..(31): n is a, c, g, or t
  misc_feature (44)..(44): n is a, c, g, or t
  misc_feature (46)..(46): n is a, c, g, or t
  misc_feature (79)..(79): n is a, c, g, or t
  misc_feature (83)..(83): n is a, c, g, or t
  misc_feature (93)..(93): n is a, c, g, or t
ngaacngacagaaattgattagagngnaganaggaacaaaaaancncgcctttttaaaaaaaaggggggcccacccacnactnaaaatacagntaactaatcaaacaaaaaaaggaaataaattcctgaaggctatgacctggtttcaccaatccacatgaaatgactactgaaaaaggaaaagaatgaaaaagggaaattaaaaatgctttcacaaagatgggcaattatctcttgacaaactgaataaacccactgaaaaaatgaggagctgcccggaaacaatgaaattgcaaaaccaaaaagtaaagggaacaaacaagaacagaataagaggttgaaaatccccaattgatgaaaaaactaaaatctgctgctggttttaaaaaagaaagctaaaaaataaaattaatcaaaaaagaaggca

SEQ ID NO: 714861 - DNA, 208 bp, Homo sapiens
gtatagcattttaaagcggcataccctaaagaggtgtgtaatcaccatccgcagccaaaatatagtttattatctctctccctctttgtgaatgatatgtgtaaagtgaatccaattcctggcccccagagcaaataagctactgtcagaggcaagaacatccaagctgctgatatgcagcaaaccccattcatgccccgcagtctag

SEQ ID NO: 714862 - DNA, 540 bp, Homo sapiens
ggggggtgatcacaccagcgcgactaaatacatctgacccgatcccatgcgtgcagaggtcataaaggatgcagaagagacagcaaagatgggtgcctactccttctgctgggaccacatgacctcaatggggcaccagcctgatagccagtaggatcactcctgcagagggtatctgacaagccctgtagaagggtctcacccagttgggtggcacagggagcaggatccgtttaatggagcactctgtcccttggtggagagggtgtgtctatgcttggagggaaacccactcatctgggctgtccagattccttggaactaccaggagtgaaaagctaaatctgctggtcagcagagactgcggccacccctcccctatgggctgaggcccaggagatccaaattctgtcccttagcctctggctggagttatcggagatccagcagggaagcgccccgacccacacacacccaaactacgaacggatgggttgggattgggcctgcaaagcactctagccgagactgccacagcca

SEQ ID NO: 714863 - DNA, 768 bp, Homo sapiens
attctaagttggttctacttaaggaacttccagggattcatcatctatatattaagtacgccattcaccgattcctgtgtaatatgttttgactgacaatgatgactcaatcacattggcctctatctttggggtctattcgatccgtcttaatcataatccttaacataacaaataatgacgttagcgaaagtattccctttataccatgaattttctagaggacacaatatgttctctccgaaatctcatctaccaagttgatagcagattggatattatgtttcctgaagaagtctcttttgcaaagcataacgcttaagaagttcctagaactacataagtaaagctggtattttaatatcctgattgactatttaggaaagattgcttaataagaagatggatggagtggcattgtagtacgtattgtgtgtatccacatagttcactttcgagtacagttatatgtatacattgttttgattgagagttgtgactatacaatgttagaatcagatatagcttgtttcttgttaaatatacgatatacacgaaatacatataattttctctcctttttgttgtgcatatctctatgcatttataaacttttgagactttgtgaattcgaccgtatgtgtaaatttttgtgtgtttagtacaaccagaaagtatacaagcttttaatgtgtgtcagacaacttcgttccatacaatctgtggtatcgagcaataatgttaataactgtgcggcaattatattaa

SEQ ID NO: 714864 - DNA, 367 bp, Homo sapiens
agtttttccccaaattttttttcccgggggcccattgctaaacccaagatggtgaggggccttttttttttaggttttccttaaaaaaaattcccaatttcccactataaaatccaaaaaaggggttttttttttccaccctcttaaccttttttggagaaggcatttttggttttccgaaattaacataaaatcccaaagcaaaattccggaagctgagaactttgggcagttggtcagctttacctatggggctttgcccttaaataaagggggggatgggagattttttcaaaaatggaaggaaaactgtttcctgaacaataaaagggatgaacggggcaaaaaaaaaaacttttttttatta

SEQ ID NO: 714865 - DNA, 1209 bp, Homo sapiens
  misc_feature (263)..(263): n is a, c, g, or t
cggggttccggacaactcccccaagacaaaccctctgtgctcctctccttcagtccccagcctgggtaaagatggccccatggtcccccgaaagggcctagatcccagctgtgctctggggccatcagcactcttccgtcagaagcctctccaggcatcgctatctggctcaccagcgccgtcgttccgagccttcgctcccagatctatcgtcccccgtgctacaatccctcgagtccgtggtacatagcctgaccgcgggnactaggtcgcacagtatttagagcacatgggcctggcagagaaccgatctcgggtgcacaacatttcggacgtgaacacaggtggccctggtgaggcaccgaggaaattatgctgccaatatctaacatagaccaccagcggataacctcggctggcatagatgtggtgcgtaggcacgcagctggtggtgcagtcaagagctcatgaacgtctcggatggtgccatccgggcggtgtgcgtgggagcttagagggtgaagggaaggctgcatgggatacgccttgtgattggcttattccacgagatggcgaaggcgagcgaaggacccctgcgtaccctcctgtacgcgagtgtgccttcgttgcctactaggatttctccatgcaaaggcatccgtagacttgaccgcaccctggcacggtcgagccgtttaccgcgtggcgcgctccgttgcccgtttcaccctcgtccgctaggtggggacaatcccggaaggacgggggccttgacttgtgctaggagctttgacgtcggccaagctgctcgacaggggcccgcacccgggggacccccgccaagggggggggcgcccactcctggcgggcgagcgtttgtgctgaccgtggtgctaaagggcgccgggtccatatcaagcggtgtgagtcgaccggccccgtggtggggttcgaccttggttggcgctctattgggcgcttagcgataccggaggggcgaggacaccggcgatgacctgcccccggcccaatcgctgggggtcacttgtttccgggactcttgtggtggttggggggcgcccttggcttgcccccggtgttggcttcagagtgaactcctctgcacgggtgtccagacctctggtgtgttgggcaatgggggcggattggaacagtggcgccttgtgggccccttggggaattacaccc

SEQ ID NO: 714866 - DNA, 956 bp, Homo sapiens
  misc_feature (294)..(294): n is a, c, g, or t
  misc_feature (549)..(549): n is a, c, g, or t
agcggggaaccggattcgggagagcgtggccggccatgggtgggggcgccggtaggaggcggaggtggcgcgagcatggaggaggggagaagagctgctgggctgggtcgcggagagccggcggcacgcgacgaggctcatccagcgggcgacggtaatgataggaacgttactgtcactgtgacgtgacaggagttcttccacgcgtgtccagcagagccacgcgtacatcgactggaagcatacctggttctatctcgacactgacgagcactccgaatgttgggtcgcgcngatcattacactgtcaacagaaacacatactagacatcgagcaatgcgtaaactcctcgtagacatgcagcgattccgagacagaccttcaccatgcatcattgctcccgtcgagactttggcatacgctggactcagtcgcgtctctctgtgctggcgttgagtcaccggcatggttagtacaggcattggccgaaacattggcgctcttcctggtagttcaacttttgattggcttgggaccccacgagtggnttgggatcgcctgcaggtggcggtttcgatctgtcctgttggtgtgtggctgtgattagcgaattcacttcgctggtgtgagagttacctcaagaactgtcgtccatcgtattgccgtctacgtgatgtaacgcaagtggacatagttcccagggctatattgaataatgtcagtattcctactggccagtcgtctcatagttcgtgtcgtgggtaggcgcttaggtcgcagggtccctcgcatgtaagcgtggactcccgtgggaaagggaacttcaccctgcaagtagaccccctaaaagtacttccccatccattggcgacgtacgaaaggcgcaagttgcttcggcgcaaacctgacgtgttaatcacactgtgtgtcacaagttgtaggactcggaggaacc

SEQ ID NO: 714867 - DNA, 334 bp, Homo sapiens
gggcacatcaaaacacaccaaacctagctgcaaagaatgtgaaaccaccaccctctcatacattttcaagaaggcaaaaaaaagagatcctcaagcacctggggatgtgtagctgttgatcccggcagacaaccgtgagtttcagaggcaaggaaaagattttttaaaagttaagcagcgattaatagagattgctaatcacggtgacaagttttacagaccactgaacattcggatcgtgttgcacggcgggaaatgtgtaatgacatgcacaaatgctctgtaagtcaggacccattcacctgcctccattaatttctggactggaggaaga

SEQ ID NO: 714868 - DNA, 393 bp, Homo sapiens
gacttgtgtatagctgagactgtaactggcaggtgttttcagttgctgcactttttatttaatcttgctcaggtcccagtaactatctcaaaggtaatcgcaggaatatgcatatagaaatacggttcaaaaaaaatctgtgtatggtttcatctaaaaagacaagcactattggaaacactaaacacgtgttatactttgtcgttattttgcattcctgtactttacaaactgtcatcacagcaaaaagtttaaaattaggtaatgacctatctctgtaaatacgtaccgttcagctggtattttaaacaatgtattataaattaattaatgtttctggacacatgttcatatatatgtatatgaatgtctctttatgctgaagtgtcaacg

SEQ ID NO: 714869 - DNA, 131 bp, Homo sapiens
taaacaagggcttgctctggcactcaggctggcaattgtagctcactgcagtctccaactcctggccttacgcgatcctcctgcctcagcctcataaatagctgggactaaaaggggcgcagcaccatgcc

SEQ ID NO: 714870 - DNA, 237 bp, Homo sapiens
cagggcatagaacagtaggaactatgttggccctgtgcggcaggcacatgcagccatgtcctgatccacggctgtgcttttattcttaaagaggatcatctagaatcctcagaaatgttctcttagcagccctgagatcatgccctcaataactctgccacgggacgagtgggagaaaccacagacctagagatgagtcaggatgcccactttgtgccttggggtaagctagggggg

SEQ ID NO: 714871 - DNA, 532 bp, Homo sapiens
aaaaatagacagtgcctttcaagagaaaaaaaatggtgctggcattttccctccggtaacctgaaaacataaggggtgtacttatattaaatatattcttacaaatgtccaggtcatgtttaccagcgggaatcctttaacttaaggtgtatttggcatggtgatattaaatcaagacattaacatgagtagaaggtggtggattaaagacaagttggagatccactaaaataaatggtggtatgttggtccttcgggtggcggtggaagcttcatattttcttgggacatcataagacgtctaagctctggaatgtacaactttaaggctatatgaatttggccatttggcaaacacgggatatgctcggggcatccaccatcccagtggaaataatttatcccggtgcatattaattttggtcacaaatctaactgagggaggagctcctgggtatgtaggcccacattctacttgcaggctatatatcctgtttgcataatctgtgcttggtgccccaataatcatgct

SEQ ID NO: 714872 - DNA, 235 bp, Homo sapiens
gtatttacagagtcggaaactgcatttcaggggaagattgatgctgcttaggttgagaccagcaaatacctgtgggatgctctcaataaaaagtacagcttgctgaaccacatgcgaataatgaggtcgtacctgctctttgttcaaggagactttataaggcacttaatggacttgctaaaaccaggacttgatcgcccagctacgactttggatcagcataactggacttgaa

SEQ ID NO: 714873 - DNA, 365 bp, Homo sapiens
  misc_feature (13)..(13): n is a, c, g, or t
  misc_feature (20)..(20): n is a, c, g, or t
  misc_feature (28)..(28): n is a, c, g, or t
  misc_feature (34)..(34): n is a, c, g, or t
  misc_feature (39)..(40): n is a, c, g, or t
  misc_feature (45)..(46): n is a, c, g, or t
  misc_feature (81)..(81): n is a, c, g, or t
  misc_feature (110)..(110): n is a, c, g, or t
  misc_feature (112)..(112): n is a, c, g, or t
  misc_feature (150)..(150): n is a, c, g, or t
  misc_feature (153)..(153): n is a, c, g, or t
  misc_feature (172)..(172): n is a, c, g, or t
  misc_feature (206)..(206): n is a, c, g, or t
  misc_feature (215)..(215): n is a, c, g, or t
  misc_feature (218)..(218): n is a, c, g, or t
  misc_feature (221)..(221): n is a, c, g, or t
  misc_feature (267)..(267): n is a, c, g, or t
  misc_feature (282)..(282): n is a, c, g, or t
  misc_feature (295)..(295): n is a, c, g, or t
  misc_feature (314)..(314): n is a, c, g, or t
  misc_feature (331)..(331): n is a, c, g, or t
  misc_feature (338)..(338): n is a, c, g, or t
  misc_feature (350)..(350): n is a, c, g, or t
  misc_feature (358)..(358): n is a, c, g, or t
tggaaaagaacgnaaatttnttgaaacnggtttnggggnnggggnnggggggacagcggggggttttccaaagagaactgnggggggggccagcgcccggccaggggggngngggggcctggccacagaccctatctcaggcccagcttnttnttttccttctgcttcttgnggaccacgtccagattccggtccttccacatgcncttgcgaanttnganggggggcgagccacaaacttcccattcatctcacgcatggggcgcncgttgtcgctggggnccttgaagctgangaagccgttgcccttggtnttgcctgtgcgcttttnacggatnaccttggccttnaggaaggntgggaag

SEQ ID NO: 714874 - DNA, 503 bp, Homo sapiens
gaacttctatgatttcacttcgttagtacgtgaattagatattcctggtgaaatttatgaaaggaagacgtctccatttgagttctcaactgttgaaatgccatacgacgtcttacaattgggacaaatgtcagactgaggtacattttgaaggtgacaattggcagaaactatgttgggaatattgtcgagtaccgggatttctgtgtgagaaactactcacctgtccctacgatcaataacagcattaaggttgaactggtacaatcttccatatcggcattgtgtgtgcctggggccttgacaatgttgacaaaatttcttttcacagttcatgttagctgtggtcagtggtcacagcaggttctagaaactcctgaagactgttctttttctttctttctgaaaactttgaattttagtcagtcttgttttgactaaatcggatacttcatagcccaatagacacttttgtccccttttaagaatggatactttttttt

SEQ ID NO: 714875 - DNA, 1502 bp, Homo sapiens
ggatcgaggtgctggctggggcagaagcagacaccctcccagacagagtgggcagtgatggtgtgtgcagtgagagttagcaaatgtgtgacatcttctcgtgggtgtgatgcctgagacttgctgcaatggcttggtgtgtgtgctatgtgtgccctgttccatgtgcatgaaatgatgcaatgagtggcagtggatggtgatgcacatgtggtgtgtgccatgctgtagtgtgtccatgcactgtggtgtgttgtgtacccacatgtgccttgtgtgtcatgacatgtggacaatggcatgtggtgacacatgtgacatgatgtgggtccccatgctgcacacctcaacccacactgcaagttcagtttatgtacgcatgtgcacatgtggtgcaatgctcctgtgcactgtgctttctcatgtgcctattgcctgtgagcctctgatgtggcttggacgatgcgtggaatgacatgtgcatgttgctcgtggtgacgtttgcatgcatgtgaacattcacacaagtgatggtgcgaaatgctgtgccacagggaagtggtgtgtgccccctggagacatttgcgacagccaatggatggctgcatggggtgctcggcactgctggtgcgccgtgtcccatcagacgggcacttgcagtgcccagggtcttggtgctgggaggatggggcccaacatgttggactctgggtgacgccttgtattgccctcaacctggatcaagaccctgagggcctggattgggcagacaagtacatgcatccacggggacgtcacatggcgcatggtcggagaatgacacgacctagcgctgaaggcctgtggcggtcggacggggagctgaaattgacggctctcccaggggacggggagggactggtcgcagggccaggggggtgacagagagcgtcacgcgggctggcaggagctggaagggcacttgtgccatccaggagacccggttgggcaaggcggggacatcagcgacgccggtccgaccggaacgacacggcagaaccagggaggaccaccagccagccacggaggccagtgcagaacagggccaaggagctacacgactgcggtgcaacgtgaccaacacaagtggccgaaggcccacagaacgccagggcacagcgtcgaccgtgacaacgccatcgacacatgaaccgcgtcgccagggttcagacagcgaacggcacagacagcagcagggagccggaggcaatagtaagaacccaaatagcagagcgagagccgctaccgaacgagggccagcccccatctaatccacacacgagtcttagacaatatgccagcccacagcactaaagaacaaaccagagcaacaggcgacaccacgtcctgagctcatcaacaacctcagtagactagaaccgcagcagacgaatcaagcgaaccgaagatgagcgacagaacagaggacgcgacacaaccgagatgcgctctcttaagagaag

SEQ ID NO: 714876 - DNA, 242 bp, Homo sapiens
  misc_feature (23)..(23): n is a, c, g, or t
  misc_feature (31)..(31): n is a, c, g, or t
  misc_feature (39)..(39): n is a, c, g, or t
  misc_feature (47)..(47): n is a, c, g, or t
  misc_feature (96)..(96): n is a, c, g, or t
ggtgagattagaggatcccagtncgggtctncacggtangtatgcanggatcgctgggccaataattatgtcagtgaatctgagactggtataaancactttagacattggtagaagggaattcgtagacttttcacttacatacgaaaggtttttttttttttttttttttttttttttttttttttttttttttttttttttttttttttttttttttttttttttttttttttcttttc

SEQ ID NO: 714877 - DNA, 91 bp, Homo sapiens
tcgaccaacaataaggccaactgtctttgctcaagctgtaactctcgccgcttgtactatacaccacctggagggagagtgggaacgtgag

SEQ ID NO: 714878 - DNA, 334 bp, Homo sapiens
tgtatgtcccgatgataaagaatattgtgccttagatcttatgtctctggctagggaagcagctaaaagcgaaggtagcttagatctaaggaccactgcacctaaaatcatcaagacctatatatcttctggtctcaatcctaccaaatcaaatcgtcacagctcacacctgttgttaataatacacacatacacacaataatatacacagtacaagtcaagactagtcatgaaaaaagtctttcaggctagcaaagctaattacttacttagtagctaaaattattccaatcataaataaacgcacagcaccattgaacagacgacatatttg

SEQ ID NO: 714879 - DNA, 165 bp, Homo sapiens
tccagtccccagcaacaccaagggacagctgcatattgttcactccttgattcttcatttagggaaaatgtctggaggatattggcatctgaagattcatagtctgagattttgcttatagatcaatttcaccatcagtagcatttagaatgttgctattggtgt

SEQ ID NO: 714880 - DNA, 442 bp, Homo sapiens
  misc_feature (6)..(6): n is a, c, g, or t
  misc_feature (26)..(26): n is a, c, g, or t
  misc_feature (53)..(53): n is a, c, g, or t
  misc_feature (109)..(109): n is a, c, g, or t
  misc_feature (434)..(434): n is a, c, g, or t
ccactngtatagtcaatgtgactggntttcaaaagccctttcagttatagagncaatgactgggcaacagaaatgcctttcatttatatcattcttctgttttcttggngcaaagggctgtagttaagaggaacagttagattttagtggcttaccaagttgctttagaggaagtctatgaaaggactgttgagccaaacaatgtccagattaaaaaccagtctgttagcaggacagaatcctcttgcagatactttgtttaacctttaacttagtgcaagaagagttcaagctatgacttttgagattaaatcttaaattatgtaagcatgtttctgataaggattgttttatcatctgcatcagaaccatttggactgctttaaaatacagatttttggactcctacccagatttactaaatcaaattctgngaatagaa

SEQ ID NO: 714881 - DNA, 173 bp, Homo sapiens
ttggaagtgtaagcccttgtcattaaaattttaggttaagaaaaaaattattttttgttcttagtctaatgtgaactgaatgcctgagagatgttgtgggcagttaattataaagtagtgtagttatgttaattctgaagtcattagagaagatgagaagataggatgcaatg

SEQ ID NO: 714882 - DNA, 425 bp, Homo sapiens
gacaaatgggaaccaggcaagtcctcaggcttgcaccaggtttacctaaagcttgttgccttttcttgtctgtttatccgcgtagagcactcaagaagttctgaaactgctttgtatctgctttgtactcttggtgccttcttggtccgtaccccagcatttgcatagattatttagtataatggtaagataaatgttaaggaagatttattaagaatctgaatgttattcattatttgttaccatttacattaacattgatttgtggtatttgtgatttggttaatctgtatgaaaattgtaagtagaaaggtttatatttcatcttaatctttggatgttgcccacgtacttgttggaagatggattatttgaatgctcatggcacctgacttgtaaaaaatacagactacagaaaaaaaaaa

SEQ ID NO: 714883 - DNA, 311 bp, Homo sapiens
gggctttttgaggggggtatggaaattaaatgttttcgttaaaaacttatccctattaaaacaggcagttgtttttttgaaaatgcctaaataacagtatttttaaaatttgacagacaagtaacaggtcaattacttgatattccttgtttccagtaccacaggccatttttgacatcccatgtttgcctggataaagttcctcatttcaaacagtaaaaaaacttttttgcagttcattaaagtaaggcttaacctgtaaacagtatttgatggcccccctataaataaaattcagcattttattttta

SEQ ID NO: 714884 - DNA, 754 bp, Homo sapiens
cggacgcgtgtggctaggcaggggaatctgaggcgcggctccggggattcggctcgggccgctggctctgctactgcgtggtgcatgtgtgatgctgtgtgccctgtgcccgtcggtgtgccctgatgcccgtccgtgatccggccccttcccctggtacccggccccctcggacgactacctctggctgctctgtgcgggttcagctgtgggccgggggacccgctgtggtccgtggccgccagtgccgtggcctacgcttgcctcgctgtcaggttgctagccggcccgcagtgggccctgtggccggtgggcccgtctaccccttggtgcttcagccccttggatgccttgctacagctgtcacccttggcgtggcagtgaggcccggtgcggccccaagtgcacccggtcaccaccaacccttggaatgaccgtcttagaagctttggccagcactgacgagcgggtcaaacagccgaaacgggcgtgccagcaggccttgggccacagacttacggggtggccatggcccctgggaacctggggaagcaggcggacgcacaaggccccgggtggggacccagggcgccgcaaggagctggcccagcggctgaagcaccgtattggggcgaagccacgacgcgcgttcgttagcgcgcttaaggcgggctcacttgcgaacacggcccccccgggggccaagtggcccggccccacaacacagcgaccggtcaagtggaccgccggcgta

SEQ ID NO: 714885 - DNA, 320 bp, Homo sapiens
gggattacaggctcataccaccatgcccagctaatttttgtattattattattgttttttagtagagacggggtttcaccatgttggccaggctagtcacgaactcctaacctcaggggatccacccacctgtgcctcccaaagtgctgtggattacaggcatgagctaccacacctggtttggagagtcttaattaaggacatttccctaatggtcatttattttgcttaaatcccagaccgtgtttcagagtgaatgcttactttgagagtagccattctcttgtcctgtactttgtcagaactaagaggagatagcc

SEQ ID NO: 714886 - DNA, 215 bp, Homo sapiens
attcgcggccgcgtcgacaagtgactaaaattttgaatttcttataaagaaatatctgtgaggcagggtgtggtggctcatccctgtaatccttgctacttgggaggctgaggcaggaggcttgcttgagcccaggtgtttgaggttacagtgagctatgatcatgccactgcactctccagcctgggcagcagaaagagaccctgtctcttaac

SEQ ID NO: 714887 - DNA, 349 bp, Homo sapiens
ttatactgtcacccaggctggagtgcagtggcaccatctctgctcactgcggccttgacctcctgggctcaagcgattctcctacccctcagctactctaggaggctgaggccggaggatggcttgagcctgggatttcaaggctgcagtgagctctgatcacgctactgccttccagcctgggcggaagaacgagacctcgtctcaaaaaaaaaaaagaaaggagaaacatggttgaaggcgataagtatgatggaaaaaaggatcaaggagcaggatgagggagagatcacagttggagggggtacattttattttattatattattattctttgagactccatcgc

SEQ ID NO: 714888 - DNA, 168 bp, Homo sapiens
  misc_feature (141)..(141): n is a, c, g, or t
  misc_feature (153)..(153): n is a, c, g, or t
cagagatcttccaaaaatttattaagtgtttacttttaaagtggaaacaatgtttttaagaggtgatataaagaatggcccccactgtaatccctaccatatgttgattctatgttgggtgtttggaggggagaatgattnctttttctagantcagagaattgggaa

SEQ ID NO: 714889 - DNA, 137 bp, Homo sapiens
aatgaatagtaatttttgactctgccttataatcttaacaaacattttctcttgctctagtcttactttattgagtaatgaagtacagtatattatacatattctaacatagaatcacatcagtgtgatacctaaaa

SEQ ID NO: 714890 - DNA, 103 bp, Homo sapiens
tgtatcccaaaaacagcccacatcatcctttccccatcacaggacttctgcctctgagtccaaagtagttgccccaattcctgccatcacatctgcaccccag

SEQ ID NO: 714891 - DNA, 300 bp, Homo sapiens
  misc_feature (7)..(7): n is a, c, g, or t
  misc_feature (18)..(18): n is a, c, g, or t
  misc_feature (68)..(68): n is a, c, g, or t
  misc_feature (138)..(138): n is a, c, g, or t
  misc_feature (141)..(141): n is a, c, g, or t
  misc_feature (156)..(156): n is a, c, g, or t
  misc_feature (185)..(188): n is a, c, g, or t
  misc_feature (204)..(204): n is a, c, g, or t
  misc_feature (208)..(208): n is a, c, g, or t
  misc_feature (213)..(213): n is a, c, g, or t
  misc_feature (233)..(233): n is a, c, g, or t
  misc_feature (247)..(247): n is a, c, g, or t
  misc_feature (255)..(257): n is a, c, g, or t
  misc_feature (274)..(274): n is a, c, g, or t
  misc_feature (283)..(283): n is a, c, g, or t
  misc_feature (287)..(287): n is a, c, g, or t
  misc_feature (300)..(300): n is a, c, g, or t
tgatgtntccaacgtccnttgtcactggtcgtggtgagggatgaggaagcgagtttcagagcccgtgnagatatgctgcccgtgagaaggattatgaggaggttggtgtggatctgttgaagagaggtgagtaagaanatnaggaatactaattanccatccttttgccctcacatgcatctccnnnnaattcacttcacttantggnagcgntaaactttctggtaagatantttcacttgtgacngctttccnnnggacgggaaatttcccngcaatcgcnaatnaaagcataacagn

SEQ ID NO: 714892 - DNA, 163 bp, Homo sapiens
  misc_feature (43)..(43): n is a, c, g, or t
ccagggatggccaggatgatgggggaggaggagggaaattttngcgggtgggaagtataaaaaggaaatttatttaaattaaaaaacaaaacagaagagatgtcaggaactttttttaattcctttcttttcagaataatatattaaaagactcatgatccta

SEQ ID NO: 714893 - DNA, 1045 bp, Homo sapiens
  misc_feature (203)..(203): n is a, c, g, or t
  misc_feature (216)..(216): n is a, c, g, or t
  misc_feature (395)..(395): n is a, c, g, or t
  misc_feature (435)..(435): n is a, c, g, or t
  misc_feature (640)..(641): n is a, c, g, or t
  misc_feature (658)..(658): n is a, c, g, or t
  misc_feature (717)..(717): n is a, c, g, or t
caggaaggcctggagggatggcagacgcgcatctcccagaaggagctggagcagcagcaacagcaggtggtgcagctagaaggggtggagaatggcactggccggaaccttctggggcaactcatcaacattctcctgggctggcatgggcagtccttttgggtctttggtctccactggttagccaactggtggtggtcccncctctatgtaagnaatcggccaaccgaggacggttacagaccacatttcaattcccttggtagggttatattatatgcgcccttatctcctgggaagaccactggaggacaggcccctccttcacggctaatggtgtgagaacggggttccctttatcacatctccccttaagaatgacatgtgcttggcancacgacacgcggcacttttgggttccccttaaccccctcntgtggcggaaggtggcaatgtgacggcacgacagaaggttacgaacacggcacaactgtatacctatacttcctggaaaggttttttcctataccaagcaagacacacaacggaaggtttgaaggtgtaacatctctggttgtatcacattatatgacagtatagtggggttattattatcgtttcacaaggaagaacgggccannttgggccactaaggtanatatttcttaagaaatcttttcatctccaaagaaaaggtatttatttggggggcgaaanaaatccttggggttcacattttttgatggttcggcattgagttttttcccttgggggattgcaaactcctttacaaccgggtccttttaatattgaaacccagcatctggggagcacagcggagagggtgatctaaattgttggcttacggacgggctaaaaaccccttaaagaatggccgttttggggacccgtttactaaaccctcttgtgggggcctaccttcctttcacaaattgtgtggaccctctatctggtagttaccacggggtggtttgttgggcaacacctgttctccgaggtattcccgtattgatggcccgtatct

SEQ ID NO: 714894 - DNA, 4742 bp, Homo sapiens
gtagcagtgcagactgcctcaaaacaagttgatggtgattatgttgtgtctgaatggagtgaaattatagaattctgcaccgcagactattcaaaagttcatctaacacaattgttggagaaggctgaagtgattgcaggacgcatgcttaagttttctgttttttatcgtaatcagcacaaagaatattttgactatgttcgagaacatcatgggaatgctatgcagccatctgtcaaggataacagtggtagccatggctctcctatcagtggaaaattagaaggcatcttcttcagctgcagcactgaattcaatactggaaagccaccccaggattcaccttatggaagatacaggtttgagattgccgcagaaaaactttttaaccccaatactaacttatactttggggacttctactgtatgtacactgcttatcattatgtgattcttgttattgctcctgtgggatcaccaggagatgaattttgtaagcagcgccttcctcaactaaattctaaggataataaatttttgacctgtacagaagaagatggggtgctggtttaccaccatgcccaggatgtcattttagaagtcatttacactgaccctgtggatctttctctgggcaccgtggcagaaatcactggtcatcagctcatgagtttgtctactgcaaatgcaaagaaagatcccagctgcaaaacctgtaatatcagtgttggacgttaatgcccacttttcttattcttactcagccccttttcctcccttaggagcattggtcctctgttgtccatttttatcaccagatgttttccactgaagcatgcacatgccactgtcaccaaaacaaacaactaccactttccaaatttcattcagaaccattttagtgttttcctattccctacccctcccactactttcaatgatgaaataccctaagttaagttctccttttgacactttattgcctagatgctgcaatgtttttatgtttcctttatgccaaacataacaaaacagttatatagactgctttagcaaagtacacaataatggcttataaatggtgtttaaatatgcattcattttaatctactgaacaaatattgggataactccaaaccgcatgaaagggtgtaattgcagcatgagttaaatcttgaagcctagaattgtcagcacttccaacttcttgtttgacagtgttatttatgttatttatattagctaacaggaaacaactactgtgtttcaacataataaatataatagaaaaatattttatttgtattgttgtataaaatatttacaatcatatagaatatatagagttacattttaatagcaactgtgtacatgtcacgaaaccatttcccttatcaaagatgtaatttgtaaacctcaaatagttgtgtatctgtcctgttagaagtagatgacttcaattaaacaaatttatgaaggacattattctgattcataaaagttataaaatattaggtaaatacagagaaaacaataagcctctgaaataagtctgtttctgaaatagtcaatagtcttcccatccaaactataagagaatgtgaatttcttcaacatcatacttaaacattacagaaaatagaaatacaaacaaggttggtacatgagagaaaatgttgaccttttacttccttttacaaaaatgaaaataataaacatgttttcgtataaaataacacaaaatgatatacactgaagttgatgaagcaaataaatattctggcttctttttcaaggtatcagggcaaacaatttccaaacttttcattttgtacagaaggatgaataactacagctcatgggaaatgttttgactttacaaagtatagatgttggaacattaagaaaaatgtatattcccaatgaaaaaatagttatatcatcttatagtaaaccaaaagattagcaataatactatggacacattagattatatactacagacacatatctatccaaaatacctattttaaatttttaatacaatattttattttaatataaacatctgtcagttatagacaaagataataattcacaaagtacatgctatcagaatgaactttggtaaccagaaatgtaaaatttcaaataacggataaaataatgtgttatttttatagagaaagaaaaaaaatagcaacacaatctagtttattttagggtactgagagcctagcagacttaaaggacaaggtagtaaatgttttatcactcaaaaatccattagaagtttcaaataaattgctttcttgctagctgtattccttcctacttgaaaagcgaatttcttttcctcctatgattgattttttaaaatcatgctcttttccatacatcaacataaacagtctttggatactaaataaactttccctaacaagtgtcctagctatgttatttagatttgataaaatattagacatttttaaaaatacttgtattgactatgagttttctgcttggcatggaggacactgaattttttcccaattatatggctacctgttgtattcttccccccgtttaaatcccttctccttgtatataattaaacttgctattccttcttaaaaacagctaatactaccactaaagtgcttccattttcattgtgtcaaaactacttagcaaggatggcagaggaaaataaactttactttatatcatgggtgaaagtgatcataacatttcctgaacctcaaatagttttggccacatcttgcttgctgatgaggacctctaatagtctcagtttggcttttatgtgcttatattcataatactcatctgccattggtatcctatcttccttttgtggacttctgcaaaacaaaaatacatttgttagttcacaatgagtcaagtcattatttaaacattcttttataattcatacatgagaaagtatatgaggacctctaatagtctcagtttggcttttatgtgcttatattcataatactcatctgccattggtatcctatcttccttttgtggacttctgcaaaacaaaaatacatttgttagttcacaatgagtcaagtcattatttaaacattcttttataattcatacatgagaaagtatactgtaacagcctccacttggtttttgcatcatgtcttcttttccttccctttcaccttcattcactccttcttccatgtgttactaagtttctaaataatagtaacctttgaaaacttgaatgtcataagtgttttgcaaatatgtggtctagtgcttagacttacaacaaaggggtcagtgaaaagatctaaggagaagcaaacaaacaagaaacagaactttcaaggcattctttgtccagtcattcttccattatttgccacacccctacagctgtacaaaatgatcagccctaatacagttgttaaaaatattaacctgaaaatactacaggaatttcattataaaaataacataaacctatggtaacaagaaaagcatttagggtctgtcttacaaacttgaaacgtttccagattttcttgtaattataatacctatctctgctaatatatagtagaaccactgagctgttccttgattgaagtaattgacaagagtctaaattgtggtggttctcttctgtacactaattctactaaggctagacatgtaacaatgcatagatttttatacatatgcagcatactcttgctgtttacttggaagaataacttggtaatatcaggagttaaaaccatttgccttcccacaaaaatatgttgtcaggaaacgttttctaaagggaaaaattgcgacagggtctcagaaggctcttgttttcttggttaataagatagccaatcgttttgaaaacatttccacccacgactttgaaattcaaggggtagaggacacagatatagtcaccacaattacaactgaatataaccacaagtattctctaatgttagtatggctgaaaccaggtaaatagcatatatttaatgttttatctttagctcccttttatttttcccagtagtgataaagagatatttctatctcttaccaaataaaaaacaagctaatctatacaaattaagaatatagtatctacttgtatttcaacactatttattgccctgcaatttctagtacagaactcagaacagtatacaaatccatagacagcattcttcttaactgttgtctaaattatataacatatatctttgcctccattctgtgttatgagtcaaacttatcatggctggatgtctgaataccaccttaatttgtataaatagatctaagtaaagaaattgtctaattattacagagaaacattaataatcaattatgtaattttccgtagttttgcatattccattttggctaataagagtgctttgaggccgggcacagtggctcacgcctgtaatcccagcactttgagaggccgaggcgggcggatcacaaggtcaggagattgagaccatcctggctaacatggtgaaaccctgtctctactaaaaatataaaaacttagccacgcgtggtggcgtacgcctgtagtcccagctacttgggaggctgaggcaggagaatggcgtgaaccgtgaacccaggaggcggagcttgcagtgagccgagatcgcgtcactgcactccagcccaggtgacagagtgagactccgtctcaaaag

SEQ ID NO: 714895 - DNA, 253 bp, Homo sapiens
aggatatcaccactgctattccagacctgtatctattaataaattactattttagtcgggcgtgttggcatgcgcctgtagtctcagctactgtggaggctgaggtgggaggatagcttgagcccaggaggtcgaagtctgaactgagcggtgattcacgcctctgcactcaagcctggatgacagagccagaccctgtctcaaatgaagtaaaataggccaggcacggtggcccacgcctgtaatcccagca

SEQ ID NO: 714896 - DNA, 261 bp, Homo sapiens
ggtggcaattctcccacttggaatggtgtatatacccaatgtatctaggaagtaactaacttgcttttgatttacaggctcataggcagaagggacttgcttgtctcagatgagacttaggactgtggacttttgagttaatgttgaaatgagttaagactttgggggactgtgggaaggcatgatttcttggaaatgtgaggacatgagattggggaggggccaggggtggaatgatatggatgggctgtgtccccacac

SEQ ID NO: 714897 - DNA, 165 bp, Homo sapiens
aagtgacgagcgagacctcgtcaaataagaaaaagaatgaatgaagcgaaatgccatttctctagtgagaaactggaatattatcaatgtcacttcttcccaaattgatttataatttaaaaacaattttagtacttctgcaacttgtctggagtacggtcaact

SEQ ID NO: 714898 - DNA, 350 bp, Homo sapiens
tcgtagaaactgtaaatggatattggatagcactaatgattacgtatggagacgggaatatcatcatctaaaatctagacagaagccctctcaaaaactacttagtgatatctgcattcaagtcacagagttgaacattcgctttcttagagcacgttggaaacactctttttgtagtgtctggaagtggacatttggagcgctaagatgccataggtgaaaaagggaatgtcttcccataaaaactagacagaagcattctcagaaacttgtatgtgatgtgtgtacccagccaaaggagtagaacacttactattgatagagcagataagaaacgcacttatagtgga

SEQ ID NO: 714899 - DNA, 90 bp, Homo sapiens
tgtcactcggaacttcaggatggaggaccctgaccctaagcctccttcagatctctggcccaggctcaagcctagagatgggcagggcta

SEQ ID NO: 714900 - DNA, 251 bp, Homo sapiens
cgtcgacgtttttcatcttggaaggataacaattcatgaaaataaaattacttcaggttattttaagagaccaattattgcccatgtttcatcagttagctgatggtcagctctggccacagtggtaagagagaaagaaaagacaggatctagacaggaaatctgggcaacagaagactgagcctcagctaaaaaggctcagctgtgtcagactcaagttatctatttgagatacactctttggtcgacgc

SEQ ID NO: 714901 - DNA, 2995 bp, Homo sapiens
ccggaagcccatccaccaatcctcacctctcacctctgtgtccgccctgctgggaaatattccaggctttggccaaggccagtgcagccccaggttcccgagcggcaggttgggtgcggaccatggcctctcacaagctgctggtgaccccccccaaggccctgctcaagcccctctccatccccaaccagctcctgctggggcctggtccttccaacctgcctcctcgcatcatggcagccggggggctgcagatgatcgggtccatgagcaaggatatgtaccagatcatggacgagatcaaggaaggcatccagtacgtgttccagaccaggaacccactcacactggtcatctctggctcgggacactgtgccctggaggccgccctggtcaatgtgctggagcctggggactccttcctggttggggccaatggcatttgggggcagcgagccgtggacatcggggagcgcataggagcccgagtgcacccgatgaccaaggaccctggaggccactacacactgcaggaggtggaggagggcctggcccagcacaagccagtgctgctgttcttaacccacggggagtcgtccaccggcgtgctgcagccccttgatggcttcggggaactctgccacaggtacaagtgcctgctcctggtggattcggtggcatccctgggcgggacccccctttacatggaccggcaaggcatcgacatcctgtactcgggctcccagaaggccctgaacgcccctccagggacctcgctcatctccttcagtgacaaggccaaaaagaagatgtactcccgcaagacgaagcccttctccttctacctggacatcaagtggctggccaacttctggggctgtgacgaccagcccaggatgtaccatcacacaatccccgtcatcagcctgtacagcctgagagagagcctggccctcattgcggaacagggcctggagaacagctggcgccagcaccgcgaggccgcggcgtatctgcatgggcgcctgcaggcactggggctgcagctcttcgtgaaggacccggcgctccggcttcccacagtcaccactgtggctgtacccgctggctatgactggagagacatcgtcagctacgtcatagaccacttcgacattgagatcatgggtggccttgggccctccacggggaaggtgctgcggatcggcctgctgggctgcaatgccacccgcgagaatgtggaccgcgtgacggaggccctgagggcggccctgcagcactgccccaagaagaagctgtgacctgcccactggcacacagctggcactggcacacacctgtcccatgcccaccctgagggatcaggagcaaacagaccctgcaaggtcctccaggcctggggacaggaaagccactgacccagcccgggaggcagaaccaggcagcctccctggccccaggcagcccttttccctccagtggcacctcctggaaacagtccacttgggcgcaaaacccagtgccttccaaatgagctgcagtccccaggccatgagcctcccgggaatgtttaataaagggcctggccacctctcctcactgtgtggggtggtctgtgaaagagtgagaggagagcatctctgctccctgagctgcctgattgtggactttagggggacactcctcatcctggagcccacagggtagatcctcccctggaggaggtgctgtcaccacactctagccccagatgtcacacccccaaacgtcctcacgcaccacatccaggtgaacccacatggcgcacagggctggttggagacccctgtcatggacaagggtacctgcgtgctggagagcgcacagccaggacctgagcccatgacacgtggaagcctccaatggaaggtcccctatgctcccatccagccagtgcccacccctcaactgcctgacttctgtgaccatagatcagcctggcatatttgaatttatttatttatttggaaacggagtttcactcttgttgcccacgctggagtgcagtggcatgatctcagctcactacaacctccacctcccgggttcaagcgattctcctgcctcaggctccggattagctgggactacaggtgtgcaccaccatgcccggctaatttttgtatttttagtacagatggggtttcactatattggccaggctggtctcgaactcctgacctcaagtgatccacctgcctcggcctcccaaagtgctgggattacaagcgtgagccactgtgcccagccatagttgaatttcatggtcagtggaacacacagcaggtcctccactgtgccagcttctttcacttactgtttttgacactcacatgtaccgtcgtgggcgccggtgtgtctttgttgctgagtgccgtcccgtcatatggacgtgcgtcggggcccccggtgtgtcttgttgctgagtgccgtcccgtcatatggacaccccatgaattggtgggtcaatcaccataggtgaacatctggggttatttctattttggggctgttttgaatacggaggtagtgaaattcttactcaagccttcgtgtggccatatattttcatttttcttggataaataactaggagtggaattgcagggtcatacaataggcttaaccttatacgagactgccacgaaattctccgaagtggctcttccatgtttcattcccgcagctacagcgtccagggtgctccacgtcctcacccacactccatgttgtctttttttgctagggggtgtaaaatcctgtctgatttggttttagtttgcatttccctgatgcctattgatgttgagcaacttctcataagctatcggccgtttgtagatcttctgaaaagtgtcagttcaaatattttgttcatatttggatttttatcttcttattgtcaatgtgtgatcattttaaaatatattctagatactatcagaaaaaaaaaaaa

SEQ ID NO: 714902 - DNA, 2651 bp, Homo sapiens
ctggcagagtgcagattgcaggggcacatgcgcagagaagacgggccagggccagagtagagagcagctgctgctccggggacccacctggggtggccatgagagctggtggctggaggccgggaggacccgtgaccagaggtaatggcactgaggggcccagggctggagagaccacccctcacctgtccagagctgaggcaggagcagtgctgtggaggatgccaggtcgggggagctggccctgagaggagagggggcctgggagccagcaccctgagccctggccctgatccactccagccctgtgtagcccaacagcccttcccctccttgcccagtcccctccccctgcaaggcactctccactcttctcccccaggggccacaggcagacctcccctctgtctctctgaaccctcctctgtctctcccagacccagatgtttccttctgccctggggtagtcccaggccctgccccaggcaaagtcaaactgggggctccaggggctcccctgcaccaaggcctgcagagtcaggttcttcctcccgcaccacagagggcggggcttcctgcccaccccacccatgtcactgcccaccagcgccatctcccacacagggcctggagaacagctggcgccagcaccgcgaggccgcggcgtatctgcatgggcgcctgcaggcactggggctgcagctcttcgtgaaggacccggcgctccggcttcccacagtcaccactgtggctgtacccgctggctatgactggagagacatcgtcagctacgtcatagaccacttcgacattgagatcatgggtggccttgggccctccacggggaaggtgctgcggatcggcctgctgggctgcaatgccacccgcgagaatgtggaccgcgtgacggaggccctgagggcggccctgcagcactgccccaagaagaagctgtgacctgcccactggcacacagctggcactggcacacacctgtcccatgcccaccctgagggatcaggagcaaacagaccctgcaaggtcctccaggcctggggacaggaaagccactgacccagcccgggaggcagaaccaggcagcctccctggccccaggcagcccttttccctccagtggcacctcctggaaacagtccacttgggcgcaaaacccagtgccttccaaatgagctgcagtccccaggccatgagcctcccgggaatgtttaataaagggcctggccacctctcctcactgtgtggggtggtctgtgaaagagtgagaggagagcatctctgctccctgagctgcctgattgtggactttagggggacactcctcatcctggagcccacagggtagatcctcccctggaggaggtgctgtcaccacactctagccccagatgtcacacccccaaacgtcctcacgcaccacatccaggtgaacccacatggcgcacagggctggttggagacccctgtcatggacaagggtacctgcgtgctggagagcgcacagccaggacctgagcccatgacacgtggaagcctccaatggaaggtcccctatgctcccatccagccagtgcccacccctcaactgcctgacttctgtgaccatagatcagcctggcatatttgaatttatttatttatttggaaacggagtttcactcttgttgcccacgctggagtgcagtggcatgatctcagctcactacaacctccacctcccgggttcaagcgattctcctgcctcaggctccggattagctgggactacaggtgtgcaccaccatgcccggctaatttttgtatttttagtacagatggggtttcactatattggccaggctggtctcgaactcctgacctcaagtgatccacctgcctcggcctcccaaagtgctgggattacaagcgtgagccactgtgcccagccatagttgaatttcatggtcagtggaacacacagcaggtcctccactgtgccagcttctttcacttactgtttttgacactcacatgtaccgtcgtgggcgccggtgtgtctttgttgctgagtgccgtcccgtcatatggacgtgcgtcggggcccccggtgtgtcttgttgctgagtgccgtcccgtcatatggacaccccatgaattggtgggtcaatcaccataggtgaacatctggggttatttctattttggggctgttttgaatacggaggtagtgaaattcttactcaagccttcgtgtggccatatattttcatttttcttggataaataactaggagtggaattgcagggtcatacaataggcttaaccttatacgagactgccacgaaattctccgaagtggctcttccatgtttcattcccgcagctacagcgtccagggtgctccacgtcctcacccacactccatgttgtctttttttgctagggggtgtaaaatcctgtctgatttggttttagtttgcatttccctgatgcctattgatgttgagcaacttctcataagctatcggccgtttgtagatcttctgaaaagtgtcagttcaaatattttgttcatatttggatttttatcttcttattgtcaatgtgtgatcattttaaaatatattctagatactatcagaaaaaaaaaaaa

SEQ ID NO: 714903 - DNA, 311 bp, Homo sapiens
agcaccagcaagtccgccagatccggaagaagatgatgaactcatgacccgagaggtgcagactaatgacttgaaggaagtagttaataaactgattccagacagcattgggaaagacatagaaaaggcttgccagtccatttatcctctccatgacgtctttgttagaaaagtaaaaatgctgaagaaacccaagtttgaattgggcaactcatggagctgcatggggaaggcggcagctctggcaaagcagctggagacgagacgggtgctaaggttgagcgagctgacggatatgaaccgccagtcca

SEQ ID NO: 714904 - DNA, 1595 bp, Homo sapiens
ccggaagcccatccaccaatcctcacctctcacctctgtgtccgccctgctgggaaatattccaggctttggccaaggccagtgcagccccaggttcccgagcggcaggttgggtgcggaccatggcctctcacaagctgctggtgaccccccccaaggccctgctcaagcccctctccatccccaaccagctcctgctggggcctggtccttccaacctgcctcctcgcatcatggcagccggggggctgcagatgatcgggtccatgagcaaggatatgtaccagatcatggacgagatcaaggaaggcatccagtacgtgttccagaccaggaacccactcacactggtcatctctggctcgggacactgtgccctggaggccgccctggtcaatgtgctggagcctggggactccttcctggttggggccaatggcatttgggggcagcgagccgtggacatcggggagcgcataggagcccgagtgcacccgatgaccaaggaccctggaggccactacacactgcaggaggtggaggagggcctggcccagcacaagccagtgctgctgttcttaacccacggggagtcgtccaccggcgtgctgcagccccttgatggcttcggggaactctgccacaggtacaagtgcctgctcctggtggattcggtggcatccctgggcgggacccccctttacatggaccggcaaggcatcgacatcctgtactcgggctcccagaaggccctgaacgcccctccagggacctcgctcatctccttcagtgacaaggccaaaaagaagatgtactcccgcaagacgaagcccttctccttctacctggacatcaagtggctggccaacttctggggctgtgacgaccagcccaggatgtaccatcacacaatccccgtcatcagcctgtacagcctgagagagagcctggccctcattgcggaacagggcctggagaacagctggcgccagcaccgcgaggccgcggcgtatctgcatgggcgcctgcaggcactggggctgcagctcttcgtgaaggacccggcgctccggcttcccacagtcaccactgtggctgtacccgctggctatgactggagagacatcgtcagctacgtcatagaccacttcgacattgagatcatgggtggccttgggccctccacggggaaggtgctgcggatcggcctgctgggctgcaatgccacccgcgagaatgtggaccgcgtgacggaggccctgagggcggccctgcagcactgccccaagaagaagctgtgacctgcccactggcacacagctggcactggcacacacctgtcccatgcccaccctgagggatcaggagcaaacagaccctgcaaggtcctccaggcctggggacaggaaagccactgacccagcccgggaggcagaaccaggcagcctccctggccccaggcagcccttttccctccagtggcacctcctggaaacagtccacttgggcgcaaaacccagtgccttccaaatgagctgcagtccccaggccatgagcctcccgggaatgtttaataaagggcctggccacctctc

SEQ ID NO: 714905 - DNA, 182 bp, Homo sapiens
taaaacgggaaatttttaatttcttttttaaaaaaataaatttgtctcttagaggtaaaattttctttaaaaaaaattgtcaaatgtcaaagttttaaacccattcccaagatttttatgttttttaaagaaattttgttggggaaaattgatcggattgattaaaaaaccaattttttgga

SEQ ID NO: 714906 - DNA, 2437 bp, Homo sapiens
ccagcacagcagagggagaagctgcgctcgctcaggcctgaggtcatggctgccacgcagcagtgcccagatttgaacccaggactcccttccacatctcccctgctatcgtgtacggattcgtggtagggtcgtagcctaccagcccattagctaggcaggcatcccgctggactggcctgccctgaggtgggactcacccgtcccgagcccacccatctacaggcatcgacatcctgtactcgggctcccagaaggccctgaacgcccctccagggacctcgctcatctccttcagtgacaaggccaacttctggggctgtgacgaccagcccaggatgtaccatcacacaatccccgtcatcagcctgtacagcctgagagagagcctggccctcattgcggaacagggcctggagaacagctggcgccagcaccgcgaggccgcggcgtatctgcatgggcgcctgcaggcactggggctgcagctcttcgtgaaggacccggcgctccggcttcccacagtcaccactgtggctgtacccgctggctatgactggagagacatcgtcagctacgtcatagaccacttcgacattgagatcatgggtggccttgggccctccacggggaaggtgctgcggatcggcctgctgggctgcaatgccacccgcgagaatgtggaccgcgtgacggaggccctgagggcggccctgcagcactgccccaagaagaagctgtgacctgcccactggcacacagctggcactggcacacacctgtcccatgcccaccctgagggatcaggagcaaacagaccctgcaaggtcctccaggcctggggacaggaaagccactgacccagcccgggaggcagaaccaggcagcctccctggccccaggcagcccttttccctccagtggcacctcctggaaacagtccacttgggcgcaaaacccagtgccttccaaatgagctgcagtccccaggccatgagcctcccgggaatgtttaataaagggcctggccacctctcctcactgtgtggggtggtctgtgaaagagtgagaggagagcatctctgctccctgagctgcctgattgtggactttagggggacactcctcatcctggagcccacagggtagatcctcccctggaggaggtgctgtcaccacactctagccccagatgtcacacccccaaacgtcctcacgcaccacatccaggtgaacccacatggcgcacagggctggttggagacccctgtcatggacaagggtacctgcgtgctggagagcgcacagccaggacctgagcccatgacacgtggaagcctccaatggaaggtcccctatgctcccatccagccagtgcccacccctcaactgcctgacttctgtgaccatagatcagcctggcatatttgaatttatttatttatttggaaacggagtttcactcttgttgcccacgctggagtgcagtggcatgatctcagctcactacaacctccacctcccgggttcaagcgattctcctgcctcaggctccggattagctgggactacaggtgtgcaccaccatgcccggctaatttttgtatttttagtacagatggggtttcactatattggccaggctggtctcgaactcctgacctcaagtgatccacctgcctcggcctcccaaagtgctgggattacaagcgtgagccactgtgcccagccatagttgaatttcatggtcagtggaacacacagcaggtcctccactgtgccagcttctttcacttactgtttttgacactcacatgtaccgtcgtgggcgccggtgtgtctttgttgctgagtgccgtcccgtcatatggacgtgcgtcggggcccccggtgtgtcttgttgctgagtgccgtcccgtcatatggacaccccatgaattggtgggtcaatcaccataggtgaacatctggggttatttctattttggggctgttttgaatacggaggtagtgaaattcttactcaagccttcgtgtggccatatattttcatttttcttggataaataactaggagtggaattgcagggtcatacaataggcttaaccttatacgagactgccacgaaattctccgaagtggctcttccatgtttcattcccgcagctacagcgtccagggtgctccacgtcctcacccacactccatgttgtctttttttgctagggggtgtaaaatcctgtctgatttggttttagtttgcatttccctgatgcctattgatgttgagcaacttctcataagctatcggccgtttgtagatcttctgaaaagtgtcagttcaaatattttgttcatatttggatttttatcttcttattgtcaatgtgtgatcattttaaaatatattctagatactatcagaaaaaaaaaaaa

SEQ ID NO: 714907 - DNA, 993 bp, Homo sapiens
atgacccaccaatcacatgcctatcatatagtaaaacccgagcccatgaccccttaacaggggccctctctagccctcctaatgacctccggcctagccatgtgatttcacattccactccattacgctcctcatactaggcctactaaccaacacactaatccatataccaatgatggcgcgatgtaacacgagaaagcacattaccaaggtcagcaacgagaccacctgtccaaagaaggccttcgatagctgggataatcctatcgagtacctcagaagtgcttctcttcgcaggattttactgagtcctttataccactcgagacgcatagggacctaaccgcagccaacttaggagaggacccctggagcacaggagaaagggcattcaacgccgtctaaattcccgcgtagaatgtccacagtccctaaaagcagcattctcgtactaagcttcggcagtgcagggacgtatcaactctacgctgagggcatcacccattacgtctagaatagtaaaaccagccggtgaccaaaataagatccatcggacacaatgccgactggattacaagagtgaagaacctggggcgtccctcttaagtcgttagcccgcatccttaacagaggcagctcatcacagaaggtaacgttccagaaaggtcaccaccgcggtgacaacgcaagtttatacccgagcgaggctgtccttacaccggagcagtatccacaagcaaaattcgttggtacaggggcaagaccctactcgagaggcctcttccacacaaccgcgggagccgtatgcaccccggtgtaacgctgccacattcaggagggcaattccaccaagcgttacagcgcggcctcactagactcaactatcctcgtgactgtccaagaatcgcaccggggcacctaagcggcaacgtatctttttagccaaagcgtcgattgtcacgcaccgatcccccatgaactctcagatttcgc

SEQ ID NO: 714908 - DNA, 2516 bp, Homo sapiens
ggagatgccccagcctcctcctcccatgcacaccatcagggaggagtagaggcaggcccagccctgctacctggagctgtgccacccatgggggttgtgggggtgtctggcccctgccctctgaactccaccacagcgtccctgcttcctcagggcctggcccagcacaagccagtgctgctgttcttaacccacggggagtcgtccaccggcgtgctgcagccccttgatggcttcggggaactctgccacaggtacaagtgcctgctcctggtggattcggtggcatccctgggcgggacccccctttacatggaccggcaaaagaagatgtactcccgcaagacgaagcccttctccttctacctggacatcaagtggctggccaacttctggggctgtgacgaccagcccaggatgtaccatcacacaatccccgtcatcagcctgtacagcctgagagagagcctggccctcattgcggaacagggcctggagaacagctggcgccagcaccgcgaggccgcggcgtatctgcatgggcgcctgcaggcactggggctgcagctcttcgtgaaggacccggcgctccggcttcccacagtcaccactgtggctgtacccgctggctatgactggagagacatcgtcagctacgtcatagaccacttcgacattgagatcatgggtggccttgggccctccacggggaaggtgctgcggatcggcctgctgggctgcaatgccacccgcgagaatgtggaccgcgtgacggaggccctgagggcggccctgcagcactgccccaagaagaagctgtgacctgcccactggcacacagctggcactggcacacacctgtcccatgcccaccctgagggatcaggagcaaacagaccctgcaaggtcctccaggcctggggacaggaaagccactgacccagcccgggaggcagaaccaggcagcctccctggccccaggcagcccttttccctccagtggcacctcctggaaacagtccacttgggcgcaaaacccagtgccttccaaatgagctgcagtccccaggccatgagcctcccgggaatgtttaataaagggcctggccacctctcctcactgtgtggggtggtctgtgaaagagtgagaggagagcatctctgctccctgagctgcctgattgtggactttagggggacactcctcatcctggagcccacagggtagatcctcccctggaggaggtgctgtcaccacactctagccccagatgtcacacccccaaacgtcctcacgcaccacatccaggtgaacccacatggcgcacagggctggttggagacccctgtcatggacaagggtacctgcgtgctggagagcgcacagccaggacctgagcccatgacacgtggaagcctccaatggaaggtcccctatgctcccatccagccagtgcccacccctcaactgcctgacttctgtgaccatagatcagcctggcatatttgaatttatttatttatttggaaacggagtttcactcttgttgcccacgctggagtgcagtggcatgatctcagctcactacaacctccacctcccgggttcaagcgattctcctgcctcaggctccggattagctgggactacaggtgtgcaccaccatgcccggctaatttttgtatttttagtacagatggggtttcactatattggccaggctggtctcgaactcctgacctcaagtgatccacctgcctcggcctcccaaagtgctgggattacaagcgtgagccactgtgcccagccatagttgaatttcatggtcagtggaacacacagcaggtcctccactgtgccagcttctttcacttactgtttttgacactcacatgtaccgtcgtgggcgccggtgtgtctttgttgctgagtgccgtcccgtcatatggacgtgcgtcggggcccccggtgtgtcttgttgctgagtgccgtcccgtcatatggacaccccatgaattggtgggtcaatcaccataggtgaacatctggggttatttctattttggggctgttttgaatacggaggtagtgaaattcttactcaagccttcgtgtggccatatattttcatttttcttggataaataactaggagtggaattgcagggtcatacaataggcttaaccttatacgagactgccacgaaattctccgaagtggctcttccatgtttcattcccgcagctacagcgtccagggtgctccacgtcctcacccacactccatgttgtctttttttgctagggggtgtaaaatcctgtctgatttggttttagtttgcatttccctgatgcctattgatgttgagcaacttctcataagctatcggccgtttgtagatcttctgaaaagtgtcagttcaaatattttgttcatatttggatttttatcttcttattgtcaatgtgtgatcattttaaaatatattctagatactatcagaaaaaaaaaaaa

SEQ ID NO: 714909 - DNA, 171 bp, Homo sapiens
gcccgatttactctgtctgggagtgactctgtctgtagtatctgcactttcccaacaccttctccctggataccttaatggaacctgggcctcaggtctaactcctacctcaacgtgggctcatccccaaagaccactgaggttcccccagctgcaggacagagtctactc

SEQ ID NO: 714910 - DNA, 950 bp, Homo sapiens
gggcgcgcgcgcgaggttcccctcgttggcggcggggggttcttggttcgtgaagagaagcgagacgcccattctgcccccggcccggcgaggggcgggggaggcgcgggaagtcgacgggccggggtcctggaaggccacgtgtcgttggcagctcccggtgaagatggttccactcagaggaccaccccgtgggcggaaactcctcgggccaggtcccttccccgggggccgtgccctttccccttgatgctattgctgggggccttagccctgggttcacctccgcgcggggcttccgccccaacatgcttggattgggggccccaagaccagggcgcggccttcaaaggggggaacaccacatcacccaactaagggcgcctgggaggggcacccccttcggggaacaaccatggccacatgattgcacaaagcacaatgtgggaagtccaatggcattggaagacaggggcaattgtcggaaacgacgccgccgctgacaacccaagagttgaaacggaattgggggaatcgcggacaaaggggggaccaatcgctgggaatggggaccccccgcggacccaaggcacgccagggggaccacaagcactccacaagggttaacccctccggccacgggggggggctccgggagcagtggcctctaagtacaagtaccaaggacagaggggccggtctacgggaggccgccaagattgtcctccgggggcaagagagggttgccccggctgaattgggtgtagacccccaaaggcccgtggggcaggagagacgcgggggccaaaccccaattatacagcagcaggtggaccaaagtcagagcgcagatcctggcccacacagatggtgggcggggaggagccccctaccgacacttgaattgggggcgagggaagcgccaacgcacggatgagcagagtgcaaga

SEQ ID NO: 714911 - DNA, 2929 bp, Homo sapiens
ccggaagcccatccaccaatcctcacctctcacctctgtgtccgccctgctgggaaatattccaggctttggccaaggccagtgcagccccaggttcccgagcggcaggttgggtgcggaccatggcctctcacaagctgctggtgaccccccccaaggccctgctcaagcccctctccatccccaaccagctcctgctggggcctggtccttccaacctgcctcctcgcatcatggcagccggggggctgcagatgatcgggtccatgagcaaggatatgtaccagatcatggacgagatcaaggaaggcatccagtacgtgttccagaccaggaacccactcacactggtcatctctggctcgggacactgtgccctggaggccgccctggtcaatgtgctggagcctggggactccttcctggttggggccaatggcatttgggggcagcgagccgtggacatcggggagcgcataggagcccgagtgcacccgatgaccaaggaccctggaggccactacacactgcaggaggtggaggagggcctggcccagcacaagccagtgctgctgttcttaacccacggggagtcgtccaccggcgtgctgcagccccttgatggcttcggggaactctgccacaggtacaagtgcctgctcctggtggattcggtggcatccctgggcgggacccccctttacatggaccggcaaggcatcgacatcctgtactcgggctcccagaaggccctgaacgcccctccagggacctcgctcatctccttcagtgacaaggccaacttctggggctgtgacgaccagcccaggatgtaccatcacacaatccccgtcatcagcctgtacagcctgagagagagcctggccctcattgcggaacagggcctggagaacagctggcgccagcaccgcgaggccgcggcgtatctgcatgggcgcctgcaggcactggggctgcagctcttcgtgaaggacccggcgctccggcttcccacagtcaccactgtggctgtacccgctggctatgactggagagacatcgtcagctacgtcatagaccacttcgacattgagatcatgggtggccttgggccctccacggggaaggtgctgcggatcggcctgctgggctgcaatgccacccgcgagaatgtggaccgcgtgacggaggccctgagggcggccctgcagcactgccccaagaagaagctgtgacctgcccactggcacacagctggcactggcacacacctgtcccatgcccaccctgagggatcaggagcaaacagaccctgcaaggtcctccaggcctggggacaggaaagccactgacccagcccgggaggcagaaccaggcagcctccctggccccaggcagcccttttccctccagtggcacctcctggaaacagtccacttgggcgcaaaacccagtgccttccaaatgagctgcagtccccaggccatgagcctcccgggaatgtttaataaagggcctggccacctctcctcactgtgtggggtggtctgtgaaagagtgagaggagagcatctctgctccctgagctgcctgattgtggactttagggggacactcctcatcctggagcccacagggtagatcctcccctggaggaggtgctgtcaccacactctagccccagatgtcacacccccaaacgtcctcacgcaccacatccaggtgaacccacatggcgcacagggctggttggagacccctgtcatggacaagggtacctgcgtgctggagagcgcacagccaggacctgagcccatgacacgtggaagcctccaatggaaggtcccctatgctcccatccagccagtgcccacccctcaactgcctgacttctgtgaccatagatcagcctggcatatttgaatttatttatttatttggaaacggagtttcactcttgttgcccacgctggagtgcagtggcatgatctcagctcactacaacctccacctcccgggttcaagcgattctcctgcctcaggctccggattagctgggactacaggtgtgcaccaccatgcccggctaatttttgtatttttagtacagatggggtttcactatattggccaggctggtctcgaactcctgacctcaagtgatccacctgcctcggcctcccaaagtgctgggattacaagcgtgagccactgtgcccagccatagttgaatttcatggtcagtggaacacacagcaggtcctccactgtgccagcttctttcacttactgtttttgacactcacatgtaccgtcgtgggcgccggtgtgtctttgttgctgagtgccgtcccgtcatatggacgtgcgtcggggcccccggtgtgtcttgttgctgagtgccgtcccgtcatatggacaccccatgaattggtgggtcaatcaccataggtgaacatctggggttatttctattttggggctgttttgaatacggaggtagtgaaattcttactcaagccttcgtgtggccatatattttcatttttcttggataaataactaggagtggaattgcagggtcatacaataggcttaaccttatacgagactgccacgaaattctccgaagtggctcttccatgtttcattcccgcagctacagcgtccagggtgctccacgtcctcacccacactccatgttgtctttttttgctagggggtgtaaaatcctgtctgatttggttttagtttgcatttccctgatgcctattgatgttgagcaacttctcataagctatcggccgtttgtagatcttctgaaaagtgtcagttcaaatattttgttcatatttggatttttatcttcttattgtcaatgtgtgatcattttaaaatatattctagatactatcagaaaaaaaaaaaa

SEQ ID NO: 714912 - DNA, 573 bp, Homo sapiens
  misc_feature (1)..(1): n is a, c, g, or t
  misc_feature (34)..(34): n is a, c, g, or t
  misc_feature (54)..(54): n is a, c, g, or t
  misc_feature (67)..(67): n is a, c, g, or t
  misc_feature (84)..(84): n is a, c, g, or t
  misc_feature (113)..(113): n is a, c, g, or t
  misc_feature (278)..(278): n is a, c, g, or t
naaaggcatttgcccggcaccggatccggctgcnggagaagggaccggttatantaaggaatggtcngatataaaccttacggnggtctcttttctggcagccatcttttttngcttcctctacgggatgtcacttgcagtatgcctgctttctggtgttggataccagagttcttcattgataagagttctataaataaaattactacaaagataaagctttattctttagtataaaaatatatctaataacagcctcattaggacaatggtatgtnataacaatgttttatataagaaatatttatcttcagcatcaaatggctcttaaatgtatcaatcattatttatacatagaacttggaagcactcctcagaacatcttttaagtattttagagaagtaacttgctgattatttgaacatcattttaattattacaggacaatgataagtgcaagtcgtcatgattctgtggtggtaaaaacacacgcagattgataagaaaggcacctattaagacttggacaaaactagaatgccagcttaagtcaataaaagtttcctaatgta

SEQ ID NO: 714913 - DNA, 709 bp, Homo sapiens
gagcgggggggggaagtggtgctgatttacggctcaagggcctctcgatcgcagcccgggcccgacccaactcagtcaaaagccgcgccctccatcctgactgtgattgggcgcggcgtctagaaattacggccacttattcgctatagaggaggtccaggcgcctgtgggcctgcaccacactcgcccagccgagtatttccttccctgactataaatcacgcttagctccctgattctcttcggacgtcctgcgggaaagatggggccggccgaatgtcgctaatgtatactgagatcctgactcccctcagggcagctgggaaactagcgtgctggcacctttcagtccttgagggaactcgcccctttgcccatggccacgtgtggcagttaacagcctctgaaactcggagcaaacatcacttacttccacaaacaccgggaaacaagtccgagcgcaggcgagacggtgcaaggaagacaagaagccaccgcaagataaaagcccactaccattctcccttcctccaacgacacggggtcttggaccttcccttcgatcccccaaggtacctgtacaggacaccctccacagtattggcgaatacccttttttagggagccccggctgagggaaaaaggagaaccgggatgaagcaaaacttttggcccacattaagagccgtggagaaaaacagaaccgcaa

SEQ ID NO: 714914 - DNA, 124 bp, Homo sapiens
tagatcgagcgagagacctccacagtatccggtggttccagttcacctggattgaatcacctaagctcctgtatcagcactcctcatcatcactacatctgccaggctccgtcgctcgctctta

SEQ ID NO: 714915 - DNA, 128 bp, Homo sapiens
aaccttgagcttagacggtagaggttgctccggacccgcactgctgcacatgaggtaacccatggcctcatcatacctgatatctcctgggagcgaaaataagaaaggacatagagagcaaggggaag

SEQ ID NO: 714916 - DNA, 214 bp, Homo sapiens
tactcccatggtcatcatttatacatcatcatatcattcaactcccacgtgggcatcacagcatgggatgggacagcacccccagctccctcccactctgaatgcatgtcatgcaacagtctgcagcactctgtctgaatccttcaggtcgtcagccactttattccagtcccttgaacatccacagtgcttgtgttttcatttatgggcacca

SEQ ID NO: 714917 - DNA, 253 bp, Homo sapiens
tgagtgccccatagtggtatttctgtccctatggggccataagactgaaagactcaccctcccgagtctctcgcacctttcacggtcatcccctatcccctgtctgtgatggatcgaggaggccctgggctggacaaagcacctgcagctccctgtacaaacctgcacgcctttccccgaagcaaagcacgaatttatagggtccatgcagcaggatctaggatccccagctgtggcactgagcgtccgttcc

SEQ ID NO: 714918 - DNA, 443 bp, Homo sapiens
ccaggtcgtactaaaacagaaactctggaccaccactctgaagtctaactgtctaacactgtcataacgtgctggaagcaaggagccaatgaggtgacactggatttcgtacctgtttggaggcttgttcttgctgaagctctgtttgttctacttggtgaggctgactagaaaagctctggttataactggcctggtactgattttgctgttttaaagtttctggttcattaacaggaggaactggggcattcatattgaacacctgttagtaaataaagtaaatgattagttcatccttttattctctggtttataacatggccaaactcaatggtgttttacctcagacataaataaagacatcacagaggtctcaaacacaaaaacatcacacacacatacaaaaatccctccaagtgattcaatggtacagaccgtcg

SEQ ID NO: 714919 - DNA, 1137 bp, Homo sapiens
ggccgcttttggcccgagtcatgtagatctttgactagcggcctgggactgcggtatccccgaacctgagtgtcgggtgatagcaaagaccagaatatgaactgacgttgtagtgatctgacgattgagagtaggatcacacaatcatgtatgcgtaagcttgaggtaggttggacgccagtgctcgctgcctagttgaccgttgttcggtcatagccagaagtgcgtgtgtctctaaagactagagcgggggtcccatctgagcccgacgagaacaggttgatcattcccgtaggaggaatggttgaaagctcatagcgtagccaggttcgcctgccgatccagttgggcgattcctttggagcagcgttaatctgtgcattcacacaactggcgtgtccgatagccatgcattgccattatcgtttatccagaagcggactatgcatcagcacagatcccgaaagcatatgtgctgtcgagcctctagacttttaacaagcaccatgtgggtaattgttttcttacaataatattagaggtgaaaagaggccttcaattgttgtgtgtgcgatgagagagaccagggtttggctcccattgagctcctggatgaataatggtagggcctgaaagcctgctgaaacgattgctactcgcgagaaaacgcctcgggtacatatgaataatccgtgcgctccttgggtatggagcgtaggcagggctccgagttcctccagggtcaagagaagtatgaccctggacctccaaggtttcccgattgaccccgggatgtacatcttgcctgaggcagctggatggactgtacgacgctccttcatcaggactacccgcaggtgtctatccgaaggccccgttcgaacagggactaccggggggctttgtcgctgttcagaacggggctagacacagggatgtggtggggagacaactcttacaacggcgaaaagtgaaacccgccgaaaagtaacctggggcctcgtacaataaccaaaggtctgggcggaacaaaacaaagcagcaaaaagggggggtgtaacacatagggccaaaacacacactttagagctctgaggaaaaaaccgccagtgaaccatcaatagagggtgagttata

SEQ ID NO: 714920 - DNA, 649 bp, Homo sapiens
cccaggggagcgtaagatgtgcctttcactttccgccatgattgtgaggcctcccagccatgtggaacctgagcacctgtttatgcactgcagtcgtgagtgagatagaatcatgtgaggagtggacagtctgccttacagcccatgctcagtacatatcctaatgaggaattggtccctggctgtcgttgtctccacgcccttgagttggacaatgctccgtcccaaggatgtgacagattctttcatttatgactatgccacgctcagcccatctaacctcaaatctaacctaatcctggtggccctcccaccttcccagcacacaggagcaagcagagaacatgggcaagtcaaagtcaaaaaggaaaggatggcctacagatgctgttctgtgaggacagtgtccaaaccagaaagtcaagatgcctctttgaggatccgtctgaaaacaaacaaaatacgtgaaatccaggagagctggagtagaaaacgccgtgaaggtagcgtggagagcatcagggagcagctgctatttcaacacagtggggacttcacacctgggcctgagggagcctcactgtttcactgaatttatgttcatatatttatgataataaatatgttcatacacttacgttcaaaaaaa

SEQ ID NO: 714921 - DNA, 491 bp, Homo sapiens
gtaaacagcccggctcgctggcgtggagccggtacacctctaggggctctcgattccgtgggcggtatatcggctgagcaacgaggtggtgaggttgatcggggtttatcgataacagaacaggctcctctagagggatatgaagcaccgaccagagttcctttgagtgtcaggctgtggctcgtagtgtgctggcgagcagttgtgttgatttaactgtagaggtatagggctaaacatagtggggtactctaatcccagtttgggtcttagctattgtgtgtccaaatatgtgaacgccactatcgtagtctattttgtgtcaactgtagtttgtaacaactcaggtgagttttagcttaaattgaggaggaggtgatctaaaacactctttacgccggcttctattgacttgggttaatcgtgtgaccgcggtggttggcacgcacttgaccaagcctgaggttagtctagcttagtttaactttcgt

SEQ ID NO: 714922 - DNA, 317 bp, Homo sapiens
tagagcatcccccgtatggtcctgcacatatgttctttattcttattgtgccctgctatattagttaaaaaccaccatttcactgtaaaaagataaatacttcatttatcactctaagaagtatcatatcttaatcgtccatccaggaataactggatattctctaacatcaatacatcataacttaacttcttatcataccacataaactagaaaggcttcatttctagatagtctcctcatatttctaattggccatgacaatttggatactaggtactctccctatctttccttataatagcttatttttctaa

SEQ ID NO: 714923 - DNA, 196 bp, Homo sapiens
cctattatgcggatgggaggcctctctctccctcgggtgtgccctctctacacagtggccctcttctgtgaacgcatatcccaattatatttgtgaagaaagaacttttaagggataggggccctaataaagaaccggccagtcacacaagaacattctcaatttttatagccttaaacaccccaaacagttcaca

SEQ ID NO: 714924 - DNA, 870 bp, Homo sapiens
  misc_feature (624)..(624): n is a, c, g, or t
gcaaaaagaacaaagctagaggtatcatgctacctgacttcaaactataatacaagactacagtaaccaaaacagcatggtactggtaccaaaacagatatatagaccaatggaacagaacagaggcctcagaaataacatcacacatctacaaccatctgatctttgacaaacctgacaaaaacaagaaatggggaaaggatttcctatttaataaatcgtgctgggaaaactggctagccatatgtagaaagctgaaactggacaccttccttacaccttacgcaaaaattaactcaacacagattaaagacttaaatgttagacctaaaaccataaaaaccctagaagaaaacctaggcaataccattcaggatataggcatgggcaaagacttcatgactaaaacaccaaaagcaattgcaacaaaagccaaaatagacaaatgggttctaattaaaataaagagcttctgcacagcaaaagaacctatcatcagagtgaacaggcaacctacagaatgggagaatatctttgcatctacccatctgagaaagggctatatcaagaatctacttaagaacttaactttacaaggaaaaaaacaacccatcaaaacagtgngccaggatattgagcaggacccttccagaagaagacatctatgcaggcaacaaatggaaaaatgtccataacccggccacgaacaatgcaatgaaaccagggaaaccctcagcacgaatggaacatacaggcgcaacacgagcgaggtggaacgatctcacggggaagtcaaacacgggaaagggccaaaacgaaaagaaccaggtcacaagacacaaaaccattcgaacaaagaacggaaaaacc

SEQ ID NO: 714925 - DNA, 373 bp, Homo sapiens
  misc_feature (253)..(253): n is a, c, g, or t
gagatatggtctggctctgttgcccaggctagagtgcggtggcacgattttggctcactgcaacctccgcctcctgggctcaagccatcctcctacctcagcctcctaagtagctggaaccaaaggcacatgccatcatgtccagctaatttttgcattttttgtagacacaggatttcaccatgttgccaggccggtcttgaactcctgaactcaagcaatctgcccacctcggcctcccaaagtgctgggntcatatgcatccatcactgcgcctggccaacatttttttttttaactatcatcctgttcccaggaagctcagagtctctcacaggcccttttcagttcctggggctctcatatttcctca

SEQ ID NO: 714926 - DNA, 337 bp, Homo sapiens
gagaccgggtttcaccatgttggccaggatggtctcaatctcttgaccttgtgatccgtccaccgcagtctcccagagtgctgggattacaggcgtgagcaaccgcgtgtggcctacactaactttttaaataatcgtacatatttattatttgcccctcttctcttccccaggcaaaacatttagcattccttcaaatgatcttattattctgtaatttttttttaaattgatatgaagtctcgccctgtcacccagacttgagtgcagaggtcgcagtgagccgagatcataccactacactccagcctgggccacagagtgagactccgtctca

SEQ ID NO: 714927 - DNA, 175 bp, Homo sapiens
actctagagatccctgtgtatacaactcacagagttgaaccttcctttgacagagcagttttgaaaaattctttctgtggagtttgcacagtggagattccaagcgattggaggctaatctttgaaatggaaatatcttcgtgtacacactacacagaatcattctcagaaactg

SEQ ID NO: 714928 - DNA, 310 bp, Homo sapiens
caaggcatttaatggttgaaaagttgatattttccaagataatttaaaaattattgatggagtgacactctgtcttcttatgctggagtgcaaatgagcgatctcggctcacggaaacctctgcctcccaagtacaaacaatactactgccacaacctcctgagtaactgggattacaggcatgagacccattatgtttatattataacccatcaaatgttgatatccccattgaaaaagtgagacaactgaggcaaaaagatacaaaaaaattttcctacaaatgcacaaataaaattaacaaagctgg

SEQ ID NO: 714929 - DNA, 197 bp, Homo sapiens
atgtttctttatacagcacatgcggttgaatcttaaggttaatttcaatataaagatcctcatgaattaaatagttgatgcaatttttaacgttcattgatatcaaaaaaataaacaacaaaattaggcttgtaaaactgacttttccattacgtgggttttgaaatctagccccagacttactattgttcgagata

SEQ ID NO: 714930 - DNA, 84 bp, Homo sapiens
gctagaaacattgctggggcccacggctacaatgcctaggtgaacagtgatggtaagtgatcccgtaaggaatagtccatgtgt

SEQ ID NO: 714931 - DNA, 1007 bp, Homo sapiens
  misc_feature (473)..(473): n is a, c, g, or t
agcggagtgatggagggggcgggctctgcagggaagtgcgtcagaggatggcgcggggagagtaggtgtgctgtggtctgagctagagggtgaagctggcgtgaggcagtgagtgattgggcgagcagttctgaatgccacgacatggagtaaccgtttttgcatacatgcattgttgtatattgacttgatgattgcttagctcttctaatttccatcgcattctagcatggtcagtcctcctagtttggtcacagtacattcttgggtatgatctatctgaaagtcgcagttcacgatacattccagtgagttcgagataacaacgcatcgtggtgggtagttgaattcatttcatgtagcattgaggagcagaatgacacatagaccttgtaattggaatgctactttattcgataatcatatggctactagatggcgatttgtgcgccgacggctgtaatcgactcaantaaccgctaataatacattgcattggatagtaggcccgagccaggacataggaccagagtcatttgatgtaggtcccaaaatgtgctgagtttcagcatctatactagtagcaggttcactggagcacaactttgttggatcccggtaaaccagaatagcgggattgatctcccttaggacctatctttggcgttgccagttccttttacctttcgtgagttacggttgatgctgcttgtggggctttgatcggacttgtgcttgctgtgccgacagcttatatccaacattgcacgggcattctccatctcttgccggtctgtgtacacgtggggctcagataacgttggtcactgttgctgggacattggagatacttccgggcagaaactagaagctcccttaaaattggtggccggtggatttgggattgggccccttctgcctggatagtagtacacatgcccccttaaaggccatgggtccagggccgttaaacatgggtgttgaaacagaggggaagagtacagctg

SEQ ID NO: 714932 - DNA, 219 bp, Homo sapiens
  misc_feature (1)..(1): n is a, c, g, or t
nattataccacccaaaagacgaactgacgtacgaacctggggtgactctcagagacacagtacccgctgtgtatattttctctgtccaccacaagaaaaacacagacaaatagaaactccaaaacaagcaatcctctaaaagctgtaaagaacgtcagaaccagatatgaataaactaaactctggcctgtctgtgagcagtcaagggtgctcaggaaa

SEQ ID NO: 714933 - DNA, 193 bp, Homo sapiens
atcaggcgaagacggggcggggaaggggctgaaaaactaccagttgagtaccatgctcacaacctgagtaacaggatcaatcgtacgccaaacctcagcatcatgcaatataccccatttaagaaacctgcacatgtacacccttactccaaaataaaaggctaggcacggtggcccacagtcttcgcctgat

SEQ ID NO: 714934 - DNA, 358 bp, Homo sapiens
tgaaggttagccaacagactccatgctttccaaagcttcaggtttctaaaattgtttaaaaattccacatatctctggctgggcacagtggctcacgcctgtggtcccagcaccttgggaggctgaggcgggcgggtcatgaggtcgggagatcgagaccatcctggctagcgcggtgaaaccccgtctctactaaaaattaaaaaaagattggccgggcgtggtggcgggcgcctgtggtcccggctactcgggaggctgaggcaggagaagggcgtgagcccgggaggtggaggttgcagtgagctgagatcacccactgtacttcagcccgggagacaatgcgagactccgtctc

SEQ ID NO: 714935 - DNA, 996 bp, Homo sapiens
  misc_feature (394)..(394): n is a, c, g, or t
caggggttaccccctggggattacggagggcctttaaaacggggcgtctaatggggggtttttttggggggaaggccccaaaaaggcccttttggtgagtccaccagttgtttgtgcgagccgagagacacacaccaaaagggggagaatctctttacattgccgcgaacccccatatgtgccacaaaggggccccctttttttgggaataacacaaaatttggggcacacatatccctggggaacaactttggccttgagaggcacttgtgaaaggggcgcacaaaggggggggcccaccaacgatggtccccccgggatattgttgtccaacgagttaaaatgtgttttccgcggctctttacgcaggatccgggggaccttttccgcttgnggcaccacgactttgtgcgggagaaatagtttcgcgcgtggtctaagaaactggggatatttccgcgcgcggttttagaagagggggtgaggacacagattgtgcccgcagagataacacccccttgggcctgtgtggccaccaaagagaaggtggcacctctgggaattattcacgagcggccctctcagagaggctcatagagcacccacatctcagagctggtttttaccctcccctcacagggaactttttgtgggcaaacagaggaggatttcggggacaaattattggggagattcaccctgtagcacgacgcacggtcaaaccacggagttctgccccaaaagaggttttggctgaggcttgacggcccctcggaggaaaacgctgctgcaccaaaaaatgtgacacccgtagggccctaggtttacgccaaagagggacacataagcaccccttaattctgggaaataagggaaggccccttcccaggaaattatgggccatttgataattacagacaattttcaaagggccataagaacactttcccccaagagctgtcccaattaataaagaaaaaggttattttattttta

SEQ ID NO: 714936 - DNA, 838 bp, Homo sapiens
ccgggattccaattggggtcgaactgtggcctgtagccgcttatgcttgctttttgcgttcctatcccctatcggtgtcctaacgtgcgcattgtgttgttgctagcacttgccatgcggctcgctcgtgtcgtaagcccttttggcttgcccctctgttccctttggttgccctatagtcttcaaagtgttgtgggtgtgccacgcatctatggggactcgcctggtcagtgttttgcctttcggtgcgtcaaagggcaatcaggatgggtttgaaaaacgggaacaaggataggatgggcacggttcacgaggtcgtagcatcgcttgcctatcggacttcctgggttgtcaagagttgtctagcctcttgttgctccttcccagcttaataaggtcacgcttccactcctagcctctgtcaatgtgaccttgggctcactcctgccctacgcattctcagtccattgtgggcaagggagccctcgtaccactatcagaggggccagggagatccctctgcgtccactagtgccttccaccctttagctccccagagcagcttggccacagggaggggggatgcttgcttagcgtgatcccagccctgacccagaggaagccgtctatcttagtttattagcttgttgtttacgaccgtggaatgtgaccacgcttcctgcaggggtcttgggtgggaggagcccagggctccgtgtgacccctcgtttcttcctccaatccccagtttgtatattagctgccatataagattcccattggactacctgtgttctcttggggagtcagggtgcatgtcccctcccctccggcaaaa

SEQ ID NO: 714937 - DNA, 216 bp, Homo sapiens
tgatgatagacttatgtgtcatgatgctcaattgtataacagtcgacactgtgatagctaaactttttaacaaaaatttattcggattacctccctgcttaaaagattcaccagaaaagcttcatataaaaattcaggcccttattggacaacccccacaccccgtctcctcactagaacatgagaatcttctccccttgcacgcttgacttatca

SEQ ID NO: 714938 - DNA, 1647 bp, Homo sapiens
  misc_feature (1060)..(1060): n is a, c, g, or t
  misc_feature (1433)..(1433): n is a, c, g, or t
cgcacggtaaaatgccgccccccctcctgtcgctgtgttatactcactaatccgttcgtgcttctgactctgctgggtgtgttgtctcccccacgcaacactcgtctctcaaagagggagggttctctcgttctatgtagttttcgcctcctcgctcgatagataacattattttgctcctccctcactttatgtttagaagcttcccctctggggggaggatcctccacggtctgttaacaaaatggtctttttcctcagcaaatagagtagttggggggtggtgctccgaacaaccggaaccaccacacacacgggaggcgctcttgtggatgataaataacacccagccccaacacggggtgtgggggattccgccccttcccccctgtggggagcctttttttttctctcgggcggtctcgcttcctacgatcggtgggtcgccctttcccgcccccgttcgtcttcgctttgggcgggttggataaatgctttcggtggaaacggcggtgctgcaacagctatcttcttctctctccccttcttatccaacagttgtgtgccccccgcggtcatatacttcctgtggtaataacgggggggctccctcattcgggcgggttgttctctccacacacagaggtgtgtgtcctcccccatcgcgtccccaccatcatgaagatttgggaggaaattaagagcctttctttgtggtagtatataataactttcgtcgtcttcgtgaaaagggctcatactagtggggcgcccagataacgtctctaccacggggttgtttaccaccatcggccctctttataggggcggtaatatatcccactagaaatgtggtggtgatatttcttcggcggccacacaccgcctttcctcacggggagatcttttctcccacactgctgcttacaacacggtggaggcccatcacatcatcttgtctctcgtggtagggtctcctcaccacagcgggggcttttgtcaacacactcctggccccctctcgggggggtcttaccacgacctctttttggcacacaantatactctcacggggggggtttgcccgctctcgcagaagaagctctctcagattcttttcgctctcttcgcgacaacagaggtgcacacttttctgggcttacccggcttccctcctctctatatctcgggggatagcacacagagggatcaccaccacagagcacatctccctgcagcactctctctcagagagatattcgcacatgtggtgacagcaccgcagacgcagtttcgagagagacactcacctcgtggcgcccacacatatatagatggagagacccccctggtcttgttcacacaataaatatcttataatatatcacgcatatgtagcgccgcgagctgtgtggcgtgggtgtgagatgacnctgttgagtctcccagcttacattacggaggccctgtagtatggccaggatctgccttgagccccagggagattcaaggctgccagtgtagccgtgattgtgccccatgtacatcccagcctgggtgaccagagcaagactccatttttaactaaaagtaataataataataataaagtaataatcataataaaaatttaagagtgaataaata

SEQ ID NO: 714939 - DNA, 108 bp, Homo sapiens
  misc_feature (33)..(33): n is a, c, g, or t
  misc_feature (86)..(86): n is a, c, g, or t
cagtctgaatcgtctgtgcagagccccacacangtcagcatgatgtgtctcagtctcccagagcggtggctcacatcacccccagncattagactgagccagtttgca

SEQ ID NO: 714940 - DNA, 228 bp, Homo sapiens
ggacacagagaggggaacaacacacaccagggcctgttgcgggataggcagtgaggtgagggaacttagaggacgggtcaataggtgcagcaaaccaccatagcacacgtatacctatgtaacaaacttgcacattctgcacatgcatcccattttttaaaataaataaataaaagaacctaggcttcacctcatacctgttagaatggctataatcaaaaaaaaaaa

SEQ ID NO: 714941 - DNA, 924 bp, Homo sapiens
gaagcgggagagttgcttgagcccggggggtggaggttgcgtgtgggtcaggggtcgcgcaagtgaactgccaggttctggcgcaacagagcagaggacctactctctcatagaatcaacgaaaagtaaacaacacagaaaagtaactgggtttgttctctggttaatcctacgatacttttgtcttccctttcagacttaagaacattctatggatgctacatctcttgtgtcgtgtcccttggcatggcggcatacgtgatccataaacgtgcatcgtgcagcatcatttataatagcctgggaagtggtgttgctcttggggttggtggtttcacagttgtatttccaacagcagatgaggatcggcctgttgcccaggtctagttcgttgaacctcctgtgtctcaagtgaccctcgtctagcctggcgtctctccaaggtggctaggattataaggcatgagccaactgcgacctgtggccgttgcgcggaatcatgttgacactgggccactaatattaggcttgagatcctaagtgaaaccgttgcaggaagctaagcgtatacagggcatgcagtagtctgagggatagcctgttgcactcttgaggatcctcacgactcgtctgtaatttcccctgtctctggcctggtggttttcttcgaccagttctgggtaacgcctcggttaaaggcggttagacagcacgacgatcatggttttggggagaaaccagagagtgtctcgccgtcgtgagggtggcagaccccacggggttcgtgggacaaatgatgccattcgtgtgggaggaagcacgcatcgggtatggagaggcggagagacagcgacgtcacacacattgtgggatgggtatatcaaagcgagagtatcacgtgttgaccaccagacgccgccacat

SEQ ID NO: 714942 - DNA, 671 bp, Homo sapiens
ggccaggctcgctgctgctgcggagagagatgactggggagcgacccatcatggcgctcccggtctgacgctgggtggctgaggattctgggcttctggggaggctgtagggtatgggtgtccgtcgtgatcttcctgctggtgtctctggtagtctcctgattcatgcggtgaccacacgattatcggggtctgtgctcgcgagacgcatggatgatcaatggtaagtcgaacctgttgtcgtcgtcgtacggtcgtgcgcagactacgcatggtggctcatcttggcataccattcgcgggatcccggactcatcaacagggctagtccgacgggtgaccactcttcttcagcctgtgttgcattgaggcgaggaaaatgtcctcatcccgatgagggggccaagttcatcgccctgccgggaggtccatggaccagggcatgcacatgtgtctccgtacagcgttcatttgtcaatgatggggatgtccccgatgggctgaaccttgggtgcagtagtgagcgatgttgagacaggagtagtatttacttttctactccctttgtgctcacaaggggcggctgccaggtggtctctaccaatgttggtatggagcaaggactgatggtgttccttggaagcaaccccggaatctctccctggatatgc

SEQ ID NO: 714943 - DNA, 427 bp, Homo sapiens
agctatttgcagaaagctatttgcagagggattccaacaggtttaaaaatagaccttctggacctgaagtacagtactcacatttttctcttgtagagagggaatccagttttagagacaacaaatacaacttaatgaacattttacaatttaggtagaaaattaccggaatttttcatagaaatatccttgagaaactagaatttctgtattaaaagccttgtttgcactttgaatcaatagattatatattagcgtgcatacacatctgtaacaaatgtttgtttaaaaagtatgttaatcctggtaatctttttttaaagcaagacgtatttgtctatatagacaattgtgtatgtgtgtgtcgtaatgtatgtagataacaaagactggtggttacttctagatcattaaaaatgtcttccct

SEQ ID NO: 714944 - DNA, 103 bp, Homo sapiens
accgtgttgatgtgtgcttctaataagcgaataccgtcgccttttcgatgagttccttcattcatggcttggaacaacagagatgctcctgtcttgcagaact

SEQ ID NO: 714945 - DNA, 157 bp, Homo sapiens
tgcctgtacgcgtaaccgtaacattactgcaggccacctactcatgcaccatattggaagcgccaccctagctatatcaaccattaaccttccctctacacttatcgtcttcacaattctaattctactgactatccttgaaatggtcgccaatccg

SEQ ID NO: 714946 - DNA, 658 bp, Homo sapiens
  misc_feature (2)..(2): n is a, c, g, or t
  misc_feature (39)..(39): n is a, c, g, or t
  misc_feature (200)..(200): n is a, c, g, or t
  misc_feature (210)..(210): n is a, c, g, or t
  misc_feature (294)..(294): n is a, c, g, or t
  misc_feature (411)..(411): n is a, c, g, or t
  misc_feature (450)..(450): n is a, c, g, or t
  misc_feature (513)..(513): n is a, c, g, or t
  misc_feature (518)..(518): n is a, c, g, or t
  misc_feature (530)..(530): n is a, c, g, or t
  misc_feature (584)..(584): n is a, c, g, or t
  misc_feature (605)..(605): n is a, c, g, or t
  misc_feature (642)..(642): n is a, c, g, or t
  misc_feature (655)..(655): n is a, c, g, or t
tnaggttgacccacctagagcagatcctctggggacagngaggaaacaggtgtcacatcaccacgcaggttacattcgtcttccactggaatgactagagcccccaggcagtaggcagtgacctgactgcagaagagaaggggaaagactccgctcatggggacagacaggctctgttgcttctcctcactggtcatggnttagcatggntcctccccaaagtccttagtaaacaaagcactcgcaaaaacccaagtcactacttttaaactctgttggataaggggagctttnccatagcttagactgagaacctgtgctctagaactgctattctgactagattgtttgaagggagtgggtgcaggcgacaaaatggctaaaatgaaaatgggagccactggtccccgnctgcagctacaactcaagatgtctacagatgtggccagngtgacatgtgcagggtgggaggggcagagggacaagacgggcagggagggtgctcctgggganagttncccccgaccggnctcacttcttggcttgccctgggaggcaagttccatggtttgggacgctctcanccccagaactgatggctggtngctcaagtctggcaatcagttgggttaccaggtgagnaaaaaaaaaaagnccc

SEQ ID NO: 714947 - DNA, 897 bp, Homo sapiens
aatcatctgctcgagtcatgccgctacgctgagggcaggtgcttccaggagtctgctgggggacgccctggcggtgccacctatatgcccctggacggtagtggctggcctgcggggcggcgctccgggtatccccaatacccagccccccgggtcctggggacgatctgtgctccgagctggtaggaggcccctgaggctgaactgagtcaggctcctgctgagagggcccgagcttggctgcccggcagccgctgggactacgcctgtagccagcatgctccaaaattgctcacggtagttgtcctcgtgacggtgctttgtgtgacctatattgccagcgcatgagttctcgtgctgtggggggtgaggctccgggccctctcctgggactctcactccctctctctcccaggggattcagatagttgcgtgaggagtacgtggactccatggcaataagtctacaccagagtcattctcgctccgctctcctcttgcaatggagtgagtctttcgcagagggcacgcgcaccttgtggtaataagcacatgcgcccagatccagggcctcgcagtgcccgtgttacttgatgaatatctttttatgggaaccctgcctagtctctgggagtgggtggaggggacgggagctacgtggcacggatggaagaattttagtagaactttggcagtcgactctcccagggttcacctcaccctagaagtttcaccgagtgcctgtgcgggctctggtgggcagaagcgtggtaagacaatgggttgctgggcacttagtgtttcccaaggcaagtcctgtgggctagactaaatgcttgaacttgccacttcaggcggggagatgataaggcaaggtgtcactgacctgcattgtcc

SEQ ID NO: 714948 - DNA, 503 bp, Homo sapiens
  misc_feature (426)..(426): n is a, c, g, or t
  misc_feature (428)..(428): n is a, c, g, or t
  misc_feature (497)..(497): n is a, c, g, or t
agactctcaccatatctcgacaaggcaatatgcccgtattgtcaaacgctgggtagctgaaataggcctagatccttctgcatatgggacgcatagcatgcgtcgcacaaaaccaactctcatctatcgtcggacgaagaattttcgtgccgtccaattgcttttgggacacacgaagcttgagagtacagtccgctatctaggcattgaagtagaagatgcgttagcgctcgcggagcaaacagacatctaacgccaaaatagaccggtcgtcgcttagatggccgggcctagccgatttcagacatcatatgcccctcgcaactcgccactatacatccgaaggtaaagcttgcttcaacagaaacgccacgaaaatctcggccgaaattgtgctggagaaccattcgtcggagagcaacgcananttgccagcgccgaaaaaaagtaaaggtcccgtctggacaattaagatccttttgtttttgatgcgcccnggtagt

SEQ ID NO: 714949 - DNA, 795 bp, Homo sapiens
  misc_feature (64)..(64): n is a, c, g, or t
gcctcactcgcgcgttaggaggctcgggtcgttgtggtgcgctgtcttcccgcttgcgtcaggnacctgcccgactcatggccccatggcatcagatgaaggcaaactttttgttggagggctgatttgacaccaatgacagtcgctggacaggtttccaaagtacggacagatttgaatgtggtgtaagacaggagaccaagatctcgggattgggttgtcacctttgagaacattgacgacgctaaggatgcatgatgcatgaatgggaagtctgtaatggacggcagatccgagtaaccagcaggcaagtcgtcagacaacgatcccgtggtaccgtggtggctctgcgggccggggcttcttccgtgggggccgaggacgggccgtgggttctctaaggagagggaccgagctatggggggaaccggttcgagtccaggagtgggggctacggagctccaaactactatagcagccggagtcaagtggtggctacagtgaccggactcgggcgggtcctacagagacagttacgacagttacggtaagtcacactccgagggcgccacgctgctgtggcctgcggtgggagctcggtacaccttggtgccctctccaagcactttaggctggacactcagaccttgtccactggtgcttgcccagaagaggcgcatctgtcctctcagaagccatttctatcggcaggacgcaaaaaagccaaatgagaatgagcaaaaaaggcaaggaaaagcgaggacccgctgggacagtcagctaggtgccattgtg

SEQ ID NO: 714950 - DNA, 194 bp, Homo sapiens
gaggctctctctgtggggctcagaggttggagaaggcctgaggctcctgaggcccaggccatggatccagtaggagatggggcttgggtccttgtaagccacctcccagcaggctgatgtgtggttctccaaggaagatgccttgagcccctccatgcaagatggttcatttgctatccacagtggctcttctt

SEQ ID NO: 714951 - DNA, 122 bp, Homo sapiens
ctggccctaggttcttagggagcaggctgggagtcagtgggagatagagtccaagtctgaacatgttacatatgctatgtctagcacttggaactcccaagtctcccactgactccctaaga

SEQ ID NO: 714952 - DNA, 223 bp, Homo sapiens
tccgcattgtagtgggcacctgccatgtccctcctttccttcagctatccccgctctgaccttgcattttcattcttatgttgtttctcttttcccgttcagtagctcgagcgcagtgttcaccatttgtggctatgcggcgttctgggtctcggccctctctgcggttgtagggcccataggactgagagatggagatgcgtcccctccctccccccgccaa

SEQ ID NO: 714953 - DNA, 572 bp, Homo sapiens
ggtctttactctgtcgcccaggctggagtacagtggcgtgatctcgggtcactgccacctccgcctcctgggttctagcaattctcttgccttggcctcctgagtagttgggattacaggcacataaaaccacgcctggctaatttttgtgtttttagtagagatggggtttcaccatgtcagccaggctggtctcaaactcctgacctcaagtgacctgccccttggcctcccaaagtgctgggattacaggcgtgagcaccgcgcccgtgaggcagttaatagacactgaagggcagagtgatgaagcaggaatgctggctttgctgtcctcttgttgctcttcatcagctcctgcctcccaaggaaggatgcatagtggaaagccttgaggagagcttcccaggcttgctaactctctctctctctctctctctcaaaaagcttacagtgctggaaagtttttccaccacagcgccacagcttatcagcgtagatgccatctcagaagaggtgataccaagggattacatatctcagctgtgatctttctgctccaagctgcctttggg

SEQ ID NO: 714954 - DNA, 149 bp, Homo sapiens
gatctacaagaatgtacaagactgatctggaagaaggacactatttcggacacatctggtgacttccgcaagctgatgcttgcctgtcaaaggttagaagatcagaggtatggctctgtcatctgattatgaactgattgaccaagatg

SEQ ID NO: 714955 - DNA, 430 bp, Homo sapiens
gatatattgcatattcacattatgcctatatgcatctttggtagtaaactttaaccatcaggtcaattcagttatgggagctcatctccttccatctctcctaattctagatgctcaagggaacagtcaggccttacagcagggttgtgaaggcaatatgaccggcactgaactatgtgaaagggcgtctggtctattcagaggaagaggctggatatggcttatcaatagcaggcatttataattgcccatccctcaccaatgcatcgggggtggtccctagatatgaaaggtgaggaagtctctgcatactgtgatggtaccacgggctgcttcaattgtaaggcaaaggaagcaggaaggaaaggaagggatgcatttagaggcttttccacactagcgagtgtgccacgccccactaggttttccg

SEQ ID NO: 714956 - DNA, 213 bp, Homo sapiens
  misc_feature (15)..(15): n is a, c, g, or t
  misc_feature (28)..(28): n is a, c, g, or t
  misc_feature (74)..(74): n is a, c, g, or t
tggaggcagaaaatnttttaaggatttntttcaaagaataagccacagcaatggttttttagaaaactcctgtncttttaagcaaggacttttgccctctagaaagcaactgaggccaggtgcggtggctcacgcctgtaatcccagcactttgggaggccgaggtgagcggatcgcctgaggtcgggagtttttgagaccagcctggccaac

SEQ ID NO: 714957 - DNA, 252 bp, Homo sapiens
cagtgttacccgcatgacgacgttcatctagtgtgtggtgtacactagttgtccctttgtgaatatcggactgctggctttgacgactggactcatgctgctgtatcactatttgactgctcatcatatgagccttgatgtaaatcatagcctgactgctggtcatatgaatcttgtagaacatagtctggctggtcataggaaggtgctcttccacctaggattcctgatgattccatgtaaagctgctgt

SEQ ID NO: 714958 - DNA, 878 bp, Homo sapiens
  misc_feature (878)..(878): n is a, c, g, or t
tggggcaggtaggaaaggtcttaattatgggcctgtgagtcatcaggtgggtcggacataggttacgtgtccaaaggatcggccgggcacacgctagctaccccgtgcccatgggagcagcccctcgggccgacgccaggccttggtccatcagtgccagggaagccaaccccaccatcccacaagttcaggctagggggtgcgtgaggaacagggcgtgtcctaggatgggaccctccatccgggacaggggtccgggggaggatgaggcgtgaggccgggaatagaacagctctttgggttccatgatcatctaaaaaacagaaaagacaaacatttcacagtcttaaaaaaatagaagtctggaggagaagaacgccagagtccggggcccggggaggcccctcgaggcctcagcattcccggtccctggaggtctggtctggcagggccgggccacagacacgtggcccgtaatgggagccagggcctacaccccagcaaccatggtccagggaccggcagtgggtatggatctgggcaccacctactcttggggggggtgttccagcacggaaaagtcgagataatgcggcaggattcggaaaccgaacatcaagtagagtcgctaaggacactgaacggttgaacgcggaagccggcaaagaaacatgtggattgaccccacaaacaagtcctgggtgccaacgtctgaggcgcaatgaagatccgggcgcccgcggataaaatgggccttaggggggacagcctgggccggcaggccaaaacacgggagaccaagctaccaggggggcaggtcgaccaaaagaatgaccctcggatcaaatgtggaaggggcacaagatcacggcacaagn

SEQ ID NO: 714959 - DNA, 314 bp, Homo sapiens
cctttttttcatttaattccaagggtgggactccaaaactggcaaagtgggagccccattagtttgctgtgaaatcaaattaaaaaactgggaggaaggtaataaactattttacccccagagccttaatttttaaagtattaaacttgaaaattagggcttccctttcttgctttagaatgtaaccccccataagggctcatttttgccctttgtgaaaaacgggttttatcccgaactaaatgaaggcatttatttttcttgtttcaaaaatgtttttgaaaaactattattgttttcagaaacctctttga

SEQ ID NO: 714960 - DNA, 200 bp, Homo sapiens
  misc_feature (123)..(123): n is a, c, g, or t
tctggcgagtctgccagcatgcttcgccatcctttttatatgtcctttgcttcccacttctggtacattcaacatacgttcacgtagtcagcagtctttctgctttttgtgaagcctcagaantcctctgttctacttggcacccaagctatgcctggattgtatctgacttggctcgatagtcggtggtctggcagttt

SEQ ID NO: 714961 - DNA, 228 bp, Homo sapiens
cgagggggttgatagctggtcccagagccgagcaggctctgctctgtggttctgggccacaccacacagcattctcgccggcagacaagagcggggcttctgggaaccggcagagggaagccattttctctcggtaagtatctgtcttcatggccgaaagcaggcaggcgcgtacgtgcacagacaggtccacatgcccacattttcggtatggcagcgtcggatggg

SEQ ID NO: 714962 - DNA, 231 bp, Homo sapiens
acaggcatgtgctaccatgcccaggtaatttttgtactttttgtagagatagggtttcaccatgttgcccaggctggtttcaagcttctggggtcaagtgatttgcctgcctcagtttcccaaagtgctgggattacaggcatgaggcatagcgctcaacttcctttgttttataaggaccccaggtattggatttagggcctacccctcatccccccatggcctccatga

SEQ ID NO: 714963 - DNA, 122 bp, Homo sapiens
atataatcatcttctttttattacttctctggcattcttgcctggatactttgctcgcataattatacctacaatgaaaccagcatcccaaagtcaccaagataaaccctcctactccaact

SEQ ID NO: 714964 - DNA, 664 bp, Homo sapiens
  misc_feature (32)..(32): n is a, c, g, or t
  misc_feature (71)..(71): n is a, c, g, or t
  misc_feature (81)..(81): n is a, c, g, or t
  misc_feature (90)..(90): n is a, c, g, or t
  misc_feature (155)..(155): n is a, c, g, or t
  misc_feature (184)..(184): n is a, c, g, or t
  misc_feature (208)..(208): n is a, c, g, or t
  misc_feature (210)..(211): n is a, c, g, or t
  misc_feature (227)..(227): n is a, c, g, or t
  misc_feature (232)..(232): n is a, c, g, or t
  misc_feature (234)..(234): n is a, c, g, or t
  misc_feature (236)..(236): n is a, c, g, or t
  misc_feature (286)..(286): n is a, c, g, or t
  misc_feature (293)..(293): n is a, c, g, or t
  misc_feature (297)..(297): n is a, c, g, or t
  misc_feature (319)..(319): n is a, c, g, or t
  misc_feature (322)..(322): n is a, c, g, or t
  misc_feature (324)..(324): n is a, c, g, or t
  misc_feature (374)..(374): n is a, c, g, or t
  misc_feature (385)..(385): n is a, c, g, or t
  misc_feature (419)..(419): n is a, c, g, or t
  misc_feature (421)..(421): n is a, c, g, or t
  misc_feature (457)..(457): n is a, c, g, or t
  misc_feature (475)..(475): n is a, c, g, or t
  misc_feature (535)..(535): n is a, c, g, or t
  misc_feature (541)..(541): n is a, c, g, or t
  misc_feature (556)..(556): n is a, c, g, or t
  misc_feature (567)..(567): n is a, c, g, or t
  misc_feature (576)..(576): n is a, c, g, or t
  misc_feature (654)..(654): n is a, c, g, or t
gggaggccaaatcgcacaagggcaaagcaaanagaggaagaaacagtaaaaaaaaaaaaaagaccaaaatntctttgtttngtttttccngtaaaaaaaaggaccccaaaaaaaaagggagggaaagggacaagagggaacaaacccctaagggnagagaaaggggaaggagaaggagaagccncaaaaggagaggggggaggggaangnnataaaggcagcaaagnaatcncngnggaaagagggaggaggaccccccaaagcctcagagaaaaaggcaaagatngcccccncagngtccagaagggaaagggcagcnttncntccttccatggcagccactccattacccactccggataacctacaccctnatgtagaaaanagtgcggcagagcccgaaaggcagaaaatcgctngngtgggtaaaaagtcagcattaccagcagcagcggtncccccgactcccccatcncagggaccaccgactgccctgggcggggccctcgggggggaaaggctccacggggcaggnatacanctcgaggccagtaancctctggaggnagcccaatnaggtcaaagattttgcccaactggtcggcttcagagtttccacagaagaaaggctttcgacgaaacaactctgcaaanatacagcaaa

SEQ ID NO: 714965 - DNA, 220 bp, Homo sapiens
cattcgtgtcccgctaatcctgatacgcagtccatcattaccaatagggtttacgacctcatgttggatcaggacatccctatggtgcagccgctattaaaggttctgtttgttcaacgacttaaagctcctacgttgatctgatgttccgacagagagtaatccagtgtcggtttctatctacgttcaaattcctccctgtactaaatgtcacggcgga

SEQ ID NO: 714966 - DNA, 343 bp, Homo sapiens
  misc_feature (3)..(3): n is a, c, g, or t
ctncaggagagagaactgaatcatggaggcagtttcccccatgctgttctcatggtagtgaataagtctcatgaggtctgatggttttataaatggatgttcccctgcacatgctctctcctgcccacgtgtctgactaaattttgtatttttactagagacgggctttcactatgttggccaggctggcctccaactcctgatctcgtgatccgtccaccccgaactcccaaagtgctaggatcataggcataagccaccacacccggcctctttttttttctttttcttttctttatctggagactgagttttgcactcgttgaccaggctgaagtgcaat

SEQ ID NO: 714967 - DNA, 328 bp, Homo sapiens
ggaatgacttaaatcgaactaaatggaatgtgaatctgcatgtacagaagcatattcccaatctgagtgagcaaataattgctagtgcccaattcctgtggctggccagaaatcagctgccattcgctgaacggagacaagaacacattatgtccctgatgccaaaatatgcacctactctttcctctaatctggtgaggtcatcctgggagtgacatggatggcctccgcacagagcttcataacctcttcatggactttttatcttcaagccgatgacggaaaaatagttatactccagtctaaagccagaaatccagtaggcaac

SEQ ID NO: 714968 - DNA, 218 bp, Homo sapiens
  misc_feature (80)..(80): n is a, c, g, or t
cgaattctttgtggtgagaaagcccctggctgtgttcacgtacattatggatggtctgcaattgagaggacatgcgtcanccttgaggagtctttctcccttttttggagacagggtctcactctgttgcccaggctagagcacagtggaacaatcatggctcagtgtagcctcaacctcccagcctgggcgacagagtgagacttcgtctcagttta

SEQ ID NO: 714969 - DNA, 213 bp, Homo sapiens
cggagtcgttagaggatccccagtctccactccacctcctcgagtccagcttctcctgactcagcttcctgagtagtgggactatagacgtgccaccacgcccagctaattttgtatttttagtggagacagggttacaccatgattggccaggtctggtctcaatctcttgtacctccgtgttccacccacacttgagcctcccaacagtgc

SEQ ID NO: 714970 - DNA, 981 bp, Homo sapiens
gggtccagttcccttttccggtcggagtgatcttgcgagtggagtgtgccgttgtgcccggtgcctgcaccgatgagcgtgccggcttcatcgaggatcagtgaagaagatcagtgactgtctgtaagacttacgctagtcctcttaatctagtagatctgaatatgagtcgcctagaagaagtttccagtatagtaggaaactcgggacaaggtgtggacttccactgttcgatttacgctcaaaattcagttgttagatgcccttgtcgattggtgatgtcctggaagggtaggcgagtgtagttggacagatagtcgcacaatgtagtgcagtcggaagccagctgttggtatcccatacgctatgatcctggcaaccacgtgacaaacacgaagctctgattgacagcctatgtgaaaagctggtcaacatctcgcgaaggtgaacgcccgtctctgagactgcggtggtcaagcaagcttttccatcgggatggataagaatactcctgtacgagacacagttgtattgcaggcttataaaagtggcagcatcttgtggggccatccagttacatcccaattgaggctggatccagttagaaaaatggattgctgactggaaatctctcgcattgagtacaagcgcatcccttttgagactacttgtgtgaggcacttgtggatttgtaggaagagtgatgctggttcaaccgttatggggaatggctcggaacttcacgggtgcaatgctgcccggtccagttgtgcgcgcgtgtttgttcggcttggggatcccctgctttcttttgcccctcttcttgagacccgccagttgggcggcagttccgactcaacctgggggcgccacggccctgtcggttcaaaaccccttggcggcggctgggatggggagctccttgggggcaccgtttttcgcccacagcgctgttgtgccctccccctcttgacacgtgtc

SEQ ID NO: 714971 - DNA, 235 bp, Homo sapiens
  misc_feature (29)..(29): n is a, c, g, or t
  misc_feature (80)..(80): n is a, c, g, or t
  misc_feature (160)..(160): n is a, c, g, or t
  misc_feature (192)..(192): n is a, c, g, or t
ttttttagactagtttattgaagtgaggnggaaaagaataaagtttttttttttcctttgagatggagtcttgccctgtngcccaggctggagtgcagtggcacgatctcggctcactgcaagctccgcctcccgagttcacaccattctcctgcctcancctctcgagtagctgggactacaggcacccgncaccacacttggctaattttttgtatttttagtagagacgggt

SEQ ID NO: 714972 - DNA, 200 bp, Homo sapiens
atctcattcgacaattaactactttcacatggacgctatcaaattttcctcctgcccatgcctctttgcatgtagcccttgtctctgactgagctggccatctgtctaatatttacataatttctttaataatatctgccgttctttacctacaacatatcttggattgtggctttaccaccggcaaaactgaccctagg

SEQ ID NO: 714973 - DNA, 1046 bp, Homo sapiens
  misc_feature (1)..(1): n is a, c, g, or t
ntgacagtgatgtgtactcaggctaggcggcctttggcggttgaccgttcccgtgattattgtggcttctcccgctgctccggtcggttaggtgcccctccgccggtgtgccctgcaccagggtggccctcccctccttgcggcggcctaatgtcacccatccgggcaattcccctccaccagggcagagagacctgggcttgtatcccagccctttgccccggggtgtcccctctccccttcccgcgtgtataccaagggctttattttttccgccacgagttggccgtaattctcagaactggggaatctccccgccctcgggagcctggggtcctcaatttcgccggttgtgtaggcttaggccccccttgggtgccttgcgagcttcctcaatagacaccgttatcccttggggccagttgtgagctcttttcttccgggtacggccgccccggaggcgtttgtctctccccaaagaggtcggccccccttttccttgtggcgccctgtgtgcgctcctgcgcccgcaggctcctcacccgggggccccccaggtggcctctcgcaccgtttcttctgttcgcacgcgccagacatgttgggtgggtatcatggggggtctgttcatgtgaggcccctgaagaacgttggacaaatcctgttcaaaggccccttccaagggaaggagaaaccccggcccgcgcgggtcctggccacggtgaggtgttccccctgtggccccttcacaatgtttgtgctgtttgtttttttttataaaacaacaggagcaccttttaagacaacctgccccgttgaagaaacccagaaccagtcccgttgtgtgtgtgggaccacaaggcaattttccaataattgtaattggggattccgtttctgaagatttaggaaatttttccgcccattaagccccccgttttaagccccttttattttgaagtttgggtattgtgtgggggcaaatggttttttttttttttttcaaagcgtgtgtgaaccaatggaaataaagcccgggactgtga

SEQ ID NO: 714974 - DNA, 105 bp, Homo sapiens
ctattacagtggacagggggacaagggatggggggaacatatgccaatctattttctgagctcttcacacggtgcctaaaaaatcccaaacatataactgaactc

SEQ ID NO: 714975 - DNA, 693 bp, Homo sapiens
agaacgtttacaattcacgcatttctttaggttcacctgtaattaagtcgtcttcatgtgaagcaacttggaacatagcttcgatattctctcaacctcgctagaagtctgggaaagcagtcatactttgcatgcactatatttcatacaaagatcatcagtatgctgtaaatcacaccatcagtcgtaacttagctatactcttagaccacattggtcaatttctcattgctcagaaatgtcactattaggagccatgtacacactcattagatctatcgagatatcagtatgcacatgtatgtggtcacagagtcagtagagctcatggtaccgagcagtatctgcagaatcggcacagctcagcgtctcagggctgggtgtcagtctgttcaacagatttctgaacaatcactggaggcgtgtgatcagaccttgtgaaacagcatgtgtgtgatggctgagataattacatagggcctcaaggcagtgactggcaccagtgcctactctggcttatgacgcaggaaagcatcagtagtgagttcagattgtctgcctgataggatcatgacaggcagatctcactgggtaggtgctggaaagtcaatggtcattacctatgaaggacagttcagagaaatagtcctgtaaaataggcatggcgatgtcctgacgggactcacagccatg

SEQ ID NO: 714976 - DNA, 975 bp, Homo sapiens
ctagaacatgcgtaagatgcgggcgcccagtaggtacgttcgttaggacgatggtcatccgactgtgtgcctacggggatcctggtgcatgagtacgctggttgtagctcgaccgaatagaaaacgccttggcggtaaccgcattgtgctgaaccaatatcgcgagatggagttgtgaaggctcatggaggggtagtctagtctagacagtgagtccattgcgagcttagatataagaataaagccctggccatgcattgtcagagagggttcgcagggctgtgttccaattgggtcaggttgggtggatgaatggaaattgatttaaaattcgaaattaaaatttggattggtgaaatcttggattgttacagaagcaatattcccaaattcttgattgaggcaaatattgcttcgccaattcctgtggtcgccagaaatccagtgccattccggttggaaccgtgagacaagaacaactttagtgtcccttgatgggccaaaaaatgcacctactctttcctctaaactctggggaggtccattctgaggtgacaatggatgggcctcccggcacagagaagcttcataaccctcttcatggactttttatccttcaagccgatgacgggcaacaaatagttattatccagtcctaagacagaaatccagtacgcaccacattggggagcaggagcctacaatttgggagaatcatcttaagcaaatgtctatctgcaattgaaaatcccagggccaagaatttctgaagatggaaaagtgatggtttaaggatgccttctaatctggggggattaactaacacctggcctcgggaggtatgtgacttgtgggcaacgtgacctgtgcgaatttcctcgaggggaatatggggcgttataaaacacaaatcatttgtggggatacaagagtaaagagcgcacaagggtcaagattaaagaaaacacaacaggg

SEQ ID NO: 714977 - DNA, 386 bp, Homo sapiens
gaggcgggttgagtaccaagatccatcatctcgttgacggccacgggatgccgttggtgattctgaccgcacccgggcaggccggtgatgcaccgatgtttccgatcctgatgggacacctgagagtggctggcagtggcccgggtcgaccgcggacccgcccggacagggtccgcggcgacaaggcgtattcatcgaaagcgatccgtgggctgctgcgtgaccgtggcatcaccgcggtaatcccgcagcctgatgaccaggtcgcccaccgtaaacgccgcggcagcacaggtggtcggccacctgcgttcgacgccgaagactacaaaggccgcaacgttgttgacgccgctttcaacgaccaaacaattgggcgccatcgc

SEQ ID NO: 714978 - DNA, 394 bp, Homo sapiens
gcgatcagaggatccctaatcacagtcgtcagtctgcacgtataattttgtgtgtcataatagctcttattttaaaaaacaggactagttaacagtgtcaattactagtaattcatggtataaataacttaaacaaggaagtgttaaaaagagtgttttaaataaagttttattttacgtcttttttttacttacacagaaatcgtcaaaaaaaaaacagcagagatttccccatgtagccgcaccctagtttccctctcttattaccttctcctatcagggtgtctcacatgggttaataaatatctaccatatttggccggagttaatgacccaatatggatagacggtaataacctaaaagtccatattccattggggttccccttaagtt

SEQ ID NO: 714979 - DNA, 234 bp, Homo sapiens
agagatgcaacagcagatatgtctatgacagcctgctcacaccagccatgagctgtgccggcttcctgcagggagacgtcgactcttgccagggggacaggggagggcctctggacacttcgaagaacaagatccggcggctgataggggatacaagctgcggtgctggctgagcgagagcttacagaccacgagtgtacgggagtgtgatcttattcacggactggatgtatc

SEQ ID NO: 714980 - DNA, 448 bp, Homo sapiens
  misc_feature (35)..(35): n is a, c, g, or t
  misc_feature (91)..(91): n is a, c, g, or t
  misc_feature (143)..(143): n is a, c, g, or t
  misc_feature (167)..(167): n is a, c, g, or t
  misc_feature (340)..(340): n is a, c, g, or t
  misc_feature (343)..(343): n is a, c, g, or t
gaagactctgggatggggccagagtttgtttgacnagcccccttgtgcccactgatgtgaagctcaaagcttgaaaacactgaatgagcantaatccctcccccggcctcttctccctgggccagcctcctccttcacctcantcaggtctcagcaaaaccctcctnccaagggccagcaggcacactggctcatgcctgcaatcccagcactttagggggccaagacagaaggatcacttgagatcaggagttcaagaccagcctggccaacatgatgaaaccccatctctcctaaaaatccaaaaataaattagcccggcgtggtcacaggcacctanaancccagctactctggaggctgaggctggagaatcacttgaacccaggaagcgaaggttgcagtgagctgagattgcgccactgcactccaacctgctgggcgacag

SEQ ID NO: 714981 - DNA, 1015 bp, Homo sapiens
  misc_feature (131)..(131): n is a, c, g, or t
  misc_feature (141)..(141): n is a, c, g, or t
  misc_feature (146)..(146): n is a, c, g, or t
  misc_feature (165)..(165): n is a, c, g, or t
  misc_feature (284)..(284): n is a, c, g, or t
  misc_feature (291)..(291): n is a, c, g, or t
  misc_feature (302)..(302): n is a, c, g, or t
  misc_feature (320)..(320): n is a, c, g, or t
  misc_feature (322)..(322): n is a, c, g, or t
  misc_feature (329)..(330): n is a, c, g, or t
  misc_feature (336)..(337): n is a, c, g, or t
  misc_feature (358)..(358): n is a, c, g, or t
  misc_feature (364)..(364): n is a, c, g, or t
  misc_feature (366)..(367): n is a, c, g, or t
  misc_feature (380)..(380): n is a, c, g, or t
  misc_feature (406)..(407): n is a, c, g, or t
  misc_feature (416)..(417): n is a, c, g, or t
  misc_feature (434)..(434): n is a, c, g, or t
agcctatatgcgcagtacgcaatgcagatcccaactccatggtaaatgtgatgtacacggccccccggatgatgacggctacatgaacggcagggtatgtccgtaactagtcatctcaaatggctcctacntgagaaggtngacancgtgggcagtccacaaaanctacggggcatcactattggattgatctgcacaaatacctttgaagagtacgatttcaaaaccagcaattggtgtgaatgcaaaaacatttgtggcaccatttatttaaaaaaaaaaanagctgtntgcagcagaangccttatacaagtggttntnctttttnncctttnnctttttttgggtaccttcatntctgtnanntttatataaaatnctctgcaaaggaaggcctctcttggnnctacaattnnggaggcagccacttgtngtgcctggcttctggttaaacaatggtgggatatcaaggcccccccaaattatctggtttaatcattggaacctagagctttttttttcccttccctggtccactccatggtaaatgcctttagcatttcagtaatggcatatcgggttcaaggtgacacttcagcattgccgctaaggtcttggtaagtgacagtgcatttggtagtactgtacaactttttgtgctaaccagtaagccatttcttaacgtttttggccttgattagggtgcctaatttggggggtttaaaaaaaaaactaatatatcgggtgcaattattacacacgtgtacaagacgctataaaaggctattcgcattttggtttacgtcaacacgggttcagtggctaactggttgcggtaaaagttgaggacccttttccatttgggggcacagattcttgggggacaaaaagcgagtttactggttatataatggagagatctctgtaaattgattgaagcatatttcagggtaatctgacaggttctggaaccatttcatattttccaatattggaagatttaaaaacattgtg

SEQ ID NO: 714982 - DNA, 223 bp, Homo sapiens
  misc_feature (85)..(85): n is a, c, g, or t
ctctggcagcagacagcggctggggtggcacggcacgggctgacgtaatgtcacggtggttctcgtcactcatcatcatcatgtncatgagcatccctgttgccgagcgtgtgttgaagccgaagacgatgaccttggaggcgtcgctggcgcactcgcatacgggcaggtacaggtcgctgtagatctcctctgtctggaatagccgaacctgccggaccag

SEQ ID NO: 714983 - DNA, 139 bp, Homo sapiens
aatgcgcgtgagcatcgacaaatagaaccatagaaaaattagagaaggaggctgcggagatgggaaagggctccattcaagtatgcctgtgcgatctaggactatactgaatagctgagccgtgtaacgtggatatcac

SEQ ID NO: 714984 - DNA, 1077 bp, Homo sapiens
gccgagatggaggcgacggcacctgggcgctgcctggcgctaggcgctgcatcctgctgctgacgctggcgctgtccgggaccagtgtcccgaggaccacctgccccccgtggcccgagccgataccactgctgggaaacctcctgctgactacgtgccctggggcgctgtattcagtggctcatgcgtgctgagtaagaagtacggaccggtgttacaccatctacctgggacccatggacggcctgtggtggtcctggttggcgcaggagcgctgtgcgggaggccctgggacggtcaggctgaggagttcagctggcctggggaaccgtagcgatgctggaagggacttcttgatggccatggccgttttctatctccaactgggcgagctggtggaaggcagcctcgagtgaagtttaccgatgcttgcctcatgcggcgaccatggcgcattgggggaagcgcagacagggcgaggagctgatccagtgcggaggccccgggtgatctggattggagaccattccagggagcaccagacaggacgacccacttcgactcacctcaacgtgactgcatgggcaccaggcaaaacatccaaacgttagctcttgagttccctccatactcaggacactccgagtttataccttattgaggactaagagcagtccccagggccagctcggtccggggaaaaatagggaggaaacgcctgacgtgtcgaacatcaaggcttcccaagggcaggcgatacacgaaccgtaaggcaggaatgatcatcgcatggctatccttgagggaccccttcacaatgggccccccgacgaaggcacgattcctcacaaccaagggcaggcgagcgctgtgacctggcatttcacgcagcgtccccgagcaatggtcgcaaagcagcacacacctggcaaaccttggaatcgatatccgggccccccggaaaggtgaaccatgtcgacttacctttccgttgggatgatggatgggagacacggcagggcgacagggttcggcagggcacccacacattattgagcatggaatggcaaccagtga

SEQ ID NO: 714985 - DNA, 282 bp, Homo sapiens
agggtattctatgtaacagtcttgtaaaccttaaaacagccacgactctatcgctgagatagaataaggtacttaacgcaatataaatatctaccataatttaaaaatgcaaatataagcaatgcactaaaaaataacctttagcttatttatagttaagaaacaagtgtattgcataatacaggcttcaaaaaatataatagaattactctatactgatatctataatcggaaggtccaggagtcaggtccaccttccatgccatcatccttctttccacc

SEQ ID NO: 714986 - DNA, 599 bp, Homo sapiens
  misc_feature (569)..(569): n is a, c, g, or t
ggcacgaggccttcttttcaaagttcctcaagcctgttactcatttgtcaaggctgggcttctcctacaaagccctcaacctgcccagccagcagctgtgaggctgactgaatatttggtgaccatatcaccctttctggtgctgaagctcatgtcagctccattggacagtgttattctgggctcttctcactgtagaggactggagcagaaagggttccttggaaacctgtgctgggaagccctgtttggtctaaggctaagctttggttaactctgggctccagccctttcttcctttaaatagctgatgcacggccagcaggtctccattctcatcctctctttctattctgtttctttggttcagaaatactcttctgctttttttggacgaactcaatggcccgatgttagatattgggtatttttcaatcttctgttttctgacccttccaagaaagtttgaggaagaacatgtactgctttcacgttcatttcgcccattcagatgtcttggcttgaaccttatgactccgtatcaaagtcctcacaacctgtctcagatncctgctggaatatacgggagcctctagagt

SEQ ID NO: 714987 - DNA, 644 bp, Homo sapiens
cgcggttgttcacgtctgggatcacagcaatttggagggtcgatgccggcggacgacgaggtccccattcagagagcatgatcgctgacacggcgaaaccacgtttctacttaatatgcaaagtaactagactcatgtgactaaggtaccctgtcgtcacagttacacaggtggctatggtactagaaagtcttgaacccgagaggctagagattgcagtgagccgcgatcgagcttgagtctggttgacagtgccagacatcgtcttaaaacactatttacggactgcactgatgactccatgaagcccatgtcggtccccccaacgctagagcagtagaagcttatggatgcggtctgaaaactagtctacttggccattacacgctatagagtgacgtttatacaataagtgaccgacattttcaacgcttcgtgggctatacctaggcggacccatattaaaggctttgaatgcatacgcctttagacagatgggggaatattgaataggccctaatcggtcgcattgccctgtgtgagaccttattatgcaatggaattgggagtgctagatccgcattattacgagtgacactttagttaattagtatcttttagtgcttgggccttattctgtgctt

SEQ ID NO: 714988 - DNA, 221 bp, Homo sapiens
gcgaggcctatattacggatcatttctctactcagaaaccgaaacatcggcattatccccctgcttgcaacctatagcaccagccttcataggctatgtcctcccgtgagccaaatatcatctgaggggccacagtaattacaaacttactatccgcatccatacattggggcagacctagtcaatgatctgaggaggctactcagtagacagtccccccc

SEQ ID NO: 714989 - DNA, 374 bp, Homo sapiens
ccaggctggacttgtacatgttttgctcctctacgttctaattcttgtgtatctctggcggaagggtctgctgccccgctcaccgtggattggcgatttagtcccaaagcgtgaccattaagtcaatcgtttctaaacgtttcgcgactttggtctaagacgccacctgcgctacaggataatgacaatcctataaatccaaaatgaccgttttatgaattcgtaagatttttacggaatatggttggaacctttactgccattcgttgtagcagtcgcacaattcataacttttggttatttgcaaacgtttgctcataacctaattccgtatcgttctatagggacgaaaaagcctagcgggctccgctgat

SEQ ID NO: 714990 - DNA, 193 bp, Homo sapiens
agtaaagggtgaactggtagaatggagagtcaggtccctacagtgctgctttatctcagagtcaagaattgtgaaaagttacagggaattggtttgtcagactgagcccattcaacaggaatggggtaccacaaaaaaaaaacaaaaacatatccccccaattttgcctttttgattttggacaaacggccca

SEQ ID NO: 714991 - DNA, 137 bp, Homo sapiens
tggtcaaatgaaatttaaaatttattaatggtattttacattaattttataattcttttaagcaagtggccccataaattatagactacattgtctccatacccattaacaatctccagcatttccccctcaaacct

SEQ ID NO: 714992 - DNA, 185 bp, Homo sapiens
cgttctacttcagacgatgcagtggtcttaacaaatctcctggctggtacaggaagatgtagtgagagtcgccagtgtctacgaacaatatgagagcacacctcttagaggaagacagaaaacaggtcttgattccccgtaatggcattgacttttcgtgatattactgacaactacttttactg

SEQ ID NO: 714993 - DNA, 484 bp, Homo sapiens
  misc_feature (107)..(107): n is a, c, g, or t
aggtgcagtagcttggccagcacacagtctctcaggaaggaagtctcccagggctgtgtctgggctgctgaagctagtgtgaattcttttccacatagccacgcggntgggaaggatccagtgtcctttttgttttttttatttttggaggcagggtctcactctatcacccaggcgggagggcaaggaggcagtctcggctcagggcaacctcgtgcctccggggttcaagcgattctccttcctcagcctcccgagtagcgggaactacagacacgcgccaccaggcccagctaatttgggtattttaagtagagacgaggttccactatgtgggcaagggatgggtctcgatctcctgacctcgtgatccacccgcttgggcctcccaaagtgcggggatcacgggctctcaccaccacaccgggctaattttttttttttttttttgggaaaaagggtctcctgggtggcccgggtggag

SEQ ID NO: 714994 - DNA, 809 bp, Homo sapiens
  misc_feature (74)..(74): n is a, c, g, or t
  misc_feature (92)..(92): n is a, c, g, or t
  misc_feature (111)..(111): n is a, c, g, or t
  misc_feature (151)..(151): n is a, c, g, or t
  misc_feature (163)..(163): n is a, c, g, or t
  misc_feature (196)..(196): n is a, c, g, or t
  misc_feature (200)..(200): n is a, c, g, or t
  misc_feature (219)..(219): n is a, c, g, or t
  misc_feature (221)..(221): n is a, c, g, or t
  misc_feature (241)..(241): n is a, c, g, or t
  misc_feature (243)..(243): n is a, c, g, or t
  misc_feature (247)..(247): n is a, c, g, or t
  misc_feature (281)..(281): n is a, c, g, or t
  misc_feature (283)..(283): n is a, c, g, or t
  misc_feature (348)..(348): n is a, c, g, or t
  misc_feature (350)..(350): n is a, c, g, or t
  misc_feature (367)..(367): n is a, c, g, or t
  misc_feature (385)..(385): n is a, c, g, or t
  misc_feature (388)..(388): n is a, c, g, or t
  misc_feature (394)..(394): n is a, c, g, or t
  misc_feature (410)..(410): n is a, c, g, or t
  misc_feature (420)..(420): n is a, c, g, or t
  misc_feature (427)..(427): n is a, c, g, or t
  misc_feature (439)..(439): n is a, c, g, or t
  misc_feature (444)..(444): n is a, c, g, or t
  misc_feature (456)..(456): n is a, c, g, or t
  misc_feature (460)..(461): n is a, c, g, or t
  misc_feature (463)..(463): n is a, c, g, or t
  misc_feature (471)..(471): n is a, c, g, or t
  misc_feature (482)..(482): n is a, c, g, or t
  misc_feature (488)..(488): n is a, c, g, or t
  misc_feature (492)..(492): n is a, c, g, or t
  misc_feature (494)..(494): n is a, c, g, or t
  misc_feature (507)..(507): n is a, c, g, or t
  misc_feature (514)..(514): n is a, c, g, or t
  misc_feature (526)..(526): n is a, c, g, or t
  misc_feature (528)..(528): n is a, c, g, or t
  misc_feature (542)..(542): n is a, c, g, or t
  misc_feature (566)..(566): n is a, c, g, or t
  misc_feature (596)..(596): n is a, c, g, or t
  misc_feature (629)..(629): n is a, c, g, or t
  misc_feature (631)..(631): n is a, c, g, or t
  misc_feature (783)..(783): n is a, c, g, or t
atctggcccctagaggctggtacttgggcccgaaacccccatctccggcggagagaccgtccgaggtaattttnttccacgattgcacattntgaaaacaggagattttanttcctaaaaatgggaagaacctacattttagaagagactnttggccagtatntttcaaacataaatctccaaggaaaggcttttntctntggccttttaataggacantnttcgtcacaaaaggattatntnattnttgccactagaacgccacccaaagaggagcaaantnagaacctcaaacatcccaaagctaagttggataacttggatgaagaatgggccacagaacatgcntnccaggtatccagaatgntaccagggggacttttanttnttggantatttattattactantttagaactngcaaatnattttcaaaatnccctncgtagactaatntttnntntggaaaantctataaatanaaaganattntngaatttcacagangaggaantctcagaacgantnacacttcacatttntgcttctacaaaaaaaatattttntcgaacttatgatatccatgatccaaaganttcagcaagaccagcagattggaagtatcaaantngattatcatcctcatggctttctttagagtgtacagttcacattaatattcacatcccactttctgctacttctgtcagctatactctggagaaaaatacaaagaatggacttacacgctgggccaaggaaatagaaaatggtgtttatttnattaatggacaagttaaagatgaaga

SEQ ID NO: 714995 - DNA, 271 bp, Homo sapiens
gaaataaactccggggggtagggtgggggtgttgccagggagtccctttttgtttttaaccacccctattaaggggggggttcccaggtgcccccaaaaattaaagccctgccccctcccacttttgaagggggggccccccccccgggggtcaagggtgggtttcccccgcttttttttcccccgggaaaggggggttggggggcgtctttgaatgtaaagcccacccccctttccgcaaacctccaaataaacaccttttttgggggga

SEQ ID NO: 714996 - DNA, 444 bp, Homo sapiens
gccctcccagtatgtacctggatactgaactgtaggagacccacaggacctctggactctcagctggtgcagacgaggggaggctggacaggagaccagtgtggactggctcccacccaaaggatgccccaggttgggggacaggacaggacaccccctgatcttggaggtacagtcatgtcttaccccaaccccaaaggtgccctacatgccacccatggggtgagagtaatatggcagccactgcctgtctcaccgatgtccagcctggaccatctgaggggaggggagggaactcaggaagcagaggtcgtgctgctctctggatccccccatcctgtctccacccctgtgtccgggggtttcgggtaccctggggccctgacagccaatcccaccaggagcaggccatttcctgcccatgaaactcctactaggacctgt

SEQ ID NO: 714997 - DNA, 322 bp, Homo sapiens
atgtggtggtgttactcccaatctaaggataaattgccagcgccatggctcacgcctagagccccagcactttgggaggctgaggtgggaggattgctttaggccaggagtttgagaccaggctgggcaacatggtgagaccctgtctctaaaaaaatatattttttgattagttgggcctggtggcaggcacctataatcccagctacttgagagtctgaggcgggaggattgcctgagcctaggagtctgaggctgcagtgagctatgattgtgccactgcactccagcctgagtgacagagcaaacaagaccctgttct

SEQ ID NO: 714998 - DNA, 143 bp, Homo sapiens
gcgtcgacagctggagtgccgtgacacgatctcagcgctctgcaacctctgtctcccaggctcaagccctcctcccatgttgcccaggctggtctcgaacttgtgagctcaagtgatccacctgcctcacgcctgtaatccca

SEQ ID NO: 714999 - DNA, 913 bp, Homo sapiens
tgtggtggcgtgcgcctgtgatcctagctactcaggaggctgaggcagcagaatcgcttgaacccgggaggtggaggttgcagtgggccgagattgcaccactgctctccagcctgggcgacagagcgagactccatcccaaaagaaaaaaaaaaaaaaaggttttacaattttgggtactttctaaacaaaattggcggtttaaaattaccaagagagggctagtactttacaaaaggctggaaattaagagaaattctggtggtaaaggtacgtgggttctcttccattcaggttaagggtctttaaatgggcgttttgcttctataagggttacaaacggcggaaaagtcttatttcaccttccaaacccaacctttaactcttttcccaataaagggtaactctcgtggtaaatggctcgggtcaaactccgtggcgtggtcacagagcaaacaaacactttatagaaagatcacgagataggtaagaaactctttaaaattactcaggattcaatcttcaaagcctttatttctagagatattaaggcttcaggccttcttttcccacttaaaactttggagccttcagagaattaccttaggtaaaccttggtaaggttactcacgtttccttctttcctccaaacttaggccccagaaaaagtgggagattactagaaaaagacataaggcaacacttctaaataacggtgcatggtggtgtttgaaagtttcatagggcacatttcgcggaaaactggttctattaaggagatttagcaaaggtgtcctttaaaaaataacggttagcaagggaaaggaatggcaacgggagaacagacgggggtgtgggtggtttccaaggttcaaattccattgcggagaccggggttaataaaattccattt

SEQ ID NO: 715000 - DNA, 366 bp, Homo sapiens
cacactgacttacccacctccttcccaatccacttctttttctgatttcctgtttgtttgtttgtttgttttttgagacagagtctcactctatcacccaggctggagtacagtggtgcaatcttggctcactgcaacctctgcctcctgggttcaagcaattctcctgcctcaacctcccaagaagctgggattacatgcatgtgcttccatgccaggctaatttttttggtagagatgaggtttcaccatgttggccagggtgctctcgaactcccaacctcaagtgatccacccacctcagcctcctgattagctaggattacaggtgtgcaccaccatgcccagctaattttggtattttta

SEQ ID NO: 715001 - DNA, 1128 bp, Homo sapiens
ggagagagagaactagtctccagttttttctgattgtttttaaccatgggggaatggggtgtatttcctaccactggtgtcttgggaaaaccggtatggcgagggattaatccatatattccgggtccaaagccacactgtgaaacacagaggcagagcacttgttactcggggtggtgatctctgtggtcctcaggtgtctcttcgagggctccgtgttcccttcttggctttatagctagctgcccggggaaccaagggtacgaggtgaaagcagaggatagcagctatggggggagaggaggccgtggtcgtgggctatataccgagttcttattacactgtggtgggccttcagaccttcccgagaacggaggggcgcagaagaaacacgtggttgggacagctctcgatatgggcgctttcataggccgtgggccgtggaagacaagggtggggggacgcctcaaatgtgagaatagacaactctcaagtggagagtgtacaaacacccattatttcttgggggacacaacagagggggtatatcctctccctttcgaggcgagagaagagacactcaagtgcggggcactttaaaacactgtgtgtcaccaaaaattcccagagtgtggcacactctgtgggccagagaagtgagactcccgtatatccccttgtggggcgagagagtcatcacagtggggcactccatgtgggggggtttccccgagggtaaagaagcttggtggcaacccacaaccacaacatagttgagacaccactccatatttttcatcccctgtgaggatacaacctgtgggggttcccacctgggcagactttaaaaacagcaccgagagcaacacaatagctggcgcggaggaatcttccccaaagaagcggctcctccacacagatgatagcaccacagcgcgagagcagggggcgccacccagaggttacaacacttcaaccaggggaggggggggcagggtctacacaaacagtcggggcggggacctcccctcaccaaatatatgtgagggagagctccccgtggggcgcttcttccccgcggcgaaacaaatcttccaagaaacacacggggggggacagccccccaat

SEQ ID NO: 715002 - DNA, 266 bp, Homo sapiens
ccggatctagatagtgagactgctaatgataggacgggtacagtggctcacacctgtaataatcccagtacttcgggaggccgaggctcggtggatcacctgaggttaaggggttcaagaccagcctgggcaacagagcaagactccatctcaaaaaaataaataaataaaaattggttcttacctcataaggttattgtgaagattaaatgaaataaaccatgtgaaataccaagaacactatgtctggttaagtgtatctataa

SEQ ID NO: 715003 - DNA, 138 bp, Homo sapiens
tgtccctgtcagcagcatggagacatcactcatggtggttgtaaacattgtgggtgaagtagaacccctgcgatccttactcagctgagtgaagctgagctgtgataaaataaaagaataaagaggctggcgcggccg

SEQ ID NO: 715004 - DNA, 1563 bp, Homo sapiens
gccgagtttgtagggtaccgcgcagccaccgtcgcccgagctgcaggcgtacgtgtagccctggctggctactcggggccgtacggtcagttatgccatggacaactattaccatggctataagccaatttctacagataacccaaggttcatcatagacattgaaaagcgagtcacgtgctacgacgaggagaccacgtggtagacatcgcggagcatgccatgtcaaggccatactctgtcgcagacatactgaaggcacagcagatcgaaagtaaggtagctagctccactcgagcgttccatcgccgcgcgtgataggctttctcgaagcttcaacgccatgtaccaaggccacgacaagtgttcccacgaatttcgaacacgcacggccgtgaagtgaacgatacaatcctgggtgcacccggggagctatcttatatgatgtcatcacagaagacgagacttaggagacgggtgagcctacttcttctctgtcagaagactccttgacttgacacgcaagcgagtggacaggactagatctctcgggactgaactcagccatcgtctgccttagacttattcttgcatagcacccgttaatagacacttgagcgaaaccgttccatggatttcacaggtgttgtgaccaccgaagggattcgagaagataaggctaggcgttattccctgtgatctaacaaactattggacgcgtgcctttttgccctttaccacttgtttgtcgcgcatgtgaggaccctggttgcccagagcctcattcggggggattcaagaacacgcggtggacctgctgctatttgcctatcgggacgacttgagcaggcactcaaaggtctgagggggaaagaactgcttgcacgggctcagaataagacaacgctttacccctgttactacacccatgagatgacacttgaagaacacaccacctaacggttgtggttccccgtgaattaccagcgagcttggaggtaccacgccttggagtaacttccccttgggtacaaacatcacaccacaagctttaacgtcgcctgaaagagaaagaccctttttatcttacccttaacttagagagcttaattggagaagggacaagactgtggggagacaagtaaaagtgatgcacaaacccgaaaattaagccccggggtgtttctgtcatcagaaccttcaaccgtggagagaaacaatcgcgagttgttggcccatgagagcagactgacatgctgtgaaacgtcggcacgtgccactattgtagagggcagattatagcaatcatgtcgttggcaaatcgtgcacgacggtgtgagcaacaactgtgtcagtgtttactaaacagacagaaagtgcggcaccgaggtgcatggaggaaacatggacgcatatacgacatccttcgacaccatggatgcacactcatgcatagtagcgctacgctgaacccctctcattgtcgccacgagagagcatcggcacggagtcatcaccgagccgacccatagagattctaaatgagaatcacatgtatacacc

SEQ ID NO: 715005 - DNA, 154 bp, Homo sapiens
aggctttgtgtcaggttcgtgacttcacacagccctaatggcactggtggcaagtccatctatgggagaaatttgaagattagaacttcatcctaatatgcatacggtcctggcatcttgtccattgcaaatgctgcacccaacacaaatggtt

SEQ ID NO: 715006 - DNA, 134 bp, Homo sapiens
ggaaccccccgggggggcccctctctttttgtggggggggtttcccccccccccctccccccccccttttttttttgggggggggggggggggggggggccgccttttttttttttccccctttttttttttta

SEQ ID NO: 715007 - DNA, 401 bp, Homo sapiens
  misc_feature (17)..(17): n is a, c, g, or t
  misc_feature (47)..(47): n is a, c, g, or t
  misc_feature (70)..(70): n is a, c, g, or t
attgttgaccggtctcnggtgtaagtttcctggttttgctcttactnggtggttgcttgcctttctttgnaaccaatagagagatgttttaccatcagatgggtagtgtccttgtcaacagtggctaatccctgtaatcccagcgctgtgggaggccaagtcgggcagatcacttgagttcaggagttcgagaccagccgggccaacagggtgaaacccagtctcctaactaaaatacaaaaattagccaggcatggtggcacatgcctgtggtcctggctactcaggaggctgaggcaggagaatcgcttgaacccaggaggcagaggctgcagtgggccgggatcatgccattgcactccagcctaggtgacagagtgagactctgtctcaaaaaaaaa

SEQ ID NO: 715008 - DNA, 474 bp, Homo sapiens
tccaatcacagtcctggtcacccctccgttcttccaccgttgatctttcttgctgcagatgttgacaggattcttggtgccggcttcctctccaggaagcgctcggggctctgcatcgagttggtgggaatgcagaccttgcccttcttgttttgttagcaaagaacattgtagtcccaacataattgtgggaagtgggctaggccacacgtcattccttttgaaaaagcccttttcacgcaaatatactacgcgcacgcacacacaatgtgtagaaaatctgcaagcaaaatgttgagccagattttttttttgccggccaaagtaatttatgatcttttgtctgaatttgtctattctacttgttaacatttgggccttttaaatgtattggcagtgtgtgcatacaaagctttttattctcatgacgatgatgtattctggaataaagcagatggttttgtgtatagcata

SEQ ID NO: 715009 - DNA, 1332 bp, Homo sapiens
ggggcagtagaagcactgcctgcagaccgtattggaacaagccaacagtgaaatcccttccctgcgacatatgcaaagacgttgtacaccgcagctggtgcatatgctgcacaggacaatgccaactgaggcaggcagcatccttgtttcacttggcagcaagcaacatgtgcactggcttccagaaaccgcaaccatgtctgcttcatgcaaggcagcatagtggcactcctaccatccctgtcacatccatggcacatccattcacaaggcagcacaatgcagccagtccgtgggagcaggatgtgctctcgctcatcaaccatctgcagagatctcatcccagcaagcaactagacagcagctgcaatcacaccagaagccagctggcagtccaaataagatcccagcagctggacaatgacatgcaggtggtggcccccattcatggaccaacacatcccatcatccatcctcatcacccgtcaggacggaccacaccagcacgccaagaccacccagacaaaacaggcatacatgggcgcaccagtttcgccagagactgccattcgagcatggtgcactgcacatccaagcacatgcatgtacgggacccaacactacccacacatatagatccaggagccccttgcgccaggacacacctgaccaaacggccggaagtcgtgcaaccggacatgagagacccctgcacaactggacccgaacgaatcatgcgacgaaagcctaatacccagacaaggcacaacgaggcacaatcgctaacaccagaagtgactgcatcgccacacttccagcgcaatcaagcaagaccaacagggacgaacaggggacgcaggccaggagaacagagacacgccgagcatgaaaaaacacatacacatcacaacaccacagaccccacagccgcaccacggcacacaaaaaaggacagcccagaccagagaacaagcagaaacaccatgaaagaacgcacaaggcccagcacaagacacggccctctcaacgacgcgaagaaggagacgagaacgcacgacacacaagagaaagccaccccgccgacgagtaacaccacaacactggaaacagaccagctgaccccatcgcccacacgggcaggaccagacgagaacgcagcaggcggacccacgaaccagcggggtgggcagccacagaggagacgggcacacagccagaggagacccccagcgagggctacagacgaccaactgagagcacaccacacaagcagacacagagacgaaacgaggaccaacagcaccccgacaaaacaaaacgaggagcgacacc

SEQ ID NO: 715010 - DNA, 465 bp, Homo sapiens
  misc_feature (422)..(422): n is a, c, g, or t
  misc_feature (427)..(427): n is a, c, g, or t
  misc_feature (452)..(452): n is a, c, g, or t
acagatcccacgtgggccctgttctctgtcattgccatctattctccaagaattctgtctcaatgagaagaaaaacagatcaacaggggagctgaggaatagatgggagctgcgagctgcagagggccaggactcggtgtgttccccacagcggccatctgcttggcttgtggagacgaccagctcggccacacttctgagattaggactccctgacgggccagcagaaggggctcttgtcaaatcccactttccctgattaaaccggaacaggaatgtctggcagagtagaaaatccagggaggagaggtgaggcctgcatcctgggagggaaggttgtcctgagatgttcctgccatttttgtccccaaaagcgggatgatactaggaggcgatggggggcaggatccatcctgaatgtnttccngagagtttttggaagattttgaccntcattgcaatagt

SEQ ID NO: 715011 - DNA, 927 bp, Homo sapiens
ggacatcttgctcaagtcaggaggccggagatcaggaaacggcaacaagcctcccagtactgacctgaaaacttgtgacaagaagaacaccaacaagtgctccctgggctgaggaccctttcttgcctccccaccccggaagctgaacctgagggagacaacggcagagggagtgagcaggggagaaatagccagaggggcttggcagggttcataggtagatggtcaaagcagcaatgcaggcagcaaaacggcagcaacacagggcaaacagccagcaacaggcacccaaaaaggcaaggagcagcaggaaagggcagaaaggggagcaggcaatggaattggagagaagtgaaaggaaggcaaggcaggtaggaaagcagcagggcaggcaggcacacgggacagggagcagatgcctcaggcttccagaaccttacctgggttgttcagggcaaacataaatgtaaatacactgatttattcttgtttactagatcaggttttaggggtcctgcaaaaggctagctcggcactacactaagggaatttgctcctgttctgtcactttgtcatggtctttccttgtggtattaaaggcaccattttgtaaaaaaaaaaaaaaaaaaacgaatataactagtccatatctcatgaactccatagctcgaccagaacacaacagctctcacgagacaacaacaaaaggggcgcgggaccataaatatacacggcgggggcacaatatgcgcgaacagatttgttaaagagacccacagaggagtagataaaaaagaagcggggcgggattaaaaagacgatgggggaaacatgagcggtttggaggacccctttgggggggtgaggcagacacaaacaattcgcgggaaaaccgaggatgtcacacacttgggaatgagctattaa

SEQ ID NO: 715012 - DNA, 109 bp, Homo sapiens
gcggccgcctactactactactgctcgaattcaagcttctaacgatgtacggggacatgacatcatactgtaataaaagcagcttgttttctgcttgaacaacaaaaaa

SEQ ID NO: 715013 - DNA, 179 bp, Homo sapiens
cgttaatacccaggggtctataggaccagctcccattaatcctcccctgtcctagtctgccttttctccctgtgtctacacaatgcgaggtctctttctagtttgccctccttcgtagccctattgttcagctttcccattccatagtccaaatgccctattttatacgtatacgattt

SEQ ID NO: 715014 - DNA, 762 bp, Homo sapiens
tggccaacggatgtcccttaagggcagcaggcttctcaaaaaaaagggaaaattaataattctatttagcaagttctacgattatcatgcatctctattctcctaatacttcagtggtgctactggtgccgataaagatgtacgcccaattggtggattattaccacaatctttattaacaccctggttggacaaagatcttggcaagacaatatctacacgcaagctttggccttagcgaacacacgggaactagttcccttaaaaggattacagcatattctggaacatttcctcaaccattgtgcattcccagaggggggggactactatacatggataggacgtgttgggccaaaggtgcttgaagcatttaggacacaacaaagaatagtttggaaagtgtgttacgtgtgggctcaaaaatcaccatttgtgctcctatagggaccacaggctataggtgcctcatttgcacattctccagtgccctgtgaacgttgttacaaacaccacgtggtggttacagggtttacctaagatacgtgagtgtgggccaacttttgtggaacactcccagtggtgtcaggcataggttaagtgtggtgccgtgatctccgatagaaggggggtataaacattcggggggaaactcccccatttccttgtatagttggcaccaatccctgtgggataaagggcaacacgtgctaatccataaagggcataatcaaactaagagaactggggaaccccccctgt

SEQ ID NO: 715015 - DNA, 102 bp, Homo sapiens
atgcagcctgacatcccgtttccccaggccaaatgtaggtttgaaagtaggtctgtgtcactgtgtattatgattacgtttggggtaagactacgtatggac

SEQ ID NO: 715016 - DNA, 156 bp, Homo sapiens
tgacgtctagaggatcccggaagccatcctctctgccggtgtgtgttatttcacaggaaaagaacaaaaggaataaattttctaagctctaaaaaaaaaaaagcccatcctctctagcaagcccagcatcccccattcgggcctcgagctcggtcg

SEQ ID NO: 715017 - DNA, 955 bp, Homo sapiens
  misc_feature (219)..(219): n is a, c, g, or t
  misc_feature (317)..(318): n is a, c, g, or t
  misc_feature (333)..(333): n is a, c, g, or t
  misc_feature (343)..(343): n is a, c, g, or t
  misc_feature (346)..(346): n is a, c, g, or t
  misc_feature (355)..(355): n is a, c, g, or t
  misc_feature (360)..(360): n is a, c, g, or t
  misc_feature (381)..(381): n is a, c, g, or t
  misc_feature (397)..(397): n is a, c, g, or t
  misc_feature (399)..(399): n is a, c, g, or t
  misc_feature (426)..(426): n is a, c, g, or t
  misc_feature (444)..(445): n is a, c, g, or t
  misc_feature (447)..(448): n is a, c, g, or t
  misc_feature (452)..(452): n is a, c, g, or t
  misc_feature (455)..(455): n is a, c, g, or t
  misc_feature (477)..(478): n is a, c, g, or t
  misc_feature (484)..(484): n is a, c, g, or t
  misc_feature (499)..(499): n is a, c, g, or t
  misc_feature (945)..(945): n is a, c, g, or t
gtgcgtacggcatctgacttgacgtggccacaactgaaaggtctggggagaaggcgccgtgtccgggtgtggagaggggcgtcgtggaagcgagaagagtggcccgtccctctcctccccctttccctctttcggaaagtggtttctgcggggaccgggagcctcggagtaccgaacctcgatctccggggcggggtccttggtggggactgagcgccncctcccggggacgggcggtctggccgcggagtcccctgcgggagcgtgattggctggaaacggtcccgaacccccagggagcccgatccctgggggannctggcttcggactcnagtatctgtngtngcagggtcnctgcnctagtggcctatgtcccttgntcggggccatggaganantgcggccagtaaggcggcgcctctgtntgaagaaggggaagtganntnnggantcnaggctctggcagtggaggatannggaggnccctctgcatcggcnggtaaggcgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcggatgggcagccctggatgcccccgccctccgaaatccagcggctctatgaactgctggctgcccacggtactctggagctgcaagccgagatcctgccccgccggcctcccacgccggaggccagagcgaagaggagagatccgatgaggagccggaggcaaagaagaggaagaggaaaaacacacatgccacggaatttgattttgatgatgagcagtgacacaaaggactcctgattgaccggagagcacccaggaactcagccggagcagaangggaggccgc

SEQ ID NO: 715018 - DNA, 214 bp, Homo sapiens
  misc_feature (1)..(1): n is a, c, g, or t
naaaacaagaacaacaacaactaaaaaaaaacacacaaaacagtgacttacttataattcacaatatttattagaccaagattttcactatttttacccctaataacaaggttctagtctccatttctctcctagttgaatgacttggggcaaatcttttcatatctagtggctgtttcctcctttgtaatgaagatatgtcagagttaatgag

SEQ ID NO: 715019 - DNA, 378 bp, Homo sapiens
  misc_feature (256)..(256): n is a, c, g, or t
cacatgcaaccaggtgcacgtagcaaatactaaaaaaaattttttaagtgtttttttttggttctgtttggtttggtttttggtgtttttagggccacacccatacatatagagattcccaggctaggggcctaatgggagctacggctgcgggcccacatcacagccacagcaacataggatccaagccacgtctgcgacctccaccacagctcacggcaacgcgggatccttaatccactgagcgaggccaggnatggaacccgaaacctcatggttcctagtcagattcgtttccgctgcgccacaaggggaactccccccaaattttaaatacgtaagtacaccttctagggagggcgcagtaatccggtacga

SEQ ID NO: 715020 - DNA, 1187 bp, Homo sapiens
gggccactgttctatactaccgacggacgctccgggcccgggcggctggcctcaccgcccactggggaagacatgtaaggaatttagcataagacagctatgcaaaatgtgagctggcggagctttcatatgtgcacagagatactcctgagaataaccctgatactccatttagatattcacaccagacacctctttagcaggatacgaggcacatctgtacaaaaactatccagcaaggccataaagcagcagctgttcttccagtcctggactttagcccaaaggcagaatgggtggttgcccatactctgactatgaccacaggttcgcccgcaacgtttctacaacgtaacctccaatcgagagtcatatgaacgtcagccaacctatcaaccactacaactggtacataaactctgacaaaggcccacgccctggcaacacgctctcaccactctccaagcgtacctcgcacgtaacttcacagcacctggccagtgcctgcagaaacagctactagacacgcgattacctggcagggccactctccacgacaacagaagctctgggaactacacacagagacggagagcagaactacgacacctgaacagaacctctctcacaacactctttaatcgcaaccgtggcaacctgtctcaagagggcccatgtggtgcacacgtcgcccaactgagtacaccaggagaccattgatcacctaccctcacgtcacggaactacatgacccacgcacaaccaagggacctatgaggacaccgaccacctacaattttgacatgagagaaacgaacagtccgtgccccggcgcactcccccaataccccgcaggtcgcccaacggaagctggaaccgctcagccaccccttgctaaacgcatccccatgacagagaaccacaaacctccgcatcggatcgcgacatccaccaaggcacacccgagacatatgcgccgatcaacagccgcgcccacacaacaaagccagcccacatgtctacaccgtgctacccatgaggacaacactaagggaccgatcccaaaccactactaaaaccatcacccgcaggccctcccaccgccgtacacacacacgctacgacacacagcagcgacctaatcacactatcacgcacccagacacagggacatgcaggcaacagag

SEQ ID NO: 715021 - DNA, 134 bp, Homo sapiens
tcacttttggcctccaaaagtgacaagattacaagcagaagcccccttgcctgcccagcccggtttactgttttttttttttgagatgggatttcgctcttgttgcccaggctacagtgcaatggcacgatccc

SEQ ID NO: 715022 - DNA, 185 bp, Homo sapiens
tagaggtgcacacgtaattacaatactaacttatacagacatctcatacagttgagacagatctagttctatgaatctgaggaggctactgcagtagacagtcccaccctcacacgattcttctacctttcacttcatcattgcccttcatctattgctagccctgagcagctactcctacctcc

SEQ ID NO: 715023 - DNA, 266 bp, Homo sapiens
actcagccttagcggagctgatcgcgcgctctgaggtcgagttacgggccggacactaccttctggactatcctgcccaggacctccgcagtcctggctccgtttgcggctttggacactttccgacgaagtcaacccgttggactcggcggtctctgtggaatcgccccgttcagattcttctttgcctcaacatgcagacatggtttcgccgctcatcatcagactggtggacataagctctgctcctttcaaatggaatcatt

SEQ ID NO: 715024 - DNA, 388 bp, Homo sapiens
cttcgttgccatgcacatcctcaacattgcaaggtttggcatggctgcgaccctgactggtaccatgagaggcatcattgctaacgcggagataaccctgaccgactccataggttatccaagcagacttctcactgaccaccttaccatgtgaccctgatcacttgcaggcactcactacactagcatctcctaccctaccagcagctccacttgctatcttaggtctccatccaccgtatactgagctctggttgtatgcataacccatcgttctagcgcaagctcaacccctatactatgaagactgcagagccacactgaaccacagcgggatgtgcggaccctcttccaggtagatcatgccacttcgtacccagtttgtagg

SEQ ID NO: 715025 - DNA, 414 bp, Homo sapiens
gcccttccctctttcttagaggctggaagcttttagtatttgtgcctttctgatgctttgttctcaccttggaagagaaaacacaagagtttcaaaagcaactttgatgtttccccagacgaaaggcccttttgggaagttcaggtggagttaaggccactgtttaaagcgtactgcctttgtgtgcctgaagcttgaatgacaaccatcaaccgattcgactgggcactctttttttttttgggtctccaactgggcacattcaaaagtagtttatttttttaaacaccacctcaaaattaccccccaattttttatttttaaattcagccccttaaaaggattttttttttaatgaaaaaaaccgttttgacccaaccaaaatacagaccctggcccattaaattgggggat

SEQ ID NO: 715026 - DNA, 108 bp, Homo sapiens
aacgagggggacgcccgttcaattcattgtacaatccgagacatcgatggtcatcttgtttgtcacattttcctagcgagctgttctgcccaccgcgaggtaatagac

SEQ ID NO: 715027 - DNA, 178 bp, Homo sapiens
cagggggctttcccttttaatgacgccgctgacatcattggcgtagaccacggactgtccattgatgctgattgggacgtcgttttccttgagaccaccagcttctgctggggtatcaggaattacttcaattatatacactccaaagaaatcactctggggggctgggactagcgtc

SEQ ID NO: 715028 - DNA, 160 bp, Homo sapiens
aaaaccttttgttttaactatactgctttgagatctcatttcagaggaacggcatgaacagtcttcagccacagttgtgatggttgttaatgctcacaattgtgcattctgggggttttccatccctggggttgcaagttgttcacttaacattctaaaa

SEQ ID NO: 715029 - DNA, 167 bp, Homo sapiens
tagagaagaacagaaaaagcagaagtcagtgagccatcggacgatcaactgatacaagcattacaatagactcctgtgacgataaacacaattgttcaaagctttccacagtgtccacagagtcagtgtcagggactagtccttgtgacatcctttcctgtatcaca

SEQ ID NO: 715030 - DNA, 4392 bp, Homo sapiens
tgagcgggactgggagcgactgggagggacggggaaaagtccggctggcgcctgagacaacaagcctggatccgggagctacggctgctggggtgctccggatttgcggggttcgtcgggcctgtggaagaagccccgccacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcgacctcactctggatggggtcaagtcctggctgaagccacggctgggacaggaagccacagttggcaaggccacaggcttcctcaagaactttctgatcgagcccttcgccccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgacgacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggtggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggcctgggcaccggccatccccaaccagccacccacagcggcccacactgcaaactttctcctcaacgcccagcgggagacatcgactccagcccccagcaggacagcatctttttatgagtccatggtcgatgaggtcagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctatcctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtacccccaggcagctgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttcccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggccctcggcctcctctggttccagaaaaggttgcctaagtactcttgccagttcattgagatgtgtctgatggtgacagctgatcacgggccagccgtctctggagcccacaacaccatcatttgtgcgcgcaccgcggtggagctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtcagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttttacttcccttgcttcttccttatataacatgaagaacattgtattaatctgatttttaaagactttttgtatgttacgtgttaagggcttgtttggtatcccactgaaatgttctgtgttgcagaccagagtctgtttatgtcagggggagggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaggaattcctgca

SEQ ID NO: 715031 - DNA, 1010 bp, Homo sapiens
tgggtgtgtgtgtctttatggtagaacaatttatttattccttgtggatatagtactcagtaatggggtgctgagttgaaatggtcgttcgaactctagttcttggagaaatcttataagagtgttctccatagtggctgagcgtaatttacgattcgccaccgaacagtatataagtgttcccgttttcatctagcagtctcgatcgaacacctgtattttctgttttttagcttatgaacgaaaagccattttgactgggtatgagatggtattatattgtgggttgacatttgcatttccctgatgattagtgatgatgagcatcttcttcatcgtagtttgctgggctcgataggtgtcttctttggagaagtatcgtgcatgtcctttgcccatttttaatggtgtcgtctttaggatagtagagattttaagagtactatagatatgtacttcttgtttattgtgggctttttcgaaatctacataaaaatagagtggtaatgaatgtgcatattctcacggcaacaattcaacaatctatagactcataagtaatctcatctaatccttctaaaagagttgggcacttgaaaaatccatagcttcagggttgttattattcatcaaacatttagcaatattccttaccattattagatcttcattaaggttcgtaattttcttaaatggtcctaatttttccttgagtaattggttcaaacaggttcaacgtccatatatgggttgatgggcttttaaaagtttctctaaatcgggggtcgccgggaattgaattgagattaaaatttttgtttttaataccacgtgtgatgttaaattatttgatttcagcttgaagggggggagatggcaatgtgtggcagggtggctgtgaacgtcggggtcaagggaaactttgtgttcaaacaccgagtatgggataaggggatgttcttaaccggctgttttaaaatttgcactggtgtgaaaaaggtgttgggtaa

SEQ ID NO: 715032 - DNA, 720 bp, Homo sapiens
actgctgctttcctaagttactcaaacgcactgcttacttgagtccttgttttcttttgccttgtaactactcttgtataactgtattactaacaacgacgcctccccataaatcagacgaggcaaaaacggtagcatactaaaacagaagacaccaacacagcacaacaacgcaacacacctgtgcattctctacacacagtagacgtgggggggtgctcccactataaacagagggccagcaggctgccgtgaacccaacagagagcagatcgtagttaatggcatagccaagcaaggcagcacgccaaacaacatgggcttcacacatattctaaaacatcacatgggcatgggagacaaagttaggatacaccttccacatggataggaagaaagcatctccaacttctaatcataaaatggagtttggcattaggtccaaattaaaccacacattatacaaaaaagcacacgcacctatatggcatagagtccacatggccagagggatttctaacaaagattttagttagtgaattatatgtgggaattagttggaaatgggacgacttcaattaccttcacatataaaattgaggcactatgagtttgaaggaatttaggtaaaataataaggtaggaacaaagtagattgattatggattaaggtattgacaaccaagtcaattccaaattggggtcattatggcttttaaa

SEQ ID NO: 715033 - DNA, 174 bp, Homo sapiens
gaaagaaattaggatagcttaagaaagtcgctattggactggacgggagaggcattaggcagaagcacctattactttgcaaggggcacttcagaaagtcgctgggactcagaaggctcttagtcgtgcttgagagtgagcctttcgaagagactaatttctctcggaccaatg

SEQ ID NO: 715034 - DNA, 130 bp, Homo sapiens
tcatgccacaccagaacgcaacacatgcacatactgcctgtctacacctgcactcacacctgtatacactgtctacacacccccacacctggaagaacccatggtgaaagtaaacatgctgatgtttgct

SEQ ID NO: 715035 - DNA, 248 bp, Homo sapiens
  misc_feature (116)..(116): n is a, c, g, or t
  misc_feature (245)..(245): n is a, c, g, or t
ggggtggggtggtatagatggggcagtggtgccagtgtagacaggaggacggtgcagacgaagggggacattgtggtgtacacgggtggattatgtagacggcgtggtggtatagnatggggtagttgtgtgctggtgtagacagtgaggatggtatatgacagaggagaggtgattggtgtagattgggtggattgttgtagaccagtggtggtggtatagatatgggcactggcggaggctangga

SEQ ID NO: 715036 - DNA, 264 bp, Homo sapiens
gctcggcccgttgacggaacattgaataggagcgcgaacatttaagttggtattacaggaacatgaggccatgattaagaggggggcagcaacatatgaagccctcatgagtgcagagcccgccacttgtccagagggccacgaatggaggatgtggaatcgagggcttgtcagaaaatggtggtttctttcctagtgtgaagggttctctatcaaacggagctaatgaacgatctaggggaggtttcgtgctatccggtcgaa

SEQ ID NO: 715037 - DNA, 710 bp, Homo sapiens
tcctctgtggtctgatgatgaacttcctgtgaggaaagtgacacagtaagcctgcattttacctttcctcacagcaagcctccctagatgactgaggagactggagcctgcgttgatgagatctgggaatcagggatctgcgacatgtggctaggtggagtgcagggtgtttgcagaatcagctgcgtcacatgtcaaggcgctcaacgcgtcccaggggccactaagctaagtatacccaccgcccatctcccctactgagttagcttgggagcatactaggcattgtcctcaccatgctctgcgcatgcaattttaagtattgaatatataagagacagaggtcatcacgtgtggttgcctcagggactggtgctacaaagctcgcgtgggacatcaacgacaggtgcgctaccatagcctacaggcatataccacaaaagatgatactacgcgacaatgaagcacaacgcactgctgctggaacaatgcaccagtatccgtggtcaatatttgttacgcagactgaactgaagagtagcacaatgaatatgtgagtgcaccaatcgagaacacgtccagcctgagaaatgccaccacaggttgaggagaacaaatccctattacagagggcacatgtataagaacaaaacctctcctacaaattaacagcaatgagaaatatgagggtaatgataagaagagaataa

SEQ ID NO: 715038 - DNA, 178 bp, Homo sapiens
tcggcggcccacatgccaccggagaagggtagaggaacacgcgaggtttgtcgaccggcaggtttttctgcacttcggccacctgtgcctgcatctgtgcaataagcgcattggcgcggtcctgcacgtcgaagatcttgcccaggttgcgcaggtccttctccgagtggcgtggtat

SEQ ID NO: 715039 - DNA, 1436 bp, Homo sapiens
  misc_feature (507)..(507): n is a, c, g, or t
gctttcaaggacccagaagtacggttttggtctatgtaacgggtcagagatgtggttcgagattctccccggactctccggtcactgggcgttgtggctattttagacttccaaggatctggctatctgtcgtacaatcctagcaaggttcaactaacagggggcaatggagacataaagggttagctcagtatgttgggtatcacgtggcatggtctgatggaatacgagcataggtcgcatctctgggagttgatcggttacgtatgtagtcagaagggtttgggagacacattgagttgaaggatagcagtgtaccgtgatttcgatggaacaaagaatagagttcaagttgatgagccagtcttagaccactgttatgcaaggtatacaggtggtatgaatagtaagctatgcgaagtggtgataagtggtacgtgcgttatataaagaagtcaaagatcgcacaagagaagagagaagaagacacaataagcttcagaaganggctccagggttgcaagagtcgcgtcgagaggcagataaccgcgtcgtgatcgagttaccagggagccacggtgaggccaataaccggggcgtgggccctgggagtcacccaaggactttggctgctccgtgggccagataagcgtgggaggtgcgcacaaagattggcggcccgagtgggaatccattcgccacagcattgaaacgtttgacacctgcgattggttcataagtttgtcacacatgactaagtaggaccccaacggggtggtggcatactcctgtgggagtatgttaaatgggagcaatgtcgccacgagagaagacattgcccaaatcccctggcaaatgttacaagtttacacaacaccacagagagttatcccaattgggttaaggccccaatggcggtgagcacggggtcttggaatctcttccaacataaaacagcaccaagaggaagacttggggggccacatcatttgggatggagcgtgggcacaaactggtatcccaaaattctcatcaattagggggaccaaagcaagacggcttccccgagactctggacatctggcaacaaacaacagctttttagaagttatccccttccacaaaaagcgaccagattaacacggggggaacgccacaaagcggtatcctctaacagttacattcgccccataggtgggcccaaacacatctcctatgggggacccccaagaaaatcaagcgccacaaacattgcgggctgctttcttctctccagcagctatgaaccatttatcacatttgggcagcacaattgttttctcaggcacccagatcggaaacaccatgagagcactttatctgtaggtcctttgggccagcaatttgggctcacaaatggacacctctgagctgagggctgtggtcagtcagggcga

SEQ ID NO: 715040 - DNA, 406 bp, Homo sapiens
aggtatacacataccctggcttcacgctcatggcttcacatatgcaaaacattatatccatccttattcatccaccattaacattcacaatctattcccgtctagatatatagatactattaaggaaccacacaggtcacgtcactcaggttaaatgataccatcataaggacacatacacttctgctccatataagtctgatcactgtagataatccaggtcacccagcctcccattaagatttaatcaaagtcttctgcaccccaaaccctcacaaaacagacctctatgatgaaatcacagaaagatacatattagtccagtaagtggccaaacataggtcttcagaagtccaaagacctctataaccagtaacagtagttgggagacacgcaggaataaaga

SEQ ID NO: 715041 - DNA, 584 bp, Homo sapiens
  misc_feature (129)..(129): n is a, c, g, or t
atacatgtcgaggctcatgttttgtaatccagcattagagggcaggtgggaggatccctaaggccaggattttgccagcagcctgggctgcatattaggagtgagaccttgtcctcaaggaataatgtnttgttttgttttgttttcctgaagaaaagactactgagagccagtaagactgaaataatggacatcttcatatcctgttagtttgagtgtgaatttgtacagttttcatacagagtggctctaggtataaaaacttttgagatgttaatagcttttgacctagtcattctactcttaaaagtatcttaaggaaataatctcaaatgtgagcagttttacgtgagggaggatattctttgtagcataatttatatgaagaattagaaacaccctaaggtccatcagctaggggaggacagcagaggggacggggaagcatcaggagggctcggcagccacagcaggggctgggccggcatctagcaggatccaggtctttgtgggacaaagaatcttagagaagcaacggggacaccaggctgtccactgcagcaccagtgagttcccaagacgaa

SEQ ID NO: 715042 - DNA, 1978 bp, Homo sapiens
  misc_feature (835)..(835): n is a, c, g, or t
  misc_feature (1346)..(1346): n is a, c, g, or t
tttgtctgttcatctcgctgttggtaatagtcgttgtctctctttattagtaggcgagttatgtcgccgcctcgtttttccacctgggtgttatttaaccagacatggtgttcatgtggggtagtctaaacacatacgtccatcgtttgggtgggatagtgatcacatctttttgagtggcggctatcatactatatgtttgggggtgggcaatgacaacaagatttctgtatgcgaccggtgtggtgcgtccgccctggtttcgtggattagggtacaccacgatggtgtggttcccatccattaggttcgccaacatcaacttgtgtgatggtgtgtcttctactactcatatgaccatcgtgtgttgccggttggtttgcgtcggtgtgttgtttcgtacaacggctgtgacggtggttggctggtgtggttgtctatactacccacttttgtttgagtgggtgagtggggagatgaaaacaataggtggggagtgtggtcgtgttgttgggaagcaagcacaacaatggttggtgagtttgttatgttggcgtcgtgtccgtcatgttttgtggtgcggtcttcgcgcctcgttcggctcgtgttggtgccccgaccggggtgggtttgctctgctgtggagtgtgttgattgttctcgtgttgggggcgcctccttctctgtgcgtgctagtttttcagtggtggctcgtggcgtccagacacgccccctgggtgggtgttttttatcttggcgtcggttgtactgcctcctttctctctttgattgtgggggatgtcgacgagaatcgatactgctgttgttttgagcnatacccactcctgagtgtgttgtgtttgttgatgtccctcactcccaccttgcggttattattcttgtggttggtgcgggcaacaacaaacaatagatgctcaccatctcttgtttggtgggttgttgcttctaccacaggagcatagttattgtttttcaacactagcggaagggttgttcgatcaacatatgggggacatcggctggtaggtggagtagtttgtttttctccgttcgtgtggatgtgggacctcccccccctagctggatggagcttcttttgatgatatgtaggccgcccccaccaactggttggttcgtcggagcgcagcacggagaattattatctctcgcgcagatgattgtttattgtgggccccatcagcgctctactactgcggtggtgtcgactagtacaacaagtgtgtacgccgccggggcttggtctcgtcttgttgtaagagaggagtggttcttgtagagcgcctagcggcggagattagatgatnttgcgcgcgtgctagaggcgcccacaccgcgaggtgtccccacacattttttgtcgcacgcttgtgagagccttatgttagggggatgacacacacgcacagctgggccacgactgtcgcacacactctctgggtgcacacacacagagaggtgagatatactctctctgtgtctgttctgttatagaaatattttatgaaataattttttttgcccactcgcaactttgtgtgtgggtcttcacacgaccgctcgtatatatctctctaggaccctctcttgagatgggctctataggtctggggcacagagttcacactctgagaggttctgcggagagtgttcgagagagacacacaccctcgagaccacacacactcggagagagaaaccaccactatctgttagcttatataataacaccaatattagactgggtgttgtgtgtggcgccctagcttgtgatatatccccgacttaacttcgaggagaggctgagagccacagaagaaattccgcttgttaaccccgacgagggcgctaggttgccacctgtgaactgatgattgcccccattgcactcccgcctgggcctaccccccgtgtgtgactcccgtttccacaaaatata

SEQ ID NO: 715043 - DNA, 216 bp, Homo sapiens
ggccagatccatataaacacatacaaaaagtagtcatgcttgtgctgtcacttcttaccacccttcttattgtctatttttccatagtataacatctagcttgttcccccggcgcccaccagcccatgaccacattgtcgacaagacagcctgagtgacctacatttctaatttgattggattttatacttctatcttttcatctttcttgtgatc

SEQ ID NO: 715044 - DNA, 161 bp, Homo sapiens
  misc_feature (122)..(122): n is a, c, g, or t
aattcggcatgagggagatgccccatggtgggcaggcagatgatgaagtactggcagatttgcaggctgggaaggctagacttcctcagccccgaagggtgccccttccaaaactctatcgnctgatgcaagcgtgctgggcccttaagcccaaagaacgg

SEQ ID NO: 715045 - DNA, 193 bp, Homo sapiens
tcacaacagtgccgggtatgaacaacagtgcaggtatgaacaacagtgcaggtataacaacggtgcaagatatgaacaactagtgcaggtataaacaacagtgcaagtatgaacaacagtgcaggtatgaacaacagtgcaggtataaacaacagtgcaagtatgaacaacagtgcaagtatgaacaacagtg

SEQ ID NO: 715046 - DNA, 127 bp, Homo sapiens
tctgaacacggggtggtatttgtcgaagttgatccggtgtgtgatgcagaccaccagcattaccgcggccgccgtgggatgcttccggtgcttgtcctatgcggcctgtggccgtggctcacgtggc

SEQ ID NO: 715047 - DNA, 455 bp, Homo sapiens
agaaactgatgcgttatctgtatatgtaatttaactagggatatttttccattttaaaacattgcattttaggtaatacgaaagtgagcttttgtattttgtctgtataattcaatagcaatgattttagtgaacataatctggcagggtattctttgattgtcttaatatcttccatccaatttaccagcaaattctatcatttcaaactcaaaatagatcttaaagcagttggctactcttcatttccactgaagtcctcccagccacagtcaccatcctgacctacctgtgctgcagtgccttccttaattgtctttctgtatttaccctagcttcccttcaaaactgtctccaaaaaagaggcttatctttgttttccttccttccttccttccttcctccctccttccttccttcctttttctttctttcttctctttcatttcttcttt

SEQ ID NO: 715048 - DNA, 562 bp, Homo sapiens
aggaaaaagattgtctcccgctctggtgaaaaaaggggaaaagggccccaattttttgaagtgtggtggggcggccccctgtttaaatgggtcccggccaggccactgtgtggtgggagcctctccaaccatccccccttggggggcttttctgtttgttatattaaaccaaccatttcggggggggtcctccaaaccatgggccaaaagggttctgggggtgggcagggcccccagtttgcccccaaaggcccgaagggttaattaattttttcccctaaacccgccccccccctttttaaccggggggggagaacgggttccaaaccgtttgtttccattggcccctttaggtttggggggaaaaaccgggttttttatacccaggcctcggtaaaccccccaaagggaaggggaatgttttttgggcccccttgggttttttttttggggggggccggttttaggtttttggtttttaaaaccgggcctttttatggggacccccttgcccaaaatttgtccccggatttttgggcccccttaaaaagtttaattggga

SEQ ID NO: 715049 - DNA, 1410 bp, Homo sapiens
agcgggtgttcctggaatggctggtttgaagtgcggtgccggggtggggtgtgaggctcagcagagcccggtggcaacatgagcctgaggggctgccagtgcgcgaagggtgggttcacgtgaggaagctgggggtacgctgggcagttttaagagcacccagtcagtggaaacctgagggctgggcttccttggctatgcctcgctgagcttcttcattggtctctgctggctgaccttgagtgttgcctaagaaatggggtacccgggacctacctgagggaagaggtccccaagtaacctggatggaggcgaaccaactgtgaatatttggcagatcttgactgagtgtggaaaaaagcccaagaggtcgactaaacccgtatatacgatcagcgtaaacttatgcggcttacacactatcaccaagggaagccccctggccgaagtgcagcagtctgtaggacacttgtggggcaaacccattatgggacagggtggacttgaagaaaaggtgaattgcactcactatggcgaaaagattgcattgacaacacgtccatccgtgcaacataattagaatgtccggaaattggtcaaggcgcctaaacgaattggcaaagagtacaccaagcaaaatgtggaaggggatatgacatcaattgacaagacgaacagcatatctaatacaaggtttaacgcagcgaagacgcgcgagacagaacagggaatggcctcgacggaaacgagcaaacgaaggcacttattagggcacaactagggttacgccaaaacaaaggcgcacccacctggcaaaacatggccatgaaacaacacattgaaacccgagaaaactggacagcagaagatgatcgtggccgcgaaaagagaccttagaccacaagtaaaacgcatgtcaccatagagcacagagcacagaaacgcacgtacgcgagtcagacgacaagccgacaagaagaaacaagcccacagagcaagacactaaccacaaacacgaacgggggcatcgaaggaacaacgaacgagagaagaccagtagacagcagcggacacagaaatttgaccagcatgtaaatataacgaacaaacgtaggggtcacaacaacaggtgaacaatgaccaacaaagacggagcaacacgaaaacctagacagaacaactacaaatagagacaacaaaaacaaactaaagaaaggcacagaagaatgaataggaaaacaccaaagcaagaataccaaaagaaacaatgaataaaaaagagaaaaaaaaaaataaaaaaaacacaagaacagacaaaagcagaaactaaccagcaagaaaatagacaaaacgaaaaaaaaagaaaaggaagagaagaggtaaaaaataagaaaaaagaaaagtgaagag

SEQ ID NO: 715050 - DNA, 122 bp, Homo sapiens
tttttaaacccctttttaaaaaaaagggttagggttaacgggggcttaaaaaagatttttttttttacccatttccccctccccgggcgggatgtttggaattggtcataaaacatttccca

SEQ ID NO: 715051 - DNA, 284 bp, Homo sapiens
gctcttgtgagactccccaccgtttgatcttcgtcacctagtcaaatcttcattcgcatcatcgccgcccagcttctacccttgagtgcatagccctcaggactgaacgcactcatgtacaaagacctgaagttccccgttctgatcgtgcaccgcgacatcaaggccgacactgtcgccggtgcagtatttaaagcgcttgcgggttgttgaaggcgcagcagttgctgctggtggaaggcttgggcgtggcgcaggcggcgcacaacgtgggcacggagagc

SEQ ID NO: 715052 - DNA, 279 bp, Homo sapiens
tggactctgagctggcgatgaggtgtgctccggtggaagcaagggagcccagcacggagccatggccaagtacagtggtagcagttaggactgacacattgctgctgacaggatactcgcagcgccgtctacgtctctcgcacagcccatgaagcatataggagcctcaagtaacaacaacgtttttcaaagcctaccaaacatctgcccttcagtggtgccctaataatagcaggtgggtttgaatcccaaaatgacaacaacgggacagcagcctat

SEQ ID NO: 715053 - DNA, 831 bp, Homo sapiens
ggatcctgggacctggaaggcctttagtctttcaggtgcgatggggtgctacatgggaaagaaaagcaagcggtagctgaagacttcttcagaggatgaggaggagtatgtggtggtgaaggtgctcgacaggcgcgtgactgagggacaagtggcatatctactgaagtggagagggcttttctgaggagcacaatacttgggaacctgagaaaaacttggattgccctgagctaatttctgaattgtatgaaagaagtataagatcgatgaaggagggtgagaataataaagcccagggagaagtcagaaagtaacaagaggaaatccaatgtgctcaaacagtgccgatgacatcaaatctaaataacaaagagagagcagagcaatgatatcgctcggggcgtttgagagaggcactggaagccagaaaagatcattggggcaaccagattcctgtggttgattgtaaggatcctaaggtgacaagttggaagagacacaagatgaagctgacctggtttcttgcaaaatagaagctaatgtgaaatgtccacaaattgtgatagcgctgttatgaagagagactgagcatggaattgcatatcctgaggatgcggaataacatgagagagagagaaacagcaaagagcttaacgggaggggatggcctctgtcatgactctttggatcgttaatagattcacctgcctgctccgtctcttttttagccacccttttcagtctaaacacatcctttaccaatgtgcttttccatgtgcccacaatgagaaagaagctgaaaaaaacagagggggcggcaaaaaatct

SEQ ID NO: 715054 - DNA, 298 bp, Homo sapiens
ttttatggggaaaaaaaaaaaggaaaataaggtttggagagctttcccaaggagtttccccccctttttgtttgttgataagcaaatttttgatttccccttttccaaaagtaaaagaccccagcagggccttttgtttgcccccccggaaaagaaacttccaaaaaaaaggggatttgaaagggagagttcatgacaacaacccgttttccctttcatttggattttatccccgggacccccacttggggggttgttttgtttttccaagaaaaaaaaaaacggggggtttttttca

SEQ ID NO: 715055 - DNA, 393 bp, Homo sapiens
ggctcactgcagcagcctcagcctcctgagtagctgggactataggtatgggccaccacgcctggctaatttgttttttttttttgacggatggggtctaggcatgtagtccaggctggtctcaaaatcctgggtaacatagtgagacccctgtctctacaaaaaatgtaaaaattagctaggcatggtggtacacacctgtggtcccagctacttgggaagctgaggtggaaggattgctttagagcccaggaggtcaaggcagcagtgagctgtgttcatgccactgcactccagcctgggcaacagagtgacatcctgtctcaaaaacaaaaacaaaaacaaaattgttcagcaacttttttggccaaagcagaaatttaaaaaataacc

SEQ ID NO: 715056 - DNA, 584 bp, Homo sapiens
  misc_feature (1)..(1): n is a, c, g, or t
ngccgggcacgggattgccgccgcggcgacagcatgagtgatcagcagctggactgtgccttggacctaatgaggcgcctgcctccccagcaaatcgagaaaaacctcagcgacctgatcgacctggtccccagtctatgtgaggatctcctgtcttacagttgaccagaccactgaaaattgccagagacaaggtggtgtggaaaggattacctttatgtgtgactacaacagagatggggactcctatagtgtcaccatggagtaacaagtatgaccctaccctatggaggatggggccatgccgtcatgactcggctgagaaagctggaggtgtgacgccaacaatagcctttgaacagctatcgagacctgtatatatgaagagtggacgtctcatctgtctaacctctgggatactggaatcatgggtaaagcttggagtgatcctcattacaagaaggctgtgtagatggatcaaagaagatcaaagtgcttgcttgggataccataccacgtggtaaaaagtgcaggagaaatccacgcggacgcagcgcacacatacaagttgaactcccacggtg

SEQ ID NO: 715057 - DNA, 609 bp, Homo sapiens
tgtcacaagtagtacgtacagttgctcggagtcatgattgtgttgactttgaggctttatgcgagtgtttctcaggttcatcgcattgacatctttgtctacaggtaagtgtctctcaatgttcaagtacatgacatcctcttaggtgcactggtcagtcatgtacactgtcacagcgttgtcttgctcgtagattgtcacgtcagcatctttcatatcgtattagtctcactttgtgaagagcatgtcttacgcgctgctgtgccgtaaggtatcggtcataatcagaatgtcatacgtggggctttggcagtcatatcatgcctgttcatagtttaaggatggttaccctgctccacacaggtgatcaggtttggtttatagacgacaatagcgaggaagatcaagtttatgtagttctctagcatcacatcagtatatagatgcgtctgtgcagcgtccaggcaatgcagctactgcagagatgattcaatggccgcatctgtgtgttgccatggttgcttatctaggcgtccagggggtgctggtgtagtagctgtgtccctcataataccggcaggtcacaggaacacacaggctgggcctcgg

SEQ ID NO: 715058 - DNA, 449 bp, Homo sapiens
taaaggaaagtgggggccttccattccctccagaaaatactggttttttttccaccgttgaggcaaatgcgggggggttgatcacctggcaaactttttaggaaacaggaccaccggtctggaaaactgttggcctggcctaacacctggccctgtggtgcaggcaagtgagtggtgacacagtgctggttgggggggggcattttccttcctggcctaaggggcccatctgttcaatgggagtgggacttggtctccaaagttttctactatgaaacttgattttgggagggaaaccttgggggggaggtaaagggccctgacatgaaaaaggtgggtggaacactcggttgtaaggggtttggtagtggggcgctccaggtctttgcagccactctttttttggcagccccaacgcccccaaggcgtttgatttctggttccaccca

SEQ ID NO: 715059 - DNA, 891 bp, Homo sapiens
  misc_feature (8)..(8): n is a, c, g, or t
  misc_feature (106)..(106): n is a, c, g, or t
  misc_feature (145)..(145): n is a, c, g, or t
  misc_feature (151)..(151): n is a, c, g, or t
  misc_feature (212)..(212): n is a, c, g, or t
  misc_feature (215)..(215): n is a, c, g, or t
  misc_feature (226)..(226): n is a, c, g, or t
  misc_feature (257)..(257): n is a, c, g, or t
  misc_feature (265)..(265): n is a, c, g, or t
  misc_feature (404)..(404): n is a, c, g, or t
  misc_feature (408)..(408): n is a, c, g, or t
  misc_feature (410)..(410): n is a, c, g, or t
  misc_feature (510)..(510): n is a, c, g, or t
  misc_feature (512)..(512): n is a, c, g, or t
  misc_feature (538)..(538): n is a, c, g, or t
  misc_feature (562)..(562): n is a, c, g, or t
  misc_feature (671)..(671): n is a, c, g, or t
  misc_feature (762)..(762): n is a, c, g, or t
  misc_feature (765)..(765): n is a, c, g, or t
  misc_feature (785)..(785): n is a, c, g, or t
  misc_feature (880)..(880): n is a, c, g, or t
cggggccncagtctccagtcccgcccaggcgccttttcaggctgcggtgggatttcgttttgcctccggttggggctgctgtttctcttcgccgacgtagactctngaacccctgtggtcttctcttcatctaattaccctgagnggatgnagttttcaagtccttccatagaggaatgtcccaagcctttgagtagggtaagcatcatggntgncagcctcacangattgcttctacttcaggcagtgtcgtgggnatcaggtncccgcccctgcatccctataaatcttctggctacagctcggtggtgtttgtctgcaattccacatactgttactcctttgaccccccgacctttcctgcccttggtaccttcagccgctatgagattacacgcattggncgangnatggagctgattattgggcccatccaggctaatcacacgggtcacaggcctgctactgactcctgtcagctcagatacagatagttctagaaatttgaantngatttgggagggggccatgtacatantgctgctgtctctcacacatcctntgccctggtcaccccctggcccaaaatttgtctactttaaatcgctacttcctctgtaagaaggtaatcggtatataacatcatccgggctacccatggcccagctgtngacttctccatccgcacctacacctatgcagacacccctgatgatttccagttgcacaacttcagcctcccagaggaagataccaagcttnagntacccctgattcaccgagcnctgcagttggcccagcgtcccgtttcactccttgccagcccttggacatcacccactttggctcaagaccaatggagcggtgaatgggaaggggntactcaaggga

SEQ ID NO: 715060 - DNA, 254 bp, Homo sapiens
gctcacacgcgaatcctgtctggatactcatggagctgtgcccacttggcgcagctgaggtcattttagcaagtacggacatccagtttggatctcgcatctttgatacctgtatgcctatcagcttagtacagctcttgcatctctagagagcaaaagatttgtacacagggacattgctgctcggaatgttctggtgtcctcaaatgattgtgtaaaatataggagactttggattatcccgatatatggta

SEQ ID NO: 715061 - DNA, 140 bp, Homo sapiens
  misc_feature (127)..(127): n is a, c, g, or t
agagttcatagctgtgctgacatacacagagatttaaaatactcctccttgtaccatgtgacaggcctgaatttcgagaaaaggatttattcttattctggttctccatttctagtcttaacaaatnggcctctgacaac

SEQ ID NO: 715062 - DNA, 136 bp, Homo sapiens
ggtttagactcacactctcatcggcaggtggtagaagggggtctctcatcggtaatggtaatctcagctctcctaatcccatcacttccccagcccagagaagacattccaccccattcttggtccagtagctgta

SEQ ID NO: 715063 - DNA, 560 bp, Homo sapiens
  misc_feature (24)..(24): n is a, c, g, or t
  misc_feature (41)..(41): n is a, c, g, or t
  misc_feature (70)..(70): n is a, c, g, or t
  misc_feature (72)..(72): n is a, c, g, or t
  misc_feature (74)..(75): n is a, c, g, or t
  misc_feature (80)..(80): n is a, c, g, or t
  misc_feature (85)..(85): n is a, c, g, or t
  misc_feature (92)..(92): n is a, c, g, or t
  misc_feature (108)..(108): n is a, c, g, or t
  misc_feature (114)..(114): n is a, c, g, or t
  misc_feature (178)..(178): n is a, c, g, or t
tttttcctagcttacattcaccanatcgcactggctcctgnactcttttcctatcttcaccacgaactgntncnngctcncttgntcctcantcctagcttcatctanatactngaacctggaatcctgtctgctgctgtcttcctagattcactgaatccacttctgtgtagcaccngggtcagctgtcaattaatgctagtcctcaggatttaaaaaataatcttaactcaaagtccaatgcaaaaacattaagttggtaattactcttgatcttgaattacttccgttacgaaagtccttcacatttttcaaactaagctactatatttaaggccttccaaattcttctaactcttccaaaagccttctgccttagttctgtttaaattacaccagtccttttagtagctttttgatgtgatttgtaaccaacttccccttctagcttcaagtattcttctaaattggttctggtctacgtaaacaccctcatcttctcaagctttaccttctaacttctgcaccaccagaaattaaattgatgggctattaaaata

SEQ ID NO: 715064 - DNA, 110 bp, Homo sapiens
gtagtcggtcacacttctacacgtgacattagctacttgaagaggctatttggtaccttcctgtggttggcccaagccgaaaaaggcggtacccccatttcccccccccc

SEQ ID NO: 715065 - DNA, 442 bp, Homo sapiens
cacgagggtggtgactgaagcgggcacaccgacgtcgacgactcagacactcaaggcatggctcgcgggcttgccagacttcgagctgtcgggacacgaaagtttttccatcccacaatggcgatggactggcggagcggccaaaatcagcgcggcgatgatgcaggcattgcggaacccgatcacgattgaggtaccgaagtccgatgtcgctaaccttgatacggcgaacaagaccctttcgtttaccactgctccgatcgaggaatttttcaacaggtccccaaagatctgcgatgacaacggttgtcaagcttgggaggaggttctgaagcgggccctcaccacgaactcgacacagcattacgaggctatcgaagatacgggcgcgagctacaagataacgttctggcccgactacgaccctgctcgccatatccgg

SEQ ID NO: 715066 - DNA, 881 bp, Homo sapiens
ctctctcagacaccaagcatgcagatccaggcttttctgggaaagtgaggccaccatggctctggcgaagtcatcatatgtaccggctccattcatgcttgatcctgaatacctgctgtgtgcatgggctgaggatccatgcacttcccctgggcaatggaatccacggagacacaaagaaatatccaagcgtgcaagcatcatggactcagcaccagttcccccaagacagccagactcccaccctcactagtcaacccacaatgcattgcaggcgcctggacatcttgcaccaccagggcgctgcgtcggccaaaacccatgctgacacacacatacagggcgcaacagacgcgcccacatggctacgacatgtcccagcaatggtacagataaccccaaagcgcaacacccgggtcaacacgtgacaacgacaaccggggacaagaggacaaaaatgccacacaaaagcaggcaaaacatcccacagcaatgggcaaccatacaaccaggcacatgggacccgcgcctggcacacacacaccgcgccaacacaagagataaacccccacacaacacggtagcacatacacatggacaaccgcagcacccacgacacgagaacgcagcaccacacaaacccaactacgggacgagggcaccatacgggagaacaacgtgggcacaggccccacaactacacacggcacgacaccacagaacacaacaacctaacataggaaaaagacatgtacacacggacagacgacacggggaacgaacataacaactagaaacagcgcgccccaaagacacgaaaaaagacagcgaacagacaacaaacaccacccaccacacgactgacaccactaacacaaccc

SEQ ID NO: 715067 - DNA, 130 bp, Homo sapiens
acccactcggtgcgttctacgagtacaattaggacattagctacacacaagtagtaaaaacccttcctactcagatcgtccttcaatgcctgtgtgtttaagaattgtggagctttcgcttaacgttaat

SEQ ID NO: 715068 - DNA, 517 bp, Homo sapiens
actgcgcttcaacctgggcaacagagcaagactccctttaaaaaaaaataaaaaaaatattggcaggccgaggcaggcggatcacgagttcaagagatcgagaacatcctggccaacatggtgaaaccctgtctctattaaaaatacaaaaattagctggtcatggtggtgggtgcctgtagtcccagctacgcgggaggctgaggcaggagaagtgcttgaacccgcgaggcggaggttgcagagagctgagatcgctccactgcattctagcctggcgacagagcaagaatccatctcaaaaataagtaaataaacaaataattggatgtggtggtgtgcgcctgtagtcccagctaccgaggaggctaggatgggaggatcatttgaagtcaggagtcttcagactgcagggaagtatgatcttgcccctgcactccagcctggacaacagaacaagacactatcttcttaaaaaaaaaaattaactaatacagatcccaccataacaatcatt

SEQ ID NO: 715069 - DNA, 162 bp, Homo sapiens
ggtaaaataaccccttattagagagacagtgttatatgtctttacaaaattatatagggtccattgggattgtcttgatttggtcattttcccaccctagtacttggattggatagtcctccatgccatgcctagcaatagctctataatgccaccagggga

SEQ ID NO: 715070 - DNA, 119 bp, Homo sapiens
ctatgcctcacagatattctaactttaattttatttgtaggagacagggtctggttctggtcacccaggcgggaaggcgagggggcgtgatcccggctcatggcaacctccgtctccca

SEQ ID NO: 715071 - DNA, 149 bp, Homo sapiens
ccggcatgccgagtcagggagaatcatctgaggccatggagttatcagacctagctctgtgctaccatgttagaactgttcttctactcttcatattttaaaactaaagctgggtgtggtaagcatgtgcctattgctcccagctatta

SEQ ID NO: 715072 - DNA, 538 bp, Homo sapiens
gtattggagcttagtgagttcaatgctgtgcagcttcataaaggaccatgactggtgctgttcgtacatgatgaggaggaaggagagctggatccggccatagagctcatccagccaatcgcagaatagatcatggctaaatacaaagccaaggaggaggagacgccactgctcttttttgtagctggagaggatgatatgagcgattccatgcgggactacactaacctgcctgaggctgcacctctcctcacattctggaacatgttggctcgcgccaaatacgttaaagatgttgaagagatcacaccggctgtggtagaacagtttgttagtgactttctagcagaaaagctcaagccagagcccatctgaagtcctggactgcactaaaccctcccacagccgttacccgaacctccatctggcccttggcctccaggcgtgcactctcttctcttcctgtcagactgtttgaacagaagcatactttgtattgacatttcacttctttttaaacgtgcccctccatcacaaa

SEQ ID NO: 715073 - DNA, 129 bp, Homo sapiens
gtgtgaagcagcctcctcggcagcctgcagacagtgagctgccacaggagaagaggcacatgaagaagatggcacttggcaaaaggcatgggggtcaaatcaccttccaggcccacggcaaaaggtgtg

SEQ ID NO: 715074 - DNA, 114 bp, Homo sapiens
agacccactgtacgttcggctccatcaaatccaaggcaaggctccaggttctgaagtgctgctgccgcagggggttctcacagctgtcacttctgtatgtgaagcgaagctatt

SEQ ID NO: 715075 - DNA, 343 bp, Homo sapiens
tgcgatgacacgagatctagcagtgaaagtgccatactgtgcactcatgtgtaggagggtggaggtgagagtctgttctgtacagctttctgtagtgtgtcagaaagagtcacaagcccaagaattagtctaaactgtgtcgtccagagcaggtgaccttagcagatacatagaaatagccctcaaacgacctggctgtgtggatgatgaaaagtacagcaggaaggaggatgtcttagtgaacgcatcatcctgtgagataaagtactttacatacagcccgtttgtttggccaggcaaactctatggagacgcagactacttggaatagctgctgtagttg

SEQ ID NO: 715076 - DNA, 1080 bp, Homo sapiens
aataaacaaacatcctttgggaggtaaatcaaacctctctgttttattatcacacactgtcaccactctgccgcacaccaatctctcaaacaaaaaagtggggttccccacactatcatttgttctttgatactgaccctccccacacccttcattatcattctttgttttttttacccgcgcgctttttttctttagaaaaagaaaacatgactatgcccgtgtgctactacgcatgttttgtcccacgcgcaaaacatactaccacacagagatataagagagagatatatgtgggcgagatatcactcatatcacccctcagattaggatataaaatagatgggcccccccaacagtgcacgacacccacacgtgtgtgttgtatatgcgcctttccccctccctccatctctctctcccactctttaattattttctcctctataaagacacacacccgagaataaattcactccggccgcaataataacactcccccacaccaccccctcctctctgccacacacacacttgagcgccacacacacactgtgtgtgtcatcacagagactctttatacacacacccggggtgtctcctctcgataaagagaaggcggcacacaaatacccactctctgtccccacacatagttgtgcgtgttgtgcgctctctcacacaggtggatagacaacacacacttctctctctctccacaggggcttttcatatcccctcacccacctcgtttatattagactctctccccaccctagagaaaacactccagggcgagataggcacacaactcccacatttgtgttttccaccacacgatgtttttgtcacacgtgtgtctctcctgcgcctctttatagaaaaaatatcccttctttggagaaaatttgttaaaccgcaaatttcttgaagcagtgtgtggtcaagaagagaaagttagtaaaaaatgtatggtgggctcctaataaacattttttaaaaaaaaactgtgggaaaaaatccccccttttttcaaaaaactttttgttacaatacccccccataaaaatatatacaata

SEQ ID NO: 715077 - DNA, 354 bp, Homo sapiens
ttttaaaaaaaaaggggaaaaaaatgatttgccgttttttgtaatgtccgataccccccataaaatatattgggctgttaaactcttgaatccccgtggaaatttccctttgaagaccacctcccttttaagggttttccgccaaaaaaattccgtagattttctttaaaagaaaaccgttaaaaaagcccccccctatggccctggatatattggaaacctgttttttctgttttatgctcttggggaatctacctgacctcctttttctcttggaaaagtggggggaaaaccagtatttttttaaaaaccttgtaaataaagttttggggctaaaatgccccttccctttta

SEQ ID NO: 715078 - DNA, 842 bp, Homo sapiens
tgaaaaagccagctgactttatgtgctctgtggcggcagggggctcaggagctcttggttggggcgggtccgtttcctcttcaccatcacaggcttctaggctggcgcaagagatggcagctaggccctagcgagataggactagccaatagcagcaaggtcagagaggcaggaactatggtactatagcagagactcaggtagtctagatagctagctagagctgtaggccgcagacgcaattctatagtcagatggtgtggctccagccacatatatagagatgagcttgtgcactaggctatctcctcgctatagcgctctgagaaatcctccagcgatataaaatagacccaacctaacgagaaacccctttttagcccagatcaagagaatcgcacaagtgctctcccaaacagcccacaacagagtctattagacagagatagacatatcaaaagtcccatgtaaagataacgcgaggagaaatagagacattttgcggcggcgcgcccttatcaaaaggtataactagcggggaggcctcccaaggggtgcgaaaggataagagatccatcggctataattctcccctcatcattttagaattccagagagaacacaatcttgagaggaacgccaatagtttccaccccagacaaaacaagaacgccaatcacccatattgtgagggaaaagattttggcgcggccaaaagaacatatttgagggccgagaggagagtggcctccccatctcacacgagaacaatgttgggggcaaggaacctctttattgtggggaaatccccacagaatgaggtgttttttgagcaccccaaa

SEQ ID NO: 715079 - DNA, 289 bp, Homo sapiens
ccgttaggcagatcgccctgtaatgtgattatcaaagatcgtaattatcacaaaaacgttagatctgcatagccatagatgcaatacactaggctaatatgggaagaagacatattagatccaaagagcataagttatcctgataacagaaatgatagacatacgttggacaatactacataggtcacacttggcagacacaacaagagaacataataagctggtatcatcaaacatctaatgataacagcagcagcacaataacggcaacacgcacaaacactactgg

SEQ ID NO: 715080 - DNA, 114 bp, Homo sapiens
tccgtttgcgacgactgcttgcgcacagaacaggaagatgcgtgctgtcgccaagagcaaactggggagctcaacaaggagatggcagcagaaaaggccaaagcagtcgtcgaa

SEQ ID NO: 715081 - DNA, 461 bp, Homo sapiens
ttacgagagcaacaagaagactcctcaggcgtgtgctggatgtcctagagtgctacgactccaacacagtgaagcagaaatgtctgagctttactcctcctgagaaagatggcttcccttctggaacagcagcactgaaggcccagggaccagaagcgcccgcagtactgagcagaggaggaggatgatgatgaagagactgctcctccgcgttatggccccgcgaccggatcatacgaactcagtttacacacggtcatgtaagttaaacacctgttcctggcaccagttggtgattcacatgtagatggtgctgccaagtcttccgacaaacagaaaaagaagactaagatgacagatgaagagattatggagaaacttaagaactatcgtgagcataggtgacccatagaaaaaatatacaagatatgaaaaaattggacaaggggcttctggtacag

SEQ ID NO: 715082 - DNA, 1143 bp, Homo sapiens
tctgccggatgcgacaatactacttcgtgtttcaatatcgcgtagtttgctcgggtgtagtgtgctgctgtctacctcgagtgaccgtccgctagctttgttgtgtctctgtgctctcttcgtacctcgttcgtctccggaaaatgtctctgtgttctcctttctttctgtgtgcacccccgctgttgtggttgcccccagtttttcttggggacaccaacatggggccgccacagcgatgcgccagtccccatgccttctccccgagagcctttgtccttatatggccaacaccccctagtgcccgaagccccattccggggcccccttggtacacacctcccgctttggggaactgtctcctcaatccggggattggccttgtgttccccaggggccctccctggagattcaggacaagtttcgtgcccataaggtccccagcctgtgctgtccccgtgtctggtgccccttgccgccatgtgaagtctcctgtgtcccgccccgaacactggtctcggcccgagtagacctccctgttcccggctttaggtatccccccttaagtctcccggggcccccttggaatcctgagtgatgtgcacgctgatccagactggaggaccaagtgggagcccgcggagcccccctgctgacactgctccacatctcccccttttcctttgggctggtcactccccccggtgttcgaccatggccgcactttaccaccctgaagtgcttgatatccccgagggaactctgcattctcgcttcctggagggtgtcccccatgttgcccgtgtctgtctgccgattggctaaccccacctgttgcactccgtatcccccttctatcactccaccgggtaccaacgaggtcctggccttgtctgtggagaccggattatccccttcccccttgctgaaaaggtccaggcctttttggctgagtccctctgcctttgtggctgctgcccctgtggctgctgcccccccacgctgctcctgctgctgctgcacgcccccgcttaggttgagccccggaagagtcggagggaggtcggaccgaaggatatatgggaatttggtctctttgactaatcccccaaaagccacccacttagcccgttttatttgcca

SEQ ID NO: 715083 - DNA, 595 bp, Homo sapiens
ttggctcggtcccaggtttgtcgttggtggtgtttgcctggcagtgggacagtgggcaggtgaacattgctcacggtcagtgtatgctatagtacgtaggcatgtggaagatgtcttggggtgctgccctgtgaggtggtgtggcatccctcctgccgctgcctgctggggcctcggtctgtggcttacagctcggtgtccatcacgcggtaagctggtctgcctgagtcaggcttcgacgaataccgaaggctggcctccttttgtagctgaatctccttttactgcaaatatggaagtagtgtacagagaagtctgtggatcctgctcccccagactgatgaagaatggatgtttcatggcatcctctgcggagatccgatttcgaccctcaaactgcaacagcttggttgaggagtgtcggccccgtcgctatcaagtcggggtgcgtggctcaaaagggcctcggctcggtacttgcggtagttgtatgtcttgaactcctcgttggacaggatgcctggccacgtctcctcagttggggttcctaagatacggaagatgattctagctgtcctccaccgtggagccggaa

SEQ ID NO: 715084 - DNA, 775 bp, Homo sapiens
ggtatgacttaagaggtcaggtttcttggaggaggcaaatcttatagaaatgataggagttcgctgggtaaagagtggaactttagagggagcaggtaagggagagcagaaaccaagttttcaggaacagtcatgaaggtctgagtggcatatgcaccttttctacacatctgtgttctagagactaaaacagaaacagctggctagggaggcagtagcctgactgcagagggccttgcttattatgctgggccaagaactcagtatttgactccaggcaatcaggaactactgaaagatgttaaggagtggagggatggtgacaagcagaaatgtatgtgaggatgaccaccttgtaggcatttgaaagatggatttgaatgggctgagactgggagcaggagaccaggaagctcttttgtcaatgatgcagataagagatgatgggggtcggaagaaagaaagagacaggtaagaaatatttaggaggtaaaatggcaaggctgggtgattatgtgtgggaagagaaaaggagggacagagtcacagttaacaccagataagagcttaggtgatttgactaggtcactgggctgcaggcaggggccaggttggggtatggaggcagtggggtcatgagtcacaaccaagcagtgggtgtgttccaccctccgtgggatacaccggtggagatggcagtgggaactgattctcagttcaggagaaagtctgatccatttggtagcatagtacatggtagtctcaaaccaggttg

SEQ ID NO: 715085 - DNA, 286 bp, Homo sapiens
gtctttatatgcatcctaaccaggagcttcgtctgtagttgaacatctgccttgctggctgcagacgcctctgtatgcattgacttgaggcttctgcctctcgagcttgtagctttcagaagcaataagtgaaggcagggaacgtatatatctagcacagggcttaaccctgttttccagccaatatcaggacaatgtccttgttatagctacgggcccaagactacattcactataaacacattatacaaacgtcacctttttacatctctgacataattctcaa

SEQ ID NO: 715086 - DNA, 380 bp, Homo sapiens
cccataaataaacattttctaggtaaatttgttctttggtgttaataaatttttcgtcttgaactacaaaactttttttccctctcttttaagggtatttggagcaaagtacatttataaatctctattagtttgctagggctgctacaacaaaatagcaatagaaatgtattttcttccagttctgcaggctggcagtccaagatctagggctggcagaattggtttactatgaggtctttctccatggcttgcagagggctgcatacttgctgcatcttcacaagagcttgttcctccatgtacatgtgcccttggtgtttctctgtacattttagatgagaatatgatattttaagtcctgcctcttaggcataaac

SEQ ID NO: 715087 - DNA, 1129 bp, Homo sapiens
actataacgggccatttggtagcgaggccatgggtggcgcggggcctccagcgccggctctgggccgaggcagccagagcgcggaagaggcctggaaatccacgcggattcccggagacggcgcctctgctctgcgtggttcgtggcgaggaagtccacccactgcccgcggcgccactgaccatgatcggccaccaatgacatctactgccagggacgcccatggtccatggggcagtcactgaggagacacaggctgacgaggaagctggtggtgttgatcactcctcagagtgtccagcctgctcagggtcatcctctcgcaggtgttcgatgaagtcacttgaagatgaatctaatcgctagtgccgactacatccacctggaactttctgaagagacctgcagctcggagcatcacacactcaccaagcttcacatgtaggactctcaactcactacacagcaagtgatgtcttcctggatgcagacacatctggtgcatgttcaaatggtagactgaagcatgatttgacagagggagaagatacatggcggccacccgtgaaccacgagaatgtgcggatatggattaaatagggcgaggagtaaggaataaccaaccattcaatacatacaaagggcaataaaaatcgtgctatgatgaagaacatggtaaaacgggaagctatattgaacgggggcagaacaaaaggcttaatgaaatagtaactcaaggaccatgatcgaccacagaaataaacaagaaccatacaggcaagcgtacaaacgcgagtcggaaacgaaccgacacgtcaagccagggccacaaccgaaagggccagggaaaggcgaccccaagaggcagcacgaaaccatggacaccagcaaaacccacacgacacaggaggaacaggatacgaccactgacgaaacagagagaaatactcagatgtggggcgagattcacaacaggtgtagcgagatacaatgcaaaggggcaaggagattggtggccttggcagatttggggacgatgaacaccgtgtcctcagcggatatacacgttgacgtaaacgggctaaaaacgaacggacagtagacaggaggatttgaacagagaaaacaa

SEQ ID NO: 715088 - DNA, 232 bp, Homo sapiens
gattgtaagtgcctggcacatggtgaggttggtgcaccaaagtattataaaaaacaatagagcggctgggtgtggtggctcacgcctgtaatcccagcacttcgggaggcaaggtgggtggatcacttgaggtcaagacttcgagaccagcctggccaacatggtgaaaccccatctccactaaaaatacaaaaattagccgggcatggtggcatgcacctgtagtcccagc

SEQ ID NO: 715089 - DNA, 744 bp, Homo sapiens
gggttggtggatgatcttgagctcctcaggaacgatatggctggttctctggtaggctgagtgcctgtttgctggtgccctagaggtcgagctctgttgcttcgaactccagtggtcagacctgttcatatctcagcatttcttcaggaccgacctattccagtaatggtgtggagtgcagcatatactcttgtctccgatccaccattctggactccaaggctgtatctctccattggactagcgagagggttgctcagtgttgttgctcctgggtctgacttccggctgcttatttggaagtccttgctctgcgatggactattctcctggtctgcacgtcctcaagtcttcatggtcacatggcggccttggacaagttgttcactgactatgttcatggaggatgccattgctagaaagctgctcataagctagggcatttatggtaatctttcatgctttaacctttgctgggcttttgctatttcaactatcacgatgtgggcatctgctaacgtctgttgccaatgtctgtgtgaatgcatctgactctttttgacttcatactttgaagaattgatgtatgcctctttgcctctgctttgtcaatgccatttaagctcacgaataaggaaagaccatacagtatatagtcattgggtggacaagcttcttctcttaatcacaagatgatttcaagcaatttaatccttgaggaaacaggttggaagacggacttat

SEQ ID NO: 715090 - DNA, 443 bp, Homo sapiens
agttctgggggagcccagcaagtggctccacctgactcacactctgggtggggcaggtgctgaagctgcatggctggccacgaacctttgtactgtcaactctggcttcctttacaagaaactaggagaacttctagcacattccttccttaacctgctctctcaaaaccatcctgacccccatggcccctcctggaaacattgtactcagaaaagcagggaccaccagtggctgtcacagtgtttggggaaaaaaggaggtgccaagtcagcaagaaaacaaatgtccgctggtcccgcccaagcagggtgtggctagtcccgggggatgttggggggcgggaactgcaggtcggagggctccacaccccagatctcccgtgcatatccgtgatggtccggtcactggagacttgcccgagcaggcgatgttctgattactt

SEQ ID NO: 715091 - DNA, 1492 bp, Homo sapiens
  misc_feature (430)..(430): n is a, c, g, or t
  misc_feature (433)..(433): n is a, c, g, or t
  misc_feature (447)..(447): n is a, c, g, or t
  misc_feature (628)..(628): n is a, c, g, or t
ggggagcttgtgcagaagttcacatgccagtgcagtgaatccaggtagttggggagatgatcatgacagtgaccaactccaaagaggatcgccaaggggccgtgtaactgcagaagtccgtgtcgaactgcgctcctgctcaaagatcgaattcaagattgggctccgctgaccgtagtctcttgcagggcagtgcaatgctggctccatgcgccaatggattggagtgccgtctagtgggtgtcatcattcgttctgggggtgatgactggagatgatagccttcagtcgctgcaccatggttatggtgtgagtgcctgttgacatctggtgcctaagcatcgaaggcatgtggtttgcccctcatttgaccgaatacctgaagtcgtcgtagtggcacgaagtttcaccaaaccaaggctacccatcnagnaaatatgatacagntaggatagctggtgatgaacccagaggacctcatagcttgtgctcaggcctggaagccacactctttcctaagaaaagaccccaccgtttggggccacacaaagtttaaaggcatggggtgcgcgctgaggtcgaacacgcgccgctttccggggtcaaaacccagttgatttatgtgccnttacccacgaagtaacaccccttcactccggtcgggatggtttcaagggccatctcaagaggctaggctttctggaaggggacccacccacgggtaactctagaacagacgtttatgtcaggagagaggtgcccccttagacattaagttataaagacagaccccccaacacagacccggtgggggaaggttcctggttaacccggcttgtgccctttatggaaaaccttttcgtaagcaatggaaaaggcccaaaatggcttcccccctttgggaagccccccttggttggggcaaagcttcctcaaggcgtttttgcaatggtccggtagttaaacttggtgccccaaaggttcactgtgggttctcttccatcaggcccttcaagcttttttcacaatccaaatggttggttctaaggaacgtctgttgttgaacgcccctccaggttgttcatacttctcccgggggagaggttgggggccacaaaggggccttaaggaattccccgccgggttggggttttattggtggcttccaaaataataaacaaaaaaggccctttcaaggttggaaccccccatttgcaaacacacaaccacaccacgagacacagaagacccaccgacacaccagaacgcccctcggcgggggacacctcccaacagagggaggggaggtggcgcggcgaacaacaacagcaggggtacacacgacccaaccgtggcgccccagatgggggctcacaagaagggtgtgtgccccagagaccccccacagttttggttgtgtgctcaccaccgccgcggcaacaacctcgcgcccgaggaccccccccacaattgaagggcgcgacgggacaaa

SEQ ID NO: 715092 - DNA, 289 bp, Homo sapiens
taaaggagacagagtctggctctgtggcccaggctggggtgcaggggcacaatcaggctctctgcagcctcaccctccggggctcaagcaatcctcctacctcagcctcctgagtagctgggaacaggcacacgccaccacacccagctgatttttttattttaatttttggtagagatggagtctcagtatgttgcccaagctgccctcgaactccttcagagaatttacggtgcttggtctcaggtgtgcagagcagcacagggttacggtagcacaatctggggag

SEQ ID NO: 715093 - DNA, 1437 bp, Homo sapiens
  misc_feature (347)..(347): n is a, c, g, or t
  misc_feature (681)..(682): n is a, c, g, or t
tggtctctattcttgttctcaaaagatggtggtaagaaaaaaggtagagacaaaaaaaaaaaaagaaaaaacgcagagagggcaagagggcggagcatgaacccaaagaaagcaacaggacggtgaaacatccgcgttaaagtagggaacccttggcagcggcacgcttctctctttggagaaacctggggagaacccctaagtgtcaaccctcggggtgtgaaaatattctcttcacccggggtatattagaggttgtgggtggctctctcctatacaaaatattttcaacctctaagagcccagagtgtggctctctgggcgaggggccctctcacacaatatcncccagagagacgagtctctcttgtgaaacacccatcgtgcgaggggaggggcaccaatacaagagagagagactatatatctctctctagagtccgccacagagagaccatgttgtgcgtcggaggagagcctcctttctcatataaaaagagagcgtcgtcgcgcagttatccacgagttacgcggcgtcatatgtgggaggggcgaaaatagtgtggtgctctatagtagaaacagcgcgagtgtcgtgcccgacaataatagagcagccctccttttatatatatgtctcgttctaaactcctcccccatctctgaggggtgggtcacaanngccacatatatatacttcgcgggtgataccctattattattattttcacaaaagagtgtgtgcgccatatatgttgtggggggtgtccccccccatatattatgtagtagtgtggcgagacacagagtagtgtagaatctttttgtcacgcgaggcgaagaaaaaacaccccagcgtggggtgttgcgcggtgtccacccattgttttacacacgagagcagaggttggaggacaagagtggtcttcccttaacaaacacacatctttttcgagagcagacccactatcaaattatttattgcccgaccccagcaggagagggtctcccccccagggatttagaagcctccccagtgctgagacaagagaagatttttcaaggcggggtgctttcaggaaaatacaaaatgcccgccggctatataattcacccacgagagcggcgtcggatgagaacgccctcataataacaaaaagtgagggaaaccacacacagcaggaacatcactgatcccccccggtggagagcaagagggaggggggggaacactcccgcccaagataagctagcgcgggcggagacattagttgccgcaaacaacacatcgtcccaggagaataaacgacagagcggacgtaagaaaaagtgcgcgtgatcacacgcgggagacaaacaaatcacaagagggggggcacaacttattataaagcaccacagcgtggcgagccaatatggagtgtgtgtgcgacccgc

SEQ ID NO: 715094 - DNA, 322 bp, Homo sapiens
tgtgtggtgttatgcctagaggtaatgataagtccgtttagtatgtttgtaaaaaagaatgtgttcttcaaaattgttaaataatcacacgattatcgatgaatttacttgacaatgtcatatatgtgctagacataggatatttgcataaaatatgataggtttaggctgcaagattgattcgaagtatgttccaactattgtttgcttcgaattgactcttatgtgatcatctcgaggtatgcttcatactttatttgccccgggaattatgtgcgagcatactaaaaaatggttagaaactgcataacaaccacacaat

SEQ ID NO: 715095 - DNA, 475 bp, Homo sapiens
gtcctacaaagagaggtggatttgccgataaggggggggttaattgaagattttcccaattttgaggggaaacccaagaccagacgctgcgcgaaaacccatttcaagataaaattaatcggggggagatgaaattttttcccccaaaactttttggggctaacggaaagcgcccagggttagtggggataccggaagggaaacaccacatgaaacatcctatcattgggagggtcattcatttctctaaaagcaggaaaattaaaaattttcaggatttgagaagcctttggtttgaagggaaaagtcctaaaagtagaagaaccctccataaacctggaggggtaaaatggaggcccccccccctaccacacatttgaagaaccgggataaataaaatttagacaaaaaaggaaggaattgaaccccccaaagggggttttaagccaaccccagggcctccatgattttttta

SEQ ID NO: 715096 - DNA, 866 bp, Homo sapiens
ttggcacgaggactggacctggagttataactgctccactgactgatagagctgacctggcctgaccattgctgccctggatgtttgcccgcgggccgacgccgtactggagtgttgcgcctcgtgtggctgcctgcgctgctcctgctgctcatccctggtggccgccgcgcatgtgatgcctcccgggagctgccgtgtgattcctgaacactcgttaccacatgtcttgcaatccaatgtgctatgcttatcagcagtggtgctacagtgaattagtgacctatcatatttgctatgttctacagcaacacaaacaaaaccttgtgcaagcagtgcctgaacgaacgtctccttgctctattggtagcaaccactaaccaagtgctatgctctagtgcactacccagctatacaaaagcgtctttagccacccggcctataccctatatgctacaactctggagctactagcaccgcatgggcgagatacaagtatagcgcgtagaacctatactgcagagccgctagatacatacaacacattgctacgcgataacgctcagcggtccgaaacccctccccttccttgcgtgcatttgccccactcttgccttgctttacttgctttggcttcgcaagctggagtgcaaccgacctgcactccccgggaacgccccgggcacaagctgatgcttgacctcgcagacacccgccccactagctgttcaaacccgggcgagcgaagatgtgcggactacctggcctcggaacgaacaccggaacagcaagacatgacagaccaacaacacttattcaaacatcagaaccacaaactattgccctgtttacaacaaacaaaaccg

SEQ ID NO: 715097 - DNA, 345 bp, Homo sapiens
  misc_feature (184)..(184): n is a, c, g, or t
  misc_feature (196)..(197): n is a, c, g, or t
  misc_feature (227)..(227): n is a, c, g, or t
  misc_feature (248)..(249): n is a, c, g, or t
catcgacggttccctccagtgttaatctctgatgataacgaagggatgagctagacttaaaggctgtgcacattcattacataagtaggacttctttctgagatgaattttctgacttccagaaagggaagtgctgtaactggatgccttcctgcctggatagtatttatggggatactcttgngcatggattttnngatgtataaaaagcccagaccttcgactgnaggatttaccacattctttanntctatagcatttctccacagtatgggtccttaaatgcttacaaagggatgcactatggctgaaggctttcccacattctttacatatatagggttt

SEQ ID NO: 715098 - DNA, 227 bp, Homo sapiens
ggaagcccagatatgacagagacgcaaggcaggctgtacgctgggttcccgaaagaaagaagatccgggtgccatactggagaaatatccagactcagtctcttgtcttctctctgtaggtctgtcttattcttgtcctttgccaggcaacttaggctgtgtgtctggatcccatgcatcagataaccaccacatcactcctgtgatgacccgagtctggtcatctg

SEQ ID NO: 715099 - DNA, 425 bp, Homo sapiens
atgctcaggatgaaaggcgacactactgtcatactcaccaacacctggctggacgaccgtgctgagagagatggcctggcccagctgatgtgtgagctgaagatgcactttgacttcctgatagagtcgtgtcaagtgggaatggtcaaacctgaaccttatatctacaagtttctgctggacaccctgaatgccagccccagtgaggacggttatttggatgacatctcagctaatctgaagccagcccgtgacttgggaatggtcaccattctggttcaggacactgacacgtgcctgaaagaactggagaaagtgaccggaatacagcttcttaataccccggtcactctgccgacctcttgcaattcgtgacatgagccatgggtacctgacagtgctcacggtccgtctgcatattgtgg

SEQ ID NO: 715100 - DNA, 358 bp, Homo sapiens
  misc_feature (166)..(166): n is a, c, g, or t
  misc_feature (186)..(186): n is a, c, g, or t
  misc_feature (260)..(260): n is a, c, g, or t
  misc_feature (282)..(282): n is a, c, g, or t
  misc_feature (298)..(298): n is a, c, g, or t
gcagcagctgtcgctggccgtgccccaggcccctcagctttgaggcgctgctcgccaggtggggggcatgggggcggcagagctgcagctcggcctctgctgcctgccggtgctcttcgtggctctgggcatggctcggaccccatcttcacgctggcgcccccgntgcattgccactacggggcnttcccccctaatgcctctggtgggagcagcgtcccaatgccagcgggtcaggtcgccagcgctgccctagcagnaagcgccgccagccgtgtcgcnaaaaataaaaaacccncgtgcagcggcttcgcccgccggacttcaaccattgctcaaggattgggactataatggc

SEQ ID NO: 715101 - DNA, 1126 bp, Homo sapiens
  misc_feature (140)..(140): n is a, c, g, or t
  misc_feature (270)..(270): n is a, c, g, or t
  misc_feature (278)..(278): n is a, c, g, or t
  misc_feature (539)..(539): n is a, c, g, or t
  misc_feature (542)..(542): n is a, c, g, or t
  misc_feature (577)..(577): n is a, c, g, or t
  misc_feature (639)..(639): n is a, c, g, or t
  misc_feature (646)..(646): n is a, c, g, or t
  misc_feature (656)..(657): n is a, c, g, or t
  misc_feature (710)..(710): n is a, c, g, or t
  misc_feature (717)..(717): n is a, c, g, or t
  misc_feature (721)..(722): n is a, c, g, or t
  misc_feature (724)..(724): n is a, c, g, or t
  misc_feature (734)..(734): n is a, c, g, or t
  misc_feature (757)..(757): n is a, c, g, or t
  misc_feature (768)..(768): n is a, c, g, or t
  misc_feature (792)..(792): n is a, c, g, or t
  misc_feature (827)..(827): n is a, c, g, or t
  misc_feature (832)..(832): n is a, c, g, or t
  misc_feature (836)..(836): n is a, c, g, or t
  misc_feature (863)..(863): n is a, c, g, or t
  misc_feature (865)..(865): n is a, c, g, or t
ggggcgcctagaggatcctctctaatcatcaggcgattcctgcaggttatatgaggggggtgatcttaaaggacattaggatggtgctcagaaatggttaatcatgctgtgtgctagccaggccagctggtaccttcttngccatgagcattcaagggacagctaacctttattgacaatctatattgcaaaagtcaggaaagaggttgtgagcctgattggattaaaagaccctggcaccttcaggtaacctcagcaccgcttcccacnttccactncaacttaagagggttccattggaccagtgtttagggatgtgaaggctgggaaacacttatttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaantgngttgaaaattgaagtgacctctttccagctgactngcaggcttatttggtaacctttcctcatccagttttccctgaaaaccggggtttatctctanaatagcngtcaggtttnnagctgagggtaagtatcctagctgagagtttggcatcttggggcggggttcgncggggtngtgnntnggcataaaangtctagtcttggccacagatagngagctacccantaatgagcccatggtttatttcanaagcacatgagggtgtgaaaccactctgtaccttncggtntggncttagctattcaagccagtcagagganantatatatattctcatcagcactcagagtagtcagtgaagagagtagatcacactggggcacaccaggattcacataaacatggtatcttcctctggggatgcacaggccatggtctacaatgaggctttacaaccttccttggttgggctcgggataacttccggctgtctaataatggaaccatacccatgtaatattatgtaaggcctgacattactgtgctaaaacaagtcatgtagtcacgtagtgtaccaatcctg

SEQ ID NO: 715102 - DNA, 240 bp, Homo sapiens
gatctagaggatctttactctcgggcctgagagtgtgcatgtacagaggttcggactgctgactcctgaggatggagaaactgtggcaccctgggggccactgagggaggccagctgattgcagcacgtgtaccttcctcttcatcgtctctgtgtttagtagatgaccgcacctcgagcaggagtggggatgccacgtctgaccccagcgcccggccctctgtccaccacggtcattcc

SEQ ID NO: 715103 - DNA, 552 bp, Homo sapiens
ctaagtctcaatcgatggtatagctagaagtgtaaaacgacggtcagagtataggtcatatcctgtgtagtgtaacacgagggccagcgcatagctcatagcgtggtaatgtaaaagcgacggccagcgcgctgaagtgcgctggaagtgtaagacgctggccatatcgtagaggaagctcgtggaagaagcagcataggcccaggctcgcagcagagaaggcaattacacaagcagatcaagacattcaaggaacccagaagctgctaacttcgatagaggtctgaaccagcagcttctgaggaaaccttgtgcaaggcgttccagcgcatcagcgagttacagaggacatgtggaagaacttacagcggaaagctggccaaaaactccgggaaggcagaatatattgaacaagtagtatatacttgtgaagccaaagtgcagaagatgtttaagaagactttagatggtgaacttgagtgaaaagtattaaaaagtaaacatttacttgccacaaaaactgcagagtccgctgatgcccgaaggaaagcc

SEQ ID NO: 715104 - DNA, 231 bp, Homo sapiens
  misc_feature (39)..(39): n is a, c, g, or t
  misc_feature (190)..(190): n is a, c, g, or t
  misc_feature (206)..(206): n is a, c, g, or t
ttggcaagcagagatagttttccagttttaatgcctttnatttctttctctggcctgatagctctggctaggacttccagtactatgttgaacagaagtcatgaaagtgggcatctttgtgttgtttcagttcttaggaggaatgcttcaactttttcctattcaatgtgatgctggctgtgggtttgtnatatatgacatttatnattttaaggtatgctctttctatgc

SEQ ID NO: 715105 - DNA, 576 bp, Homo sapiens
ttcctggagtacgtggctgagtctctggagccaccgtcccccttcgagctgctggagcccccgactccgggggcttcctcagtgctgggccggccctgctgctacatcttccctggaggcctcggggatgccgccttcttcgccgtcaatggcttcacttgctgctggtcaactgtgtgtgctcaaaccccaatgtccagtttctggaagctggtgctgtgcacctggacctgcgtggatgccgtgctggtgacccaccctgtgcgccgacagcctccccgtgctcaacagcctgctgcggctgcaaactggctggagctgctccgatgtgtgtgctgctggtgcggggctcctgcggactgacatggctgctgcatggctcatctcccccaacctgggggtcgttgttcttcaactgcctgcgaggccgcgtcgcgtgcttggcgctgctggctgagcgatgaggtgcggaagctgtgctgctgagcctcctgtgcgcagctgggcatcacgcctctgccactcatccgcggccccgtgccagccaaacccaccgtgctcttctgaggaagatgg

SEQ ID NO: 715106 - DNA, 405 bp, Homo sapiens
  misc_feature (75)..(75): n is a, c, g, or t
  misc_feature (142)..(142): n is a, c, g, or t
cgctcgttcgctgtgccaggacaaagtcctgtagctcatagtcctgccgtgtgagagggggccacatccccgttnctcgggacgcacgacccattaagcagggtgctggctgccccctccatctcgtcgatggagaggtcancaggcatcagcgatttcgtgttttgtgtgcgtgacacaaattttgggtcccttgcatacgcgtcccacagccttacggagtatcagcgactgctctccaccaatgctgcccgcgactcctactgcttgtccgctgtttttggttccggaagctgctggggacagtcaggctggctggtgtgaaagtccggtaggagatgtcgggctcgtctgtgtaccaggagctgcggtgcagggacggcaggctgccgttcacctggtccg

SEQ ID NO: 715107 - DNA, 396 bp, Homo sapiens
  misc_feature (184)..(184): n is a, c, g, or t
gaattcggcacgagggcagagggactcggagtaatcgcctgcattgggggagaagctagatgaaaggggaagcttggcatccactggagaaaggttgttttccgagcagacacaggtccatccgcagatacacgtgaagggactgggagcaaggtccgccctcggcctatgagcctcgtttggncatttggtactcggcaagactgcaacaccccaacaggcccaggaagtacacgagaagctccgaggatggctgaagtccaacgtctctgatgcggtggctcagagcacccgtatcatttatggaggctctgtgactggggcactcgcaaggagctggccaaccagcctgatgtggatggctccttgtgggtggtgcttccctaaagcccgaat

SEQ ID NO: 715108 - DNA, 956 bp, Homo sapiens
cggcgctggcagcggcaactgcggcggcggcgtcggaatcagcagtcgggattactgccgacgcttctgtcaggtggttgaagattatgctggaagatggcaggtccctttgccacagcttcaggttcttcagactgccctttgttgttttacaacagccagtgcatcattcccagatgaatgtgagcatgtacaatatgttttgagtagccttgctgtgagtttctttgagttgctgctgttctttggaagagatgagttttatgaagagcccttaaaggatattcttggatcattccaggaatgccagaatcacctccgcagatatggaaatgtgaatctggaactggtgactcgaatcattagagatggtggcccatgggaagatccagtgttgcaagctgtccttaaagctcagccagcatctcaggagatagtgaacaaatatttaagttctgaaaatccactgttctttgaactacgtgccagatacctaattgcttgtgaacgcatacccgaagcaatggctcttattaaatcttgtataaatcacccagaaatcagtaaagacttatacttccatcaagcactcttcacatgtctgtttatgtcacctgtagaagatcagctattccgggaggtattgtttgagactatttttgcctattaccattttaaccctaccaaaaaaaaaccaaaaaaaaaaagtagcccactgttgttgttaaattccttttacagtaatgccaaagatttaaggattacattatctggatgtgttttcttttggcaccataacttaaggtcatgttgaattagtcaaaatctgatattaacaaatgatgaaatcaataaaatatactcattaataagtattattcacattgcacttttgatgtgatggagaagaggtcaaataaaagtcaacaagctcacagcttgccaggagtaaaaaa

SEQ ID NO: 715109 - DNA, 573 bp, Homo sapiens
  misc_feature (82)..(82): n is a, c, g, or t
  misc_feature (331)..(331): n is a, c, g, or t
  misc_feature (353)..(353): n is a, c, g, or t
  misc_feature (362)..(362): n is a, c, g, or t
  misc_feature (418)..(418): n is a, c, g, or t
  misc_feature (461)..(461): n is a, c, g, or t
  misc_feature (552)..(552): n is a, c, g, or t
aacggcacatattttacagtcatttgctagaatacctccacttcaatgatgtcatccagtgaccccgacaaaaggattatcncaatgtcttgcactttgcaatcaagcagcaagttatgcttctctaatcgtttctgttccagagaagtttgaatacttacaacttctttttgcaatttccccacttccctgtaattacacagatatgaaaaagtaattttactcatatgtaacactgcaccaaggaagaaaaatgtatgctataaacttttatgaaaaaagaatatttattccgtgagtgctgtaagttctagaatcctctcatgatgcntgtaattaatgttaacactccngagaaaggncacgaatatactcagttaatctaaggggagcatttccactaataaatgttactggnttaatccagggtaccccagggcttcctcactccaatataagcnctacatttaggaccccaacccaggataaacagactcctaggccaaaggaaatccctggccgtaagtcacatacaccttaataaccggtttncctggcccaccaccactgggg

SEQ ID NO: 715110 - DNA, 1364 bp, Homo sapiens
cggcgctggcagcggcaactgcggcggcggcgtcggaatcagcagtcgggattactgccgacgcttctgtcaggtggttgaagattatgctggaagatggcaggtccctttgccacagcttcaggttcttcagactgccctttgttgttttacaacagccagtgcatcattcccagatgaatgtgagcatgtacaatatgttttgagtagccttgctgtgagtttctttgagttgctgctgttctttggaagagatgagttttatgaagagcccttaaaggatattcttggatcattccaggaatgccagaatcacctccgcagatatggaaatgtgaatctggaactggtgactcgaatcattagagatggtggcccatgggaagatccagtgttgcaagctgtccttaaagctcagccagcatctcaggagatagtgaacaaatatttaagttctgaaaatccactgttctttgaactacgtgccagatacctaattgcttgtgaacgcatacccgaagcaatggctcttattaaatcttgtataaatcacccagaaatcagtaaagacttatacttccatcaagcactcttcacatgtctgtttatgtcacctgtagaagatcagctattccgggagcatttattgaaaactgattgtaagagtggaattgatatcatctgtaatgctgaaaaagaaggcaaaactatgttagccttgcaactctgtgaatcctttcttattccacagctccagaatggggatatgtactgtatctgggagttgattttcatatggagtaaactacagcttaaatctaatccttcaaaacaagtttttgtagatcaatgctaccagcttttaagaacagcaactaatgtgagagtcatatttcctttcatgaaaatcatcaaagatgaggtaaataggatatatttgtcccttaaatttaaaattgagtgacagttcactgaaacttgaatctcttttgataaaatttatttgattttaaaactgaaggaaaggaggattttaaggggcacatttctccatacatttaacattctcctctggcctaaatccaaaatctcaacatgggaggcgattaatgctacttaaattcacatgggagcaacgcctccatacaacccttttcctatacctaacatttggtcctttcaatatcctaatccatattgacacttacattgcaacaccggcggttattgacgacctcgggcgacaaaacatccgtcgtgcgtagaaggaacaaaactcgggcccacgcagacaggctccaacagtgctctctacatcttttctcctcttatcttcgctctttataatttatttccggaaaaga

SEQ ID NO: 715111 - DNA, 958 bp, Homo sapiens
attaatgtgaactaacatggttttaatgtgacagattaggattcagccttttaatcttaaagaaaatattgagcagtaagaagataaagtatgtaatcttagactaaaaagacatagacccatgttacttggaacatattttaacatattaatgaactgaaagaagaaaaaaaatttttttttaaattttgtttctgttatttactttttagactaagaaatcaacaaatatttcttgagcactgttttggtgtcactcttattttcctttttccaaccatataactgaatattttcacaaataaactcctactaaggaaaatgctatttaagtagttaaatctaattagaaaccatattttagtggtaaagtttcaaagaacaaagttgagagaatcttttcttgagagtaatagagtctgttttctttttaatatagtgaacaaatatttaagttctgaaaatccactgttctttgaactacgtgccagatacctaattgcttgtgaacgcatacccgaagcaatggctcttattaaatcttgtataaatcacccagaaatcagtaaagacttatacttccatcaagcactcttcacatgtctgtttatgtcacctgtagaagatcagctattccgggaggtattgtttgagactatttttgcctattaccattttaaccctaccaaaaaaaaaccaaaaaaaaaaagtagcccactgttgttgttaaattccttttacagtaatgccaaagatttaaggattacattatctggatgtgttttcttttggcaccataacttaaggtcatgttgaattagtcaaaatctgatattaacaaatgatgaaatcaataaaatatactcattaataagtattattcacattgcacttttgatgtgatggagaagaggtcaaataaaagtcaacaagctcacagcttgccaggagtaaaaaa

SEQ ID NO: 715112 - DNA, 670 bp, Homo sapiens
  misc_feature (37)..(37): n is a, c, g, or t
ccgatcgagaggaccctgttgctaggtggagtcaaantttctgggactcaacgatctcccaagtatctgggactatagtcaagcactgtaggtttggacgaaagtatataacatgtatccaccattactatattatgcaaaatagtttcactttccaaaaactctcctgtgctccatcttcatccctccattacataaaaataaagatcctagcccttttaatttcatgttttactattcaaagcatttggtcgtttaagtctcataaaaatccagtgaggtaaatatgaatcctatcattgctatcctgcaaataataaaatggaggaatgtgaaggaatggtagagaagttaaaaagagtaagggtgaatgtgggtttaaaaaaagaaatactctctcaacatcaaaagaaaaggacataggaatagatggtttaatactttgtgaaaaggaaatacatacacctttccacagctaatttaaaagaggaagaataaatgtaaagttgacaataatacagataagaaagtaataggctgggtgtggtggctcatgcctgtaatcctaaccctttggaaggctgaggccagaggattgcttgaagctatgagttctagaccacactgggcaactttggatttttttatttagctgggatgggggtaactc

SEQ ID NO: 715113 - DNA, 965 bp, Homo sapiens
  misc_feature (19)..(19): n is a, c, g, or t
  misc_feature (61)..(61): n is a, c, g, or t
  misc_feature (69)..(69): n is a, c, g, or t
  misc_feature (71)..(72): n is a, c, g, or t
  misc_feature (85)..(85): n is a, c, g, or t
  misc_feature (89)..(89): n is a, c, g, or t
  misc_feature (119)..(119): n is a, c, g, or t
  misc_feature (132)..(132): n is a, c, g, or t
  misc_feature (136)..(137): n is a, c, g, or t
  misc_feature (156)..(156): n is a, c, g, or t
  misc_feature (170)..(170): n is a, c, g, or t
  misc_feature (192)..(193): n is a, c, g, or t
  misc_feature (195)..(196): n is a, c, g, or t
  misc_feature (256)..(256): n is a, c, g, or t
  misc_feature (302)..(302): n is a, c, g, or t
  misc_feature (364)..(364): n is a, c, g, or t
  misc_feature (367)..(367): n is a, c, g, or t
  misc_feature (369)..(370): n is a, c, g, or t
  misc_feature (377)..(378): n is a, c, g, or t
  misc_feature (381)..(384): n is a, c, g, or t
  misc_feature (396)..(396): n is a, c, g, or t
  misc_feature (408)..(409): n is a, c, g, or t
  misc_feature (412)..(412): n is a, c, g, or t
  misc_feature (418)..(418): n is a, c, g, or t
  misc_feature (429)..(429): n is a, c, g, or t
  misc_feature (436)..(436): n is a, c, g, or t
  misc_feature (444)..(444): n is a, c, g, or t
  misc_feature (447)..(447): n is a, c, g, or t
  misc_feature (482)..(482): n is a, c, g, or t
  misc_feature (486)..(486): n is a, c, g, or t
  misc_feature (503)..(503): n is a, c, g, or t
  misc_feature (506)..(506): n is a, c, g, or t
  misc_feature (510)..(511): n is a, c, g, or t
  misc_feature (515)..(515): n is a, c, g, or t
  misc_feature (518)..(518): n is a, c, g, or t
  misc_feature (530)..(530): n is a, c, g, or t
  misc_feature (549)..(549): n is a, c, g, or t
  misc_feature (569)..(569): n is a, c, g, or t
  misc_feature (576)..(576): n is a, c, g, or t
  misc_feature (583)..(583): n is a, c, g, or t
  misc_feature (586)..(586): n is a, c, g, or t
  misc_feature (591)..(591): n is a, c, g, or t
  misc_feature (950)..(950): n is a, c, g, or t
atgcatttaaaaaataagngggaggtgggcagcaaacacacaaagtcctagtttcctgggnccctgggngnnaagagtgtggcantgtntccacccactctccacagggaataaatctntctcttaaatgcnaagnntgtttccatggcctctggntgcaaatacacagngctctggggtcagagcaagggnngnngggaggaccacgagtgaaaaagcagctacacacattcacctaattccatctgagggcagnacaacgtggcaagtcttgggggtagcagctgttcccagagtcaagnaataccgtacacccctggggagatttgctcctaaaaagaagtggcagttacaaacaaaaaanaangnnaaacaannggnnnnttttttcttcanccacactcttcnnganaatgcnataaatatgtnatttaanattttaanttnatagcattggacacacactcaacatattgaaatantgantccttagagaaaaaaanggnaaannaggnaanaaaaaatattgnatttttctgatggagaatntcggcccccaggcatggggngtagtgnaccagtntcntagcntgcaggaggcgctgaggtcggccgggtcctctggggaggaaggctgtgcccattgcctggggctgtatggcaaaaattgtgttgggtgtccttggccttgccagctcaggccctcagtcgccggtcacctgggggggcctgcccgtcggagggctggttggctgactggatgaacatgggctgggcgaggtcctggcccgcaggcatgggtgacttgctggatctggtagagctgctgtccatctgtgaactggctgaactgctgctgttcttgctggacctctgtctgtgttatctgttgagcattggtggcaagtgtctggatctgtccctgcacaacttgagtgcctgatacacgntggggctagcggata

SEQ ID NO: 715114 - DNA, 903 bp, Homo sapiens
attaatgtgaactaacatggttttaatgtgacagattaggattcagccttttaatcttaaagaaaatattgagcagtaagaagataaagtatgtaatcttagactaaaaagacatagacccatgttacttggaacatattttaacatattaatgaactgaaagaagaaaaaaaatttttttttaaattttgtttctgttatttactttttagactaagaaatcaacaaatatttcttgagcactgttttggtgtcactcttattttcctttttccaaccatataactgaatattttcacaaataaactcctactaaggaaaatgctatttaagtagttaaatctaattagaaaccatattttagtggtaaagtttcaaagaacaaagttgagagaatcttttcttgagagtaatagagtctgttttctttttaatatagtgaacaaatatttaagttctgaaaatccactgttctttgaactacgtgccagatacctaattgcttgtgaacgcatacccgaagcaatggctcttattaaatcttgtataaatcacccagaaatcagtaaagacttatacttccatcaagcactcttcacatgtctgtttatgtcacctgtagaagatcagctattccgggaggtattgtttgagactatttttgcctattaccattttaaccctaccaaaaaaaaaccaaaaaaaagtagccagttggtgttaatcctttaaggagcaagattaggttcatttcgggggggttcttgggccatattaggtgggatttgccaatggtttacaatggaagcaattccttaagttcactggtggggggaaaggaaaacaccggggaaaaaaaaaggcgggaaaaaggggggggaaaagaggtaaccaaggagagta

SEQ ID NO: 715115 - DNA, 346 bp, Homo sapiens
  misc_feature (169)..(169): n is a, c, g, or t
  misc_feature (172)..(172): n is a, c, g, or t
  misc_feature (270)..(270): n is a, c, g, or t
  misc_feature (315)..(315): n is a, c, g, or t
  misc_feature (336)..(336): n is a, c, g, or t
aataaatggtaaacatgggtttttttaactttatgaaaggaaaaacttctggatttaacacattcagataatttagaaatttagaatgtgaaattcctctcaccgttgacctttttcccattccgagttccatgagcagtgaggtgtgtgtcagcgtgtgctcctgcancancatttacacccgtgcaggtgcagccacaccttttctttgcattcatctgtcatgttgaagggtaggatcgctgcctttgctccacggggacttctttnctgcgtgttctgcagggggacatccacgggcccagcttcggccantacagggggcatgctttgctncgggggcgtt

SEQ ID NO: 715116 - DNA, 1272 bp, Homo sapiens
gagctcacggaggctgatgcgtagactgtcgatgaatggccaagtatcagatggaaatgatgcggaaccgttcgccatgtcgacattgatcatcttgaccgtggtctggatatccggtccacatacgtagtggcatcattcgggttatgcacggtgcacatcactgggagtcctctagatggaagctgtgcgcagcgatgccccttgcagagactcgtgatgggttctcgatttatgatccctataaaaaatgcccaaggatctctcgtcgctaaaggcatctcggactggagctcctagaactgagtggacaggtctgtgacgaggacgctaggattctgtcgccctggaaggccttgcagagacacattgcgaagatatcagcctgtggatgtacagtgttcagaagaagtgccgattgtaaagtggagaatagatctcagatctgactcgaagtgtcctaatgtggtggtaactttgaatgcatgaagtccagctgtttgcgagactagagacatgaattcgtcagatctatgcactacgcagctagatccgatttgggggagggaaatcttacaggtttgcttgtatgagaactagagtgggcatgaacacttgagccagatgatatgtagttgtaaggattatgcaaaatggaatagccttgagagaccgaactaggtgaaggaaaacccacgtgagcatcgaaagatacctccgcgatacttcacgtcaagacgatttggcacaagttacggaagatacttttagcagggtgaccaaggacggcacgatgcggatgagaaccccgaggatttctcctgcagggaatgggaaccctctgttctcggaaggcattcctttggacatacttctacccaataggtctcgaggcttgcttcgaggggacttgcgaaggttccgactagcgtcccaatttttgcagcagcccaaggagtccaaagtcaactctagcgtagacgcacgcaaaacaggttcaacgtggatggataatctaagaagggcggcagaagagaggtttaaagtgcgggaagtcgtcgtggtcctagtggcccccaaggtgatattccttgtcaacggaaaattacgaagaagtgttatgtcaataccggggaacggtgttttccccacgaataagacggcaagggtttcaaccattgtgaaacacttctttgtgatggttccacaacgcatgggaacaaacatcgttggggaaagaaacaattatattgtggccattagttgtaagca

SEQ ID NO: 715117 - DNA, 90 bp, Homo sapiens
gcggccgcctactactactactactgctcgaattcaagcttctaacgatgtacggggacatgtaaataaatacattcttggaggagcacc

SEQ ID NO: 715118 - DNA, 171 bp, Homo sapiens
atgagttgtcctgtttaggcttttatcttccgtaaccaggatatcaaattgttccccttgttaggaaggcagactgacattctgttctgggtcgcctgacttccttgaaactgttaaagcttcatcgtggagacccttcagagagaaaaattataagccaaatcggacaca

SEQ ID NO: 715119 - DNA, 217 bp, Homo sapiens
gtcacagctaagtaatagctggagacccttgggtctgcattcttattactaacggtctgtctctgctgcccctgtgatgctctatcaaagacggtgtggtgtgttccatgtgttcatcggacaaggggagtgatgcttgtgaattctcaaatccctgcgactgctaaggcactggaggtaggagtcaacaagacaaagatcctgcctcaacctctgg

SEQ ID NO: 715120 - DNA, 708 bp, Homo sapiens
  misc_feature (636)..(636): n is a, c, g, or t
gtgaaccgtatatgaccaagaccacactatgccttgtagtgacacctaataactattgatcttagaactacgagagatgttctacggatgatctctagaaaataaaacatctaccttacctctggactctccggctgagagtagaggtttcttttaagtcttggaggaaacagttcggtgaaactttactgactcactgtagaggctacaagaacaagcaccccttccatgtgtcgtcttgagaaagatctcacagaagcttttctcagcagtactctatggcttaaaacgttcagcacaatagggcagagggggtgacttttcttacattaatgagatttacatccaagacactgaatcttccgttagaggcaagactctattttctatactgtaaatatttggtatatttgccactacgtgaatgattggttttcactaagctataatcgtgaagctagaaatgctagtctcttgcctgattctgtgtactcattgctgcatgttaagctgccagacattaaagtgcactcttgcatattttgaagaacaaatttttctgtctgcaccaagatccatagaagagaccagacagtccactcgtgggggggccaggtccccaattcggcctatagngaggtggattaacattccctggccgttgggtgacaccctttgactgagaagaccttgcgttacgaactttcg

SEQ ID NO: 715121 - DNA, 103 bp, Homo sapiens
cggcacctggaaatcgttaatcttgactattacctgtgtgaaacttgttattcactaaattcagtactcctcaaccatctcctaatgattggaaccaagcaac

SEQ ID NO: 715122 - DNA, 165 bp, Homo sapiens
gggcagcataagcgtgacttcggtggaggcgtccagtcgggctgggagacttctctgacctggcaacaatttcttccggggttctggagccctcgtagtctacagccggccccgttcttaaggatcttgatggtggggtagccactcacatcaaaccggctggcc

SEQ ID NO: 715123 - DNA, 185 bp, Homo sapiens
gttggttcgctcggagaacagcgtcaggcggacccgcccgtcggtccacttgcgctcgatgttcaactcgccggtgaagtcctgctccggcttgaggaacggattggcgaaggtcgcgacgccgccgatcgtgacgttttgataaagctcggtcaccgtcggataacgcgatggggtaccgagct

SEQ ID NO: 715124 - DNA, 311 bp, Homo sapiens
gattcgcggcatgtgtgctattttaaatcccggtagagatgggtctcctttgttgccaggctatcttgaactgctgtgctcacgtatcttcctgctcagccatgaagcaacatgcccagtgccaattttgtgtaatcaaatgatcatgtgtactcagtacccttaattacctgatgaggaatggtgatggcatgcaaccaacgttttggggagagtggcgctcacatctccactatctccagaagtccttactccctgtgatttcttccaagccacttgagataaacaccacatggcacgcgacatcgcca

SEQ ID NO: 715125 - DNA, 260 bp, Homo sapiens
  misc_feature (35)..(35): n is a, c, g, or t
tagctcggtacccttggagaagtctgggcctgggnacagagaggatgtaatctgaacactcctgttgtcacagtgtcaccagcgtatgcttgaggggacggtagacataaacggaattcagaggcaggaagactgcagagtagaaaggtgatgtgccacaagctcccgacaatggatcaactgggagctatccatctgtgctttctgaagcagttcaattgtaagagaaagccaatcaggaatgagtttctccatttcca

SEQ ID NO: 715126 - DNA, 744 bp, Homo sapiens
  misc_feature (2)..(2): n is a, c, g, or t
  misc_feature (83)..(83): n is a, c, g, or t
  misc_feature (85)..(85): n is a, c, g, or t
  misc_feature (200)..(200): n is a, c, g, or t
  misc_feature (213)..(213): n is a, c, g, or t
  misc_feature (231)..(231): n is a, c, g, or t
  misc_feature (251)..(251): n is a, c, g, or t
  misc_feature (263)..(263): n is a, c, g, or t
  misc_feature (267)..(267): n is a, c, g, or t
  misc_feature (284)..(284): n is a, c, g, or t
  misc_feature (306)..(306): n is a, c, g, or t
  misc_feature (311)..(311): n is a, c, g, or t
  misc_feature (333)..(333): n is a, c, g, or t
  misc_feature (353)..(353): n is a, c, g, or t
  misc_feature (356)..(356): n is a, c, g, or t
  misc_feature (361)..(362): n is a, c, g, or t
  misc_feature (370)..(370): n is a, c, g, or t
  misc_feature (379)..(379): n is a, c, g, or t
  misc_feature (382)..(382): n is a, c, g, or t
  misc_feature (388)..(388): n is a, c, g, or t
  misc_feature (392)..(392): n is a, c, g, or t
  misc_feature (395)..(395): n is a, c, g, or t
  misc_feature (410)..(410): n is a, c, g, or t
  misc_feature (433)..(433): n is a, c, g, or t
  misc_feature (442)..(442): n is a, c, g, or t
  misc_feature (445)..(445): n is a, c, g, or t
  misc_feature (461)..(461): n is a, c, g, or t
  misc_feature (557)..(557): n is a, c, g, or t
  misc_feature (609)..(609): n is a, c, g, or t
  misc_feature (625)..(625): n is a, c, g, or t
  misc_feature (650)..(650): n is a, c, g, or t
  misc_feature (665)..(665): n is a, c, g, or t
  misc_feature (671)..(671): n is a, c, g, or t
  misc_feature (732)..(732): n is a, c, g, or t
tntgccctcgggggtccctagaaggcgacaatggctcgagtccaggcgccgaggctggcgagcgcctgcttggcgcacagctncncgttgagcggcggcggctgctccgaggagtccggctgtcggctcaccagccccgagaagccggagccaaagatggagatcaagtttgagatgttggacgcgtccggggacgagtncgggcagaagtcntcgaagcgggcgcgcttncagggggcgaacggggcgcncccggggggctnggcncccagcccgcccgcatncttcttgttgtttttttttttnttttngccagggtaatatttgtgcttncagccggcggcggacgccangcncggtnncggagcgncttggtcanagnaggggnagtnggnggaggcgcagagtcntggtggaagtagccgttcttcancgtggttancangtgagtgtttaggtcnagcacggtggtctggctgctgcagtgcaagccgaagtccgaaggggtagggtatgcgccccggtagaagccgggggaggaggcgggggccggggangcgggcggagaagcggcggcggcggaggggcggcccctgggggcgcggacangcggccggggcgcganggtcccgcgggcagagcgcagcggncgcgggcggcggcancggcangccagggcgcaggacccggctggagaggctccaagggctgcccgcggtggggcgcgcggtnggggctggagcg

SEQ ID NO: 715127 - DNA, 790 bp, Homo sapiens
  misc_feature (149)..(149): n is a, c, g, or t
tttaagagtaaatcgcctccttaggtacaaacagaaaagggtctttaattctaagggaggccattattaccttcaactcagagacacagtgtgggtcggtacttctgaaaagaattttgttggtttctcagctgtttttccacaaagcnacaggaagtctttatggttttttttctatttccagggttattgtgattggtttataagatttggtgggggtgcatcaccaatatatcttggttcttaagatctgatccccgtgttcacctataactgatgtgtgaaaactataaaaaccatgtgtgaaaccccggggttcttaaaataccagcatagattttatcagggtgttttgtccaaccggttattccagtgattcctccccccccttcttaagaaccgttaaataatgctgttgtgttagctctgagtagaaaggaaacgagtaaaacctctgtttggaggtaatattgggttgaattctgactgcccctttctagctggaccctttaaccaatcaccccatcttttttgtgtttctctaaagtcatttataccttaaatgtaattatagccactgtggggttctgttgagaattaagagctcacactatatatgtaaagtttcccgtactagtccccagaatttagaatatgctccacaccaagtaacagcattatataagtttatatttttgtgagttataagtactttgatatattctccttaatctgtaatcacctctataagtaagtggtaataataagcagatatttttgtcccccttta

SEQ ID NO: 715128 - DNA, 177 bp, Homo sapiens
acggtccatgcctatactcctttcatgggaaggccagcatcctaagactgcagtcaggtgagtctttttcaggcagcactttcttcataaccttccaacgtgtgaaatggccctttcacgacatgctggcgccggggattttttcttaaattaattttcacacattcctcaattcct

SEQ ID NO: 715129 - DNA, 1147 bp, Homo sapiens
  misc_feature (196)..(196): n is a, c, g, or t
gagaatcggtgaacgtggcgaactaggtaatcaagtgcaaggctgcggtcgcttgggaggctggaaattctctcatccatagatgcgagatatgacggtggcacaccccaaaggctcttgacagttgcgaaatcaatgatcatgtgctcgatgtgtggtttgccacaccagatgccatatattcctgaagtggagnctgattactctagagggttagtagtgcacgagtgatgttgtggggaaatgtagatggtgcttggaaatttgtgtgcaaagtgtcttgcgttgatgtggaagttgagtaaggctggagaggctgtggattgagacttgtgcattactactttgacatcgccacgagtggtgtggagaagggcgaaagttgtttgctgctagaactccgttgaaaaactaagcttatgcgcagaaagagtaatgaagatcattcgaaggggcatgaggtattgaatgctaagactggtgtacgcagtctgggattctacttgggaaaaggtgaatgaacagatgtttggcgattaccagttgctgaaaacacaagtcaacagtttttcttgaaataccaccagggtatgatggcctggagtattctcatgttatgcctacaacagttaagactccgttaaaagcaatccgttatgcgcctacaaggttgctggccgttcagtaagcgtttggtaggggcatttgtcgacatccgggggtctaaccgtgttggcttggtttgggtgacaccaaggtggcccaaaaggatttggaagggcactgggaattattgggtaatggtagcgccgggtggtttgggagtctggtgaagagagaaacgttcaagagaagttgggggaggttgtaattcgaattgaggggctgtgtaaaaaaggtggggatgggatggctttcccacgggacttcaatttgggggtgtgttgggatcatgttccaactttagaagaatttagagttttgtgcaaggggggccaaaagaaggaagttttggggagggccacgtggcaagtggtaatttaagggccctttaaggggaattattaaagagtaaaaccccaatgtcaatggaagttggggtcatttggataattgagctgttgtgtgtgggggtgtgggactgaaa

SEQ ID NO: 715130 - DNA, 140 bp, Homo sapiens
cattcaccagaccctgcaggcagaagcaggaagcagttcaactagttagagaaagtagaagaagctgttcttttcattttacttcttggatgcaccaagaccctgtctctaaataaaaaataataggcagaaccaggaag

SEQ ID NO: 715131 - DNA, 819 bp, Homo sapiens
tgctcccttgggctctagagaggaggcccctcttagccctcagcccctccttcctctctatcttaaagtaatttgatcctcaggaatttgttccgccctcatctggcccggccaaatcccgatttgacaaatgccaggaaaaggaaactgttgagaaaccgaaactactggggaaagggagggctcactgagaaccatcccagtaacccgaccgccgctggtcttcgctggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcttgaactggtgctgtatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaataaagtgcacgtgtttctggtaaaa

SEQ ID NO: 715132 - DNA, 232 bp, Homo sapiens
ccccactcctctccagccaaggttacagagtgagacactatcttaagaaaaaaaaatggatatatatatacatatatattcatttattaatttatttaattaattaattaaagggctgtaccttatattcttcttgattcctagcctttattggctctcagatcgccagagttgtaactcaatagtaagaaaccattttgttgaggtggtagtgattctacccggggagggg

SEQ ID NO: 715133 - DNA, 868 bp, Homo sapiens
ctagtcctgacttcacttctgatgaggaagcctctctccttagccttcagcctttcctcccaccctgccataagtaatttgatcctcaagaagttaaaccacacctcattggtccctggctaattcaccaatttacaaacagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 715134 - DNA, 999 bp, Homo sapiens
  misc_feature (838)..(840): n is a, c, g, or t
tgctcccttgggctctagagaggaggcccctcttagccctcagcccctccttcctctctatcttaaagtaatttgatcctcaggaatttgttccgccctcatctggcccggccaaatcccgatttgacaaatgccaggaaaaggaaactgttgagaaaccgaaactactggggaaagggagggctcactgagaaccatcccagtaacccgaccgccgctggtcttcgctggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcttgaactggtgctgtatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaataaagtgcacgtgtttctggtaaaaaaaaaaaacaaacaaacannngaagaaagaaaaacaacaatccacaaaaatgggaaaaaaaaaaaaatagctcgggggcccacaaaaacaaaactgggggggcgcaaaatagtttcacaaacccgaaggggtccacaaaaggggggggtaacctctgttttttttctagctacccccccg

SEQ ID NO: 715135 - DNA, 407 bp, Homo sapiens
  misc_feature (288)..(288): n is a, c, g, or t
  misc_feature (295)..(295): n is a, c, g, or t
  misc_feature (354)..(354): n is a, c, g, or t
gtaattgaatgggtcgagatgtcgacgtgagtgagtgggggtatgtttgggaggcgtaggatggtactggtatatctaatatctatatttctctagtttagctttataggttaaagtattagtattagaatgtacacccagcccagccccaaagagaaagaagagagtaaaaagttgaagcggtggtttgcactccgccttgcaaatagcagaggttccgggctcactccttcctggtgggaaaggaagatgcctgtcctctccgtggaagaccctgggccctcaccncaggcancagtttgcgttttgaaaggttattgggtcccttcctcgggctgtgttcttgctggtgancaaaagtgttgcctgcagaaataaaatgcagaacgtactctacgataaaaaaa

SEQ ID NO: 715136 - DNA, 134 bp, Homo sapiens
gtattcactcgaggctcggtaccctcgataagggccaagctgctcatgaaccgccaggaactgacctggtgtttgtgctctcttgccaggaatcccaatgctttcactcttatctaccctttggccttatcgag

SEQ ID NO: 715137 - DNA, 427 bp, Homo sapiens
gaggtggtccctgatctcagggcggggagagccaatgaggagacggagccatagcacgcggctctcaggtgggggatccttgtccccctccacaatccctctccccagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaataaagtgcacgtgtttctggtaaaa

SEQ ID NO: 715138 - DNA, 101 bp, Homo sapiens
acggccgtgtattactgtgcggtagagtccttagtggtggtagctgctcctcagcccgggagcgaaagggccgataattactactactacggtatggacgt

SEQ ID NO: 715139 - DNA, 106 bp, Homo sapiens
tgactctacaggatcctatgtgagcagctggcagggacgagggtatggtgagaggagaagccagcttcccattgaagatcagcctcaggtaaaggtcagcttcggg

SEQ ID NO: 715140 - DNA, 368 bp, Homo sapiens
cgggggtttttttaccccttcccccccgcaaccattttcaacaacatggccaaaatttccgaggcccccaaaacggttgaacagcttaagctggaggttacacttgcccgcattaaggttttccaggcaccagcggaatttttggcttttttggagacgcatgccaaaaattacccgctggttacgccagtaccccccggggagaacccctttcgggacaagggccttttttttgttttgttttgagccctccgggcaggtttccctcccctgcccaagtatggatcccataaacttggtaactttggtggggcctgtgcttttagggggatttaggcccgcccaaagtttggggcccccgttgggga

SEQ ID NO: 715141 - DNA, 755 bp, Homo sapiens
  misc_feature (168)..(168): n is a, c, g, or t
  misc_feature (416)..(416): n is a, c, g, or t
  misc_feature (538)..(538): n is a, c, g, or t
gaagaggaggatattggtggtggaggacctggatatggcaatacaggagtgggggctacggaggtggttatgacaactatggaggaggaaattatggaagtggaaattacaatgattttggaaattataaccagcaaccttctaactacggtccaatgaagagtgganatttggtggtagcaggaacatggggggaccatatggtggaggaaactatggtccaggaggcagtggaggaagtgggggttatggtgggaggagccgatactgagcttcttcctatttgccatgggcttcactgtataaataggagaggatgagagcccagaggtaacagaacagcttcaggttatcgaaataacaatgttaaggaaactcttatctcagtcatgcataaatatgcagtgatatggcanaagacaccagaagcagatgcagagaagccatttgtgaatggattggattatctaataacattaccttactgtggatgaaggattgtctaaaaaaatgcctttgagacagttgcttaactttntaattgttgttctttctagtggtctttgtagaatgtttaacattccttttttgaaatgtaaatttgaagtttaggtgacagtgaacctttttaagattttctcaaattttaaagcttttaccagaacatgtgtataaacataacttttccttaaaaaattaatgctgttatagtaagaactcttttcatttatattaataattcatctaatgaaaat

SEQ ID NO: 715142 - DNA, 468 bp, Homo sapiens
  misc_feature (25)..(25): n is a, c, g, or t
  misc_feature (27)..(27): n is a, c, g, or t
  misc_feature (34)..(34): n is a, c, g, or t
  misc_feature (45)..(45): n is a, c, g, or t
acgcgaccgctggcttgaacgcttntngaactgncgctggctgancttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccagaccaacttagattgtgccccaaaaaacttgtcatccctactatcttctggctagtcatactcctattcaccgttctcgggtaccgagc

SEQ ID NO: 715143 - DNA, 891 bp, Homo sapiens
cgttcctgggcctggagggctgctttggggcaggaaactttggccaccaggcctctgacctgcaccaggagacactgggaggtttagtccccaaacccgcacagagcaggactgcagcctgaggaaagagcaaggatttcaggagagaggcctgcgacaagtgagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 715144 - DNA, 876 bp, Homo sapiens
ctcacaaaaaaaaaaaagatacacttatttgaataagatacctcttatcttggtgtcggtaactatttgtaaatagctttcaaaataattgaactttttttttaatattccctaaaaaggagttcatggtcatgggatagatttgggtatgatttagtcatgatttaaaccatgaccataaaataccccatcatcgcaggacaacctgaatttacaaatatagtattattatctaatagctatttagtggatctattgaataattgctgtgctgatgtcagacattgtcctaagcactttacatgtattttctctacgtactgtagtactgactaacaaccttaagaattaacaccattatccccatttaacacgctgaggagagtctcaaatgacagtgaacatgacttgccaccacgtctataagttcgataacatgcaaactgcctggatttgaaccccaaattttctcagacttccaaacctcaggacatactataccattatatctcttgtcctagttgtgcaatgagtaggttagaaaaacctactacaagccagatttaagtagagcaaatatcattcatgacgaaatgcatattagtgtatattcttcatatagccaatttaaacggattatagtaactatgatacctatgaacaacgagtacgtttaacattaggagacttatagaaaccgtaataacaaaattctgtggattaagtagccttgttaccttcacaggatctgacccgttggtattgctcaacttctgcctgcaatgctacaggataacaagtcataccaaatttgcgaatttgtgtttggagttaaacaattagcatcttaatcgctatatatagtattataaccta

SEQ ID NO: 715145 - DNA, 544 bp, Homo sapiens
tgttctgagggtccccgaaggctggtcacaccggtacccatggatctactgagacggggatcgaacaggaggctttatcggctgcaaaactatcctagacttcagaacagaataccaatcacatagtgaaaattcctttgacaaaacacaaagatgttttgtttttaatgggagtttttttagagttttctttttttaaaaaaaaaaaaaagaaagttaaggccaacgggcaaactcacactgcctgacgcagggccgggtttctcttccttgagggccttttacagatgtcagctttcacggtgagcggcgtgggccaacgctgctcacggggcagaccctggtgtcttccaaagctagctacactgtcagatccttgggcatcgggaaaattgagaagatggctgtccatggcccagttcgaggggccagggcagagaaaatctgggagaagggtctacaggtgcgggagtatgagttacgagaaaacactttctcagatacgggacacttgggttgggggatccatgaccacatcgatctg

SEQ ID NO: 715146 - DNA, 656 bp, Homo sapiens
  misc_feature (23)..(23): n is a, c, g, or t
gctcggtaccccttgcatgtacnggggagaaccatcccagtaacccgaccgccgctggtcttcgctggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcttgaactggtgctgtatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaataaagtgcacgtgtttctggtaaaa

SEQ ID NO: 715147 - DNA, 952 bp, Homo sapiens
cgttcctgggcctggagggctgctttggggcaggaaactttggccaccaggcctctgacctgcaccaggagacactgggaggtttagtccccaaacccgcacagagcaggactgcagcctgaggaaagagcaaggatttcaggagagaggcctgcgacaagtgagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtgaaaaaaaacaaaaagccttcagctacttggccattccccttaggggtcggatacaatctgcc

SEQ ID NO: 715148 - DNA, 943 bp, Homo sapiens
gggcaggtggattgcctgagctcaggagttgaagaccagcctgggggaaaccctgtctttactaagaggacaaaaaaaaaaaaaaaaattagctgggtgtggtggcacacgcctgtagtcccagtactcaaaaggctgaagcttgaaattcgtttgaacccaggaggtaatgttgcgtgaaccgatttcaccccatgtgattcagcctggggcaacagagcgacagagagagactggtgtcttccaaaaaaattaaaaattattaaataagattaacattaaaaggctacactataattataagcgcattccgtgagcgtggcaattgaaaaccgagaaaattctgcagaattttaagaaacttaaatgtgaacaaagagttttctgaaaaggtaagacgagttggccaaagctgtggctgtgggtgctttcgccctgtgatgatttcttgtaagagcccttgtggaagctttggggctttactcacttaaaaactggcttgggacatatggtgagcggggccttgaaagcgtggggttgcgcccttaggtgaggaatgatgtaggaggcccttgcataaagggggatcaaggcttagggaaacctaattggtgagcatttagcgaccatgagctaaccctcacctgagttgagagtctgaatccatactacctatgtcactctgaaaaaccttgagccagacagatggttcaatttaaaacgggatctcaggggtctgacagtgtccccagggtacccgagaaaaggccaggaaaggtcttctctgggaaaagagaagtccaactcagggcacaaagaattcccgtggaatacaggttccagtggaattacgcccacgagcttaaataatacttaaacgggcattattattatgccaaaaaagctacttggaaaggataccacaagggtaccaggcattgag

SEQ ID NO: 715149 - DNA, 1031 bp, Homo sapiens
cgttcctgggcctggagggctgctttggggcaggaaactttggccaccaggcctctgacctgcaccaggagacactgggaggtttagtccccaaacccgcacagagcaggactgcagcctgaggaaagagcaaggatttcaggagagaggcctgcgacaagtgagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtgacaaaacacgaaaaagcgggggggcggtacaattgccaagtagtgataatacggccggttacagcgagggaacgtggtccagctgaaacctttgcgtggacgccgatcccacagcccagcggagcgattgcggtgtcttgg

SEQ ID NO: 715150 - DNA, 282 bp, Homo sapiens
  misc_feature (33)..(33): n is a, c, g, or t
  misc_feature (79)..(79): n is a, c, g, or t
  misc_feature (102)..(102): n is a, c, g, or t
  misc_feature (126)..(126): n is a, c, g, or t
  misc_feature (137)..(137): n is a, c, g, or t
ggtcctgtgtttgatcggaactcatagctatgncctgatagaggtgattaggaaaatgttgtttgttttaaagttttcnccagttattataaatattatatngtgaatttggaaaaatgtggaaanggtagaaggangaaatttcatcatcctcaagtttctaatatttgctgtttctatagcaaatttgatgtatttatttccagaccttgttactctttttttttttttttaaagacggagtctctctattgcccaaggatggagtgcaaatggtgcaaa

SEQ ID NO: 715151 - DNA, 1126 bp, Homo sapiens
  misc_feature (902)..(902): n is a, c, g, or t
  misc_feature (913)..(913): n is a, c, g, or t
cgttcctgggcctggagggctgctttggggcaggaaactttggccaccaggcctctgacctgcaccaggagacactgggaggtttagtccccaaacccgcacagagcaggactgcagcctgaggaaagagcaaggatttcaggagagaggcctgcgacaagtgagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtgaaaaaaacaatntatataaaatncccctgttggccgcctggcccaatcgactttgactcaagcaagcttatcatgccggcgcattagagctcattggccaattggcctatatggagggtattgcaatactggccgcgttttaacacgccggactgggaaacccggcgttcccaactttatccccttgagcccccctttcccagatgctattaccgcccccccatccccttccgggg

SEQ ID NO: 715152 - DNA, 337 bp, Homo sapiens
atacagtgccaggatacctctcattatagcactacaatccttttttgggggggactggattatttattttgagacagggcctcactctgccacccaggatggagtgcagtggcacgatcacagctcattgtagcctcgaactcctgggctcaagtgatccttctgccttagcctcccgagtatctaggattacaggcatgtaccactacacccggctaatttttatttttttacatttttgtagagatggggtcctgctatgttccccaggtcggtcagtcggtcatgtggtacttcatttaggccaggtatggtgcctcggcgtgtgcagggtacc

SEQ ID NO: 715153 - DNA, 220 bp, Homo sapiens
tgctgctgccccgggtgcagaataccagcgtgtcattgcagagagaacgtcgctattgaacctgcatttaccaggaagactctgtgcattctgctgctgagtcttgcagaacaagaaaaatgagctctagaatttgctttgacagctacagaggaattgctattactcctgtaccttctgctcgatttcctttcctcatccccgatgacatgccttgggt

SEQ ID NO: 715154 - DNA, 299 bp, Homo sapiens
tcaggctggcaggactcatggatcagatctgagactggagggagaggcatttcgggtagcctagcgagggcgactggcggcagctgaaccgaggaaggcaaggttgtttctccccacgctgtgcttctgtgttcaggtgcgatatcacaattctcatgtgaacagtgatcacccatgcgctgcccttgatgatcaacggttgggtgcttacgttgatcaggcgcaggcaagttctgtgttccttgcctcttacatacgcatgacggtcaggctctgtatcccccctttttcagaggctt

SEQ ID NO: 715155 - DNA, 282 bp, Homo sapiens
ggtggattgcatacagcctggacacatggtgaaaccctgtctccacaaaaagtgcaaaaattagctgtgtattgaggcacacgcctgtggtcccagctacttgggaggctgaggtgggagtgattgcttgagcccgggaggcgaagtttgcagtgagccaagatagtgctactgtactccaccctgggcgacagagcatgaccctatctcgaagggaaaaaaaaaaaattctatactctggtttcttctggctttacaaagaagggctactggatccctgcc

SEQ ID NO: 715156 - DNA, 691 bp, Homo sapiens
  misc_feature (20)..(21): n is a, c, g, or t
  misc_feature (146)..(146): n is a, c, g, or t
  misc_feature (163)..(163): n is a, c, g, or t
  misc_feature (178)..(178): n is a, c, g, or t
  misc_feature (199)..(199): n is a, c, g, or t
  misc_feature (576)..(576): n is a, c, g, or t
  misc_feature (580)..(580): n is a, c, g, or t
  misc_feature (583)..(583): n is a, c, g, or t
  misc_feature (585)..(585): n is a, c, g, or t
  misc_feature (599)..(599): n is a, c, g, or t
agagcgcccttgtcccacgnntgctggggccccccagtagccatggctccggtgtccggctcacgcagccggatagggaggcctcgggctcggggggaagacgtcgcagttcgtcgaagagtccgaagcccagcaaatctgcccgntccccgggggccgccgntctcgctcgactctntgctctcggtccggggaccgngaatggactcacccatcagctgggtggcctcagccaatggctcccgaaaccagtcctaccgctcacgctcgcggcgcgtctagagagcggcctctgcgcccggggcatcccctttcgtttctgcctcctcgtcaggtctataacggaggtactgcgggcccccttacgggagcgacaagccttggcctagcctcctcgacaggagagggaggagagctgcggaagaagagattaggtgagagagagagatgtggcgaattggggagctcctgaagtatggggactttctccaaagaatcctgaaccagattctgtgaactacaccatgtggggatgagagcaagaaaagcactacttcaggttctacttcagaagangacnagnangaagaagtctagcngttcaaaaagaaagggtccagaaaaaggggaacggaacaaatcttttgacggaagccataagagtttctgacgatgcgacggtgactctgtt

SEQ ID NO: 715157 - DNA, 415 bp, Homo sapiens
  misc_feature (404)..(404): n is a, c, g, or t
agattgtttggtgtggctgttttctaacaagtcatcaattaatattaaaactgtcattcttccatcttcaacttttcaagttagttttgctgagaggtattcatataatctgttaagacatcctaggacaggccgggcccaagttgtcacgcctgtgaccccaacactctgggaggccgaggcaggtgcatcatctgaggtcgggagtttgagaccagcctgaccaacatggagaaaccccatctctactaaaaatacaaaaattagctgggcgcagtggcacatgcctgtaatcccagctactcagtaggctgaggcaggagaatcgctggaacctgggaggcggaggttgcggtgacccgagatcacgccattgcactccagcctgggcaacaggagcgaantccgtctcaaa

SEQ ID NO: 715158 - DNA, 392 bp, Homo sapiens
  misc_feature (20)..(20): n is a, c, g, or t
  misc_feature (37)..(37): n is a, c, g, or t
  misc_feature (267)..(267): n is a, c, g, or t
aaatccccttattaaagggncccctaatgccttcccncttgttgccttttaaaacaacactgaaaataaatatccttgcctcattagtcccaatttgttctttaagattaaaaaccccaggccggacatggtggctcacacctgcaatcccagcactttgggaggccgaggcgggtggatcatctgaggtcaggagtttgagaccagcccggtcaacatggtgaaacctcattctctactaaaaatacaaaattagccaggcatggntgcatgcgcctataattccagttactcaggaggctgaggcaggagaatcacttgaacccagaaggtggaggttgcagtgagctgagattggccactgcactccagcctgggcaacatgagcgaaa

SEQ ID NO: 715159 - DNA, 172 bp, Homo sapiens
tttttttgaactggtaatagaatttattcaaatgtgccttatatggcgctggggcttgcatggtgctcttgatatataggcccggacatctgccagtttttcttgagcatgacaccaagaagttgacagccaggtgaatgtatccagctcatcgtctgtcatctcacgtgac

SEQ ID NO: 715160 - DNA, 712 bp, Homo sapiens
attgctttctagaaatgacctaatgtccccaaccacttgtagtggcagatcactgtttcacagcatattttctcccaaggaaagtattcaaaagagactgcaactaacaagactcttatttcatcaaaatttaaatatttctgagttgtatttttaatgcctctttcttttctgcctaaatgcttagaaattataaagcaaaaaaaaaaaaaaacagcaacaaaaaatcgaagcagacaaaaaaggcactttttcagaaacattcaaattccttattgaagaagaggagaagataattggggaaatttggacatttggatataaatttatattggtaatgtgtatgtcggttaattgcaccgggaatattggacttaggtgagtatcagttaacatcctgtattatatagtggacttcaaacataattggcaatcatctggaacttggatggtcagggggagatttggaaaaaatatttagttattccaaattcatatgggtccaaaagtactcagtttctggctgaataatattttcaatttcaaagggtttggtcccctctgtgctccattctgaggctcaagagctttaatgccagtatgttttctgagttaaaataaccacttttagattgagaaaagtggttgttttcatacagggctaaacattgtagataacttacttgtttgtttgcaaacacaaaaaaaggcg

SEQ ID NO: 715161 - DNA, 93 bp, Homo sapiens
ccaatggttggtcactgtgagatcatcccccacagccagtgcaggaatccaggtagtgggggatgatctcacagtgacaaccaaagaggatcg

SEQ ID NO: 715162 - DNA, 565 bp, Homo sapiens
ctagaggaccgcaacttcgacggacattcatcctgacagtagtacctcagcttccagaatcacttggaacagatcagctcacacccagtctctcacaagtgttcattccataagagtggttgactaaagtgaatgcgtccgtctagtttatttgcatagaggtgtttgtagtattctctgatggtagtttgtatttctgtgagattggtggtgatatcccctttatcatttttttattgcgtctatttgattcttctctctttttttctttattagtcttgctagcggtctatcaatcttgttgatcctttcaaaaaaccagctcctggattcattaattttttgaaaggttttttgtgtctctatttccttcagttctactctgattttagttatttcttgccttctgctagcttttgaatgtgtttgctcttgcttttctagttcttttacttgtgatgttagggtgtcaattttggatctttcctgctttctcttgtgggcatttagtgctataaatctccctctacacactgctttgaatgcgtccgtcgaagttggggta

SEQ ID NO: 715163 - DNA, 173 bp, Homo sapiens
gaggatcaccagaggaagaatgtgctatggcagccgtcggcatagcgcatggctggctaggtgatctaaatgatctatggtgatggtgggcgggttatcagtgattattacaagaatgcataagattcctactaatgttatttatccaaaaaccttactgcacatcttccaat

SEQ ID NO: 715164 - DNA, 100 bp, Homo sapiens
  misc_feature (11)..(11): n is a, c, g, or t
  misc_feature (43)..(43): n is a, c, g, or t
  misc_feature (45)..(45): n is a, c, g, or t
tggggcaaaantgtccggccaccccccgggcaatctgttggcngngtctgtctcttggctttgtcacttttccttttcttaaaaacagtgccatgccaat

SEQ ID NO: 715165 - DNA, 667 bp, Homo sapiens
ctggtatcttagtcaagtaaatgatagaatgacagccaaagaaagggaaaaattccctaccggccagcaagctgtctccagtataggatccccactgggacctcaactcagatcagggccactgcagtcaaaacacaggttgacctgttttctagaaagactaaggagaattaggaaaaagcccatgaattattcaatgatgtccaccataactcagggaaaggaagaaaatccttctgccttccttgagcagctataggaggccttaagaaaatatactcccctgtcacctggctcactcaaggttcaattgatcctaaaagataagtttattacccaatcagctgcagatatcaggagaaagctccaaaagcgagccctaggccctgaacaaaatctggaagaattcttaaacctggcaacctcggtgttctataataaggaccaagaggaacaggcccaaaaggaaaagcaacatcagagaaaggctgcagccttagtcatggccctcagacaaacaaaccttggtggttcagagatgacagatggagccggccaatcacccagtagggctttttatcagtgtggtttgagggacactttaagatgtctaatgagaacaagcacccccagtcatgtcactatgccgagcaatcctgggcacctg

SEQ ID NO: 715166 - DNA, 781 bp, Homo sapiens
atctgcatccacacgcaatgcgcacgtgagcgtggaggtgtcaggcggaggcacctgctcacctgcatagtggcacgcatgtgtgagggacggctgtaatggtggctatcctgctgaactcttggaactccgtggacaacaaacaggcctggtttctaggtggcctctatgtagatcccgatgtagtggtgcatggaccgtactccatcacctccctgtgagcaccgacgtcaacggctcccggcccccatgacacgagtgggagggagatactcccgcaagtgtagcaagatctgtgagccatgtgctacaggcaccgagctacaatagcaggtagcaagacactacggaatacaagtgtcctactaggcgtctccaataggcgagaaggacatcatggccgtagatctactaataaacggccccgtggaggtgagctttcatcgtgtgtaattcggacttcctgatctacagagtcaggagtgtaccaaacaggtcaccggagagatgatcgggtggccatgccatccgcgatcctgggctggggagtggagaatggcgacaccctactggcgtggattgccgaactcctggaagcactgactgggtgtgacaatggcttcgtcttgaagagtacgtcagcaggacaggagtcactgtggacatcgcagtcagaagtggtggctggacttccacgcaccgatcagaactggggaacacgcatctactctgccgagggtcctgtagttgccagtacctgaggggcgagatgggggtagaa

SEQ ID NO: 715167 - DNA, 707 bp, Homo sapiens
  misc_feature (5)..(5): n is a, c, g, or t
  misc_feature (83)..(83): n is a, c, g, or t
  misc_feature (137)..(137): n is a, c, g, or t
  misc_feature (168)..(168): n is a, c, g, or t
  misc_feature (172)..(173): n is a, c, g, or t
  misc_feature (178)..(178): n is a, c, g, or t
  misc_feature (180)..(180): n is a, c, g, or t
  misc_feature (182)..(182): n is a, c, g, or t
  misc_feature (184)..(184): n is a, c, g, or t
  misc_feature (204)..(204): n is a, c, g, or t
  misc_feature (272)..(272): n is a, c, g, or t
  misc_feature (278)..(278): n is a, c, g, or t
  misc_feature (280)..(280): n is a, c, g, or t
  misc_feature (285)..(285): n is a, c, g, or t
  misc_feature (289)..(289): n is a, c, g, or t
  misc_feature (291)..(291): n is a, c, g, or t
  misc_feature (336)..(336): n is a, c, g, or t
  misc_feature (339)..(340): n is a, c, g, or t
  misc_feature (347)..(347): n is a, c, g, or t
  misc_feature (352)..(352): n is a, c, g, or t
  misc_feature (362)..(363): n is a, c, g, or t
  misc_feature (375)..(375): n is a, c, g, or t
  misc_feature (379)..(379): n is a, c, g, or t
  misc_feature (381)..(381): n is a, c, g, or t
  misc_feature (394)..(394): n is a, c, g, or t
  misc_feature (396)..(397): n is a, c, g, or t
  misc_feature (400)..(400): n is a, c, g, or t
  misc_feature (405)..(405): n is a, c, g, or t
  misc_feature (422)..(422): n is a, c, g, or t
  misc_feature (429)..(430): n is a, c, g, or t
  misc_feature (433)..(433): n is a, c, g, or t
  misc_feature (437)..(437): n is a, c, g, or t
  misc_feature (447)..(447): n is a, c, g, or t
  misc_feature (482)..(482): n is a, c, g, or t
  misc_feature (488)..(488): n is a, c, g, or t
  misc_feature (499)..(499): n is a, c, g, or t
  misc_feature (502)..(502): n is a, c, g, or t
  misc_feature (509)..(509): n is a, c, g, or t
  misc_feature (522)..(522): n is a, c, g, or t
  misc_feature (540)..(540): n is a, c, g, or t
  misc_feature (547)..(547): n is a, c, g, or t
  misc_feature (559)..(559): n is a, c, g, or t
  misc_feature (576)..(576): n is a, c, g, or t
  misc_feature (592)..(592): n is a, c, g, or t
  misc_feature (598)..(598): n is a, c, g, or t
  misc_feature (608)..(608): n is a, c, g, or t
  misc_feature (620)..(620): n is a, c, g, or t
  misc_feature (644)..(644): n is a, c, g, or t
  misc_feature (702)..(702): n is a, c, g, or t
gggcnggctggggttcactgatgtctactggaggcagcttccatgccttctggggtcctgagtctccatggcttgtggggtcngggtcccccctggattagtggatggccagagtggcatagacactgggctcagcnggagaggccccttcctgggatggaggaggcncagnngcctncngncngagggtaaagctgtgcagcngggcgtaggtcacatcctggggggcttcagatgcagcagcctcagtgtccatctgtctgtcctcttcngcctgncngtccnttgngnccaggaattccccagacagtggggagggaggagaggccatttcanacnnaggtctngagtntttcaccttnncatacgtcactncctngnggtcttcatcgtntnngcnccgantttccatttccaccccntcctcannctntttntctatcacgncagcccagaagtgttctccctggacgtcagcagcngggctngacctcctctntangcccccntccttgggctctngctcggcatcccctggangacgttngaaatcagcctntgtgctgggccaatttncttttttttcccttantccatnattttattantattaataatantatttatataatcattatttatancaccaatacccctatcattacctcccatttccttctcataacaattttttttacttanccttt

SEQ ID NO: 715168 - DNA, 969 bp, Homo sapiens
caaaagacgttggaatgcccattgcaatgttagcatgtacgacagatggggcgcatgaaacgtcgccgcgaggtgatggccgactgtttagcaactatctcatcgactatactacccaaagagcagttgaagaagacatagaattcgtatgctaggatatctgtcacataatcttgcatgcaggtattcctaaatctgatcgacagcagatatgatctaaggacaggagcagctagctcattgatgtgggaataaatagagttctagagatacgcttgtaacttagtcaaataccgctagagttggtatggaggatgtggattcggataggagtacagacagacataacgcgtgggctatatcactctcagttcctggtacggtgcttggcctcctagtgactagtggcaaggctaatgaagaataccatgatcgctgtcaacactacggtgctgaggcttgaagagcgagaagtgctgaagtctaagagagcttggggtagccacttaattcatctacgtgtgtcttcttgtgtcatcaaagcagcactccatggccagcatcaagaagcataagcagtgccaatacgacaatgcaatatccaaatttattctactgcaactggttgatccgtgatgccttgtattaatccgaaagcttacatgggtgggctgtttctgcacatagctctgacagatatactcatcagggagcataccacttatcatgcagggccctgagatctagccaggagcagacataaactagtgattaatcatgggacgactttaccatatggacggatggatgctataacttagactaagcagctcagggacacatccgccatatcgagggattgcatttcccagagtgactattagccataaggagatgataccgcatggtaccgtaaccaaaaccttaggaggtccactgatggaacacaggaaaggtgtgcttagagaa

SEQ ID NO: 715169 - DNA, 110 bp, Homo sapiens
tccactgttgacacttcagtcattggtagcagcaatgcagcattttctccagttctaaatggatctgttttatccatgcttctttctgaccatgtctgatcagtctgtct

SEQ ID NO: 715170 - DNA, 1731 bp, Homo sapiens
  misc_feature (994)..(994): n is a, c, g, or t
  misc_feature (1318)..(1318): n is a, c, g, or t
cacagagcgacgattagcaaggttcccactagagggcttgctctcctctttcacctgctctgttgctacagggatactaaccggacgacaggcatgaatctgactacagcagtttagctctttgtggtgcctggtacttagttgttgctatagtagcgtcgtgtatcaccgcgcaggtcgtcgtggcgaacggtctgccctgtcaatgcaactaccaggagagatgacatattccagcatcatgtctgcagttatcccagcgcagaacccaactcaggtgagtcctgactcagtatgtagacgaggagcaaggcgcccagtgcacctaggggctacgacttgcgagccgaggtgagcttagcaggcagagtgatcctgggacctcccagcggcggtggccctaccagagtgtttcgtgacaagtcggtatcgatgagatacggcataagatggaacatggagactacactgttcgtccatacatcgtcagcgactcgtacatttatggtaagacgcatcaatcgctggaaatggagagccttgtacgcagggtagagtggtaactggtgcgtgtattctctgcgaagggcgccatagacgtgcacatacgggagaatgtcaaggttgcgtggcgccatggatgaatatggcgcagatgggaatggcgcgacgcatttccgccagacatgaacggctccgtgcatattgtttgacatgaaaccgtttgtgccgggcagtactattgctgaatgggttttccgtatatacatcctggagttgcaagaagtgggagactcagcacacatttacgtaggaactaaaattctttgagcgggcccatggggggagcccttttaattaacaccctgtggggttatgagatattcgcggaagccccaaaaaagttacgaccgtggaatcgcgcggaagaatcaaccttattgagtacatcttagtttccaatggacacccaatccttttacaagacaaaagnccaattgtaatccccatagggctaagttgcccacaggctgatgggaatgtgctgctgggcacagcgcgtttgcacacgggtcccccgagtgactaattttgccagcacacggggttgatcattttctatggggggggcccgcacaaatatgtgtcttcttgtggccattgcgccccacatgagaagttaaacagttggttcttccaacagagcgatgtgttgggttggcgccacacagaaagtttgctcccccaggcgtgcgatataagcgcaggatctctcatacgagagaattatgcatcacaatattacccgccgtgtganaaaaaaaaagaagaagggggcctggagaaaacacgaggcggagtattggccaccacatataggggggagaagagaccccagaccggtcacctgagagaagagaaaagatccaagacgaaatgaaggaagatgaaaataacaacgagtacaacatagagcagagaaacagcggaaaggagaggccggagagcggagaacaaaatgcagcaccaacaaagaaaagtagacaaaaagaacgatgaggagaagcagaagagacgagtaggactctcacggtgaggttctacactagcttgtctctctcaactactaaccatagccaagacgagacaacgaagaacacacagaagaacaacgtcacacaaaacacagagagagacgacgcaaagagagaaaccaagataaaaacaacc

SEQ ID NO: 715171 - DNA, 229 bp, Homo sapiens
  misc_feature (114)..(114): n is a, c, g, or t
  misc_feature (154)..(154): n is a, c, g, or t
  misc_feature (170)..(170): n is a, c, g, or t
  misc_feature (177)..(178): n is a, c, g, or t
  misc_feature (217)..(217): n is a, c, g, or t
ccaatcagcactttgtaaaatgccccaatcagcaggattttaaaagtagacaatcccagggaggattgaaaaaaagggccctttgatagggcaaaaacggaacatgggaggggncaaataagggaataaaatttggcccccccagccagcagcngcaacctgttcaggtngcctgcnnctgtggaagctttgtccttttgcttttcataataaaccntggtactgttca

SEQ ID NO: 715172 - DNA, 417 bp, Homo sapiens
tgctgggattacaggcattagccaccatgcccagcccgaaatcttgctctctctttttttttaatgcaaaatcactctagtttctttggtttttttgagacaaagtttggctcttttcactcaggcttgaatgcaatggcacgatctcggctcactgcaacctctgcctcccaggttcaagctattctcccacctcagcttcctgagtagctgggattacaggcacctgccaccacacccagctaatttttgtatttttagcagagatggggttttgccacgttgaccaggctggtctcgaactcctgagttcaagtgatccgaccacctcggtctcccaaagtgctgggattacaggcgtgagccactgcacccggcgttttatgttaaaaatagggtaggaaggtaaatggaaat

SEQ ID NO: 715173 - DNA, 320 bp, Homo sapiens
tgtcacccaggccggagtgcagtggggtgatcatggatcaccgtagccacaacctctggggctcaagcaatcctccatctcactcctccaccaggtagctgggacttcaggcacatgccaccatgcctggcttcaatactgtttttcattaggggaatgtaaattaaaaacagtgagataccactgcataactaccaaaatggttaaaatccaaatcactacaactccaaaagctgaaaggggagcaataataattctcactcattactggtgggaatacaaaatggtacagccactttgagattgcggtgataggggta

SEQ ID NO: 715174 - DNA, 234 bp, Homo sapiens
cccagttttcgttcctcctttgtttgggtggggttgcctttttggttgccctcttagggggttgtttccccccccttttgccttggccttcccaaaggccccttcccttccaagttgtaccggaaattaccgttctggcctttggttttaaaaccaggcggtttttcctggaggattgtttcttgttttccctgtgggttattctttggattttaaaccggcttaaaatttcca

SEQ ID NO: 715175 - DNA, 384 bp, Homo sapiens
ctgtatacggggagttcccaaatttccctgagcctcacttccttgtctgtcagatggtgatggcaggatctagatcatgcctgcaaagagctagcctagcactatatgtgggaatgaaggacagtttggattcacagggttataggatccgagggttcttatgcaagcataagaggtgcctttgcagcatctccaacatgaacttgcatgcttccagagacagggagctcagttcttcttaaggctgcctgctccatccttgggcacttgggagtgttggaaagttcttccttatggtgataccggctctgtctccggccccaggaggcagaccagctcctctgcagatgaagggcagggcaggcactgaaagccaactctggt

SEQ ID NO: 715176 - DNA, 479 bp, Homo sapiens
aacaaatttttatatttataagcacaatgttgtacagcagatctctagcacttaccttatataagtgaaactttatacccattgaacagcagctccctacttcccctctcgccagcccctggcaaccaccattctatgcttctatgagtttaactattttatgtagtatttgtctttccttcacttatcataatgtcctcacgatttgtccattatcctgattcatcaattctgtcacatatggcaggagttccttactttttttttttttttttgagacagagtttcgctcttattgcccaggctggagggcaatggcacgatctcagcttaccacaacctctgcctcccgggttcaagcaatgctcccgcctcagcctcccaaatagctgagattacaggcgcacaccaccacacccagctaatttttgtatttttagtagagacggggtttcaccatgttggttaggctggtctcg

SEQ ID NO: 715177 - DNA, 449 bp, Homo sapiens
agcattaaaaaggaaagaggtaacgtcctttccagggacatggatgaagctggaagccatcatcctcagcacataacacaggaacagaaaaccaaatactgcgtgttctcactcataagtgggacttgaacaatgagaacatatggacacagagagggggaagaacacacaccagggcctgttgggggtagagggtgaggggagggaacttagcggatgggtcaataggtacagcaaaccaccatggcacatgtatacctatgtaacaaacctgcacattctgcacatgtattccattttcttttagaagaaataacaagaacaacaaaaccccccaaaagtattccttttattaatccacaacttaagtaaaattacacatcttacgtctctgtttcctaatgctttggattcatttaataaaggcctattgcttttttgtttgttaa

SEQ ID NO: 715178 - DNA, 1274 bp, Homo sapiens
cagcctgagcagccacgcctatatgggggcctgggcagccatgcactggctacccggtggcagcatctattgcccccaacggatgggctcacatccgatgcacaggacatgcccaagcacccccatgatgtgcctaggaacctgaactagcatccagagacacctgtccatacacatatccacggtatccagaacccacagtggacccaatgatccagtgagaacagccgagcagccgagagattgtcaagccgcatgaccacaaaaccagtgcaaccagagacaagccccaggcacacaaacagcgccacaagcagcaaggaaccacaacggcaaaccgagagacaccagaccctgcggcaacgaacacgcaccagacacgacacatgcattgaaacccagaaaacaatacaaacacaaacaacaaaaccaacgaaatcaaaatcaaaaaaacatacaacagaaaataaacacaacacacacaacacacaaacccaaaatcaaaaatcatacacatacacaacacataaacaacaccccgcacacgactacaacacaccgagtccaccgacagcaccgagagagcgcgaacgaaagtgacagcgaacaggaagccgcaaagaaacgacataggaccagagcgcagcaaccacgcgtgcaacacaaaaacacacacacaatacaaccccagcacgacagcaacactacaaacacacctaatcataataattaccagaccacgcaacgtaaataactctgcacaagataacactcaataaattataaatcacaaccaccaactatctacacaccacaacaaacctaaaaaaaaataaaatcactaccatactacacaccaaaaccaacaacaccatcacagatcagaccacaaccacaataaataccaccagtaaaacactaacaaatccctcctataaccaaacaacaacaacatagtatgaaaaacaacactacacactacaacaacgcaaacacacacaccaaacatacctcacaactagagacatccggtaaaccacacaacctacaaagataattcacgacgacactacacaaatccccacaccaacataccacgaagaagcccaaacacccaacacctaaaacaccaaccacccatagcccaatccacaaatcaactccaacataaaccaaaaacacataaaagacacacacataatccactaacaatccacaaatacatcactacaacaaactaacaataatctaacaactctcacactcaacacaca

SEQ ID NO: 715179 - DNA, 505 bp, Homo sapiens
ttggccagcacgtggtcgcttactcctgtaatcccagcactttgggaggcccagtgaggtgggagaattgcttgaacccaggaggcagaggttgcagtgagctgagattgcaccactgcactccagcctgggtatcagagtgagactcttgtctcaaaaaaaaaaaaaaaaaaaattctaaaatagaggttgggccaccaggtgcctaatattaaattaaaaacctccttgccatcatattttcccgtgctgcacccaatccccaagacacccttcacgaccattgatatacgcggtattaccacagttataaagacttgtgcaccttgcattatgtcattacgggcacatgtggttccaggagaggcacagtttgagttgcaaaaaatggtacacttgtgaggcttgccccaggctttgtgtaccggcaataagaggtgacccagggttctccccgtaagcgcatttctcccggaccaagtggggccaccatgggggtaccgag

SEQ ID NO: 715180 - DNA, 361 bp, Homo sapiens
cttgtatactacctatatttattcaacctctctcatttccgttttgaaaaactggagtagtctgaaactcttttggcttatggtgaccagaaatagtgttctggctggcacctctctaaaagcatcttcttgacgagacataggttgaaatgttaaatacatctccacttacccacaactctggtgctgcagtaatctgggagcatgcgctcacacaaagccacaagcagccagaaagcttcctcctctttggcataaagcagcagcactgaagtgacaatattcatggcctggcaataccctatgttgggatttcgaaaagcataagctgttaagactctccttagtgcagcaatgccca

SEQ ID NO: 715181 - DNA, 317 bp, Homo sapiens
  misc_feature (204)..(204): n is a, c, g, or t
  misc_feature (301)..(301): n is a, c, g, or t
agctcgatacccgcctggggagtacggaattcattctggtcgtagggatgcggaggtattgttagaattagagtaggtgacccctgagttacatcaggatgaatagaaattagctaagccactaggacatcacggttggttaaataccaccgcgcctggtgcagtattacaccatatttttaaaaaatgaggccgggcgcgtgnctcacgcctgtaatcccagcacttggggaggctgaagtgggcggatcacctgagttcaggagttcaaaaccagcctagccaacatggtgaaaccccntctctactaaaaatag

SEQ ID NO: 715182 - DNA, 345 bp, Homo sapiens
agctcgatacccgcctggggagtacggaattcattctggtcgtagggatgcggaggtattgttagaattagagtaggtgacccctgagttacatcaggatgaatagaaattagctaagccactaggacatcacggttggttaaataccaccgcgcctggtgcagtattacaccactcctggccaagcatccacttgttaacctcccacatatcagtgacaacatgtgatcatttgtcttcctgtccttcgcttatttcatttaacgtaataacactccccttccatccatgttgtggcacataacaagaattcattctttttatggccaggacaatattcattat

SEQ ID NO: 715183 - DNA, 196 bp, Homo sapiens
tctagaggatcccggcctgagtgcactggctcaatcacagtttactctagtcttgacctcccaggctaaaatgatccttccacctcagcctcctgagtagctgggactataggcacgcaccgtcatgcctggctgattttttaatattttgtagaggcagggtctcgctatgttgcccagggtggtctcgaactcc

SEQ ID NO: 715184 - DNA, 867 bp, Homo sapiens
gcaaccacacaaaaaagccaacataataaccagccaacagcacaatgacaagatcaaatctacacaaatcgatactagccttgaatgtaaatgggcaaatgccccacgttaaaaggcacagagtggcaagctagatttaaaaaaaaaaaaaaaagggagacccaagggtatgtcgtcttcaagaagacccatctcacacataaggacactcatcggtctcaaacgtaaaaggagtggagaaaaatctaccagaacaaatagaaaacagaaaaaaagcagagggtggcaatcctaatttcagacaaaacagattccaaaggaacaaatcaattttccaaaagggacaagggggcaggggcaagatagccgacctcaaaagcagcggcagttggaggctcccacggagaagaactaaaagagtggtggcaaatcctggcagcagcaactggacatatccaggtcctaaggatcaggacggacaagggggtggccgggacccaaagagaacaaggaaagatgggctggggggatgggcccaccggggagccacagggggcaaggggagccgtcaccctcagccagccaagggaggcagtgagtgagcaggctacccagccggggaaacggttggcccagggatcttggcaatccacagatcagaagatcccatcatgagaccacaccagagggcctggggggccaacaaagaagcttgcagatactcaaaagcagtcaagcggagtcgggctaaactaccgaatcccaagtggggagagagggcaaaacatggggtgtctggaggcaaaaccgcgagtccgggcgagggagcaaccacagaaacagctgccaaaactgaacccagaacgg

SEQ ID NO: 715185 - DNA, 92 bp, Homo sapiens
tgtttttccagccccccttttatgcgatgtcatcttttttaaaaaagacaaatgaagccccagggaaagtgaaataaagccttggccctcca

SEQ ID NO: 715186 - DNA, 354 bp, Homo sapiens
cctgctagcattcatccaagtgttttcatgaggtctgagccgcacgctccatgtttcgctcatctctactgctcctcgtgccctgtgtgagcatttgtcatcccaaaagagggggctcagatggtgcggcctgagtgtgcggccggcggcatttgggatacacccgtagggtgggcggggtgtgtcccaggcctaattccatctttccaccatgacagagatgcccttgtggggctggcctccttggcgcctgtccccacggcccccgcagcgtgagccacgatgctccccataccccacccattcccgatacaccttacttactgtgtgttggcccttatcgagggggatcct

SEQ ID NO: 715187 - DNA, 116 bp, Homo sapiens
tctgagagctccgactgtggtgtacgtaccatgtgctgcaatggtatatttgtccttttatggctgaatagtatccattgtatatatgtgcacatcttcttaatccattcatctgt

SEQ ID NO: 715188 - DNA, 677 bp, Homo sapiens
  misc_feature (139)..(139): n is a, c, g, or t
gaagggggctggcaataccttatccttcaaagcataaacaagacctgcagccattatgagtgtgcatttctaggtggactaaaaaccgaaaactgtattgagaacctagaatattttcaacccatctatgtctacaacnctggtgagaaaaaccagaagcttgaagaccatagtgagaaaaactggaagcttgaagaccatggtgagaaaaaccagaagcttgaagaccatggtgtgaaaatccttgaacccacccaaatacctgctccaggtccagttcctgttccagggtcccaaaagccatccttctgcatccttgggcaaactgctgcttccacagtttgggatggtcatcattttaatcagtgtttctgctataaatctctttgttgctctgtagtttgatgcattgtttatctttcttattctttacttgaaataactatagggatacacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattagatatttcagaa

SEQ ID NO: 715189 - DNA, 825 bp, Homo sapiens
agacctgtaataactataggtgcccatgccgtaacatcgactgaccaatcacagcgagctatgtgatgctaggcaagtgtgcggtagattcttcggtctatgcatgacatgatatccacgtgctcatttcagggaccggcgaaatattccctgcatttcagtgcatgcacagacgaaattatacaagagctcccatagccacagaaatcgctgagtaacaaagcaatcgcaaggctggaggcatcacatgccctgacgtccgaaatctacattaacgatctgctggtcgtagtacaacatgatatgccccagctattcaggagagtctgacagcagtggaggatcccatgagcccaaggagactgtagggctgcaggtgacctatgatcataccactgcactccagcctggacaccagagaaaaaccctgtctctaaaataaaacaaaaaaacaaaatgtagtacaaagctatagtaaccaaatcagcatagtactggcataaaaagagacacaaagaccaatggaacagaatagatagcctagatataaatccatgcatttacagagaactcatttttgacaaaggctccaggaacacacaatggggaaagaacagtcctttcaataaatggttctgggaaaaactaagattaaccacatgctgatgaatgaaactagacccctatctctcaccatattaaaaaatcgaatagaactggcttataacatttaacatgttcagacggtgatgctgccaacttactgatttagtgtatgatggtgtttgaggtgcccagtggtactgtgtctatcaggtgtcctct

SEQ ID NO: 715190 - DNA, 381 bp, Homo sapiens
  misc_feature (3)..(3): n is a, c, g, or t
ggnggggcagcaccatgcccagctgaaaggatggggttaggggagcatcatgtccggctgaaaggacgggctggggggagcatcatgcaggccaagacacagcacctgtcttactcctcacagcaggagctggctgaggattgccgctcatcacgcagaggggcgagagcagacaccgggctgacgaatgcccaggacctcaaaatctgcacaactgcactcagaagcacactgcttctgtctctgttcaaaacacccagaacaacaatcaggaacgaggctcccgtgacggccgtccccagagccagccccaccccaccacaagtgctgacaccaggccacactgccccagccaggccagagagggaccactggctacag

SEQ ID NO: 715191 - DNA, 133 bp, Homo sapiens
tgcgtagagtccgggcggcttgggatcttggcaggtaaattgaccctccagacctcacgttggttccggagcccatactcgcggatcagcttcagctcttggtcggagacgagatttctcgcaagggtctccg

SEQ ID NO: 715192 - DNA, 1000 bp, Homo sapiens
gctgggaactggagcccgaggctcccgcgcggcccgggcctggcgccctgacggggaagatgcggccctggcccgagggtgctggggctggacgagcttttactccaatacctttcctagccatgacggcacgggcactcctagggaaggcagccacaatggacgatccctatccacgggaacggctgacagcccagtgctatgcttccttgcaactgcatgactgtggcttgtgacgcaggacctccagccaggtgactggtagtcatggaccccaaccctcaactgaacaccacgcactttgtgtctgtgtgtgctatagggcgcgctcctggttgactgcgacctcactccgcctcagggctctggtcctgccatacgcatcttcacatacaccaattccatatcatggtccctggcagactgagcgctggcatcgcgcggacaattgcctgcgcagcaaaacgcttcgcacatacgctccaagcaaatgtgctgcgccactccacacaccctatacacgctgccacctcacagccaacctgctccatcagcaaccgcattctgcgctccgaggcctcaccgcggcaactgttggaccctgttcgggccttagctgcctcgtcagcactctgcacggtctggcctgccgctgaacggacccgcacacgccggcacgcgctacttgacgccacgtgctcccctgtccattccttggtcgccccgggggctgcgcttgcacccgcggtccctactcgtcgtatccacgcccgttggcgtgccaggaccccaaggcactgcctacctaggcgttgcacttgccccttcggcctggaactcttcttgtcaaggaacgttcactccagaagcattcagacagaaggcaacatcctggggcatcccacattgccactatacacaactgcgcacacctatcatattgccacgcacatggccggcacaacagccttcctagtgcaagcacgtggaaccattccac

SEQ ID NO: 715193 - DNA, 484 bp, Homo sapiens
  misc_feature (136)..(136): n is a, c, g, or t
  misc_feature (186)..(186): n is a, c, g, or t
  misc_feature (280)..(280): n is a, c, g, or t
ctcaaaaagtcttggagaactccttttcttcccccagagagggggtcttactcggtccccccaggctgggagcaccagggcacaatcagggctcactggagcctcccagactccggggctcagacagtcctccggnctgggcctcccgaagtggtaagattacgggcatgagccaccacccagggncacaatggattctggagaacacagtggcaggcactacaaatttggggataaaacaaaggcgtgaatctggccatcacgggtttacacgtctccnagactggtaagggggtccgcaaactaactccagccggagggcctgatctttcagcatcggttttggtaaccaaagctttatgggaacacaaccaggttaagccacgacagcagagtggaataatggggacaaagactatacagcccctatagccaaagagatttactatcgggccttttacaggaaaagtttccagccgctcat

SEQ ID NO: 715194 - DNA, 245 bp, Homo sapiens
  misc_feature (28)..(28): n is a, c, g, or t
  misc_feature (58)..(58): n is a, c, g, or t
  misc_feature (85)..(85): n is a, c, g, or t
  misc_feature (93)..(93): n is a, c, g, or t
  misc_feature (113)..(114): n is a, c, g, or t
  misc_feature (125)..(125): n is a, c, g, or t
  misc_feature (135)..(136): n is a, c, g, or t
  misc_feature (149)..(149): n is a, c, g, or t
  misc_feature (152)..(152): n is a, c, g, or t
  misc_feature (154)..(154): n is a, c, g, or t
  misc_feature (165)..(165): n is a, c, g, or t
  misc_feature (174)..(174): n is a, c, g, or t
  misc_feature (196)..(196): n is a, c, g, or t
gggcagaccttcactggccacgagtctnacatcaatgccatttgcttctttccaaatngcatgcatttgccactgctcagacgangccacctncaggcgtttgaccttcgtgnngaccaggagcnaagacttacnnccatgacaacatnatntncgggacacctntgtctcctnctccaagagcgggcgcctcctncttgctgggacgacgacttcactgcaacgtctgggattgcactaaagcc

SEQ ID NO: 715195 - DNA, 133 bp, Homo sapiens
ggcacgaggcctcgtgccggaggctgtttctgagcataatctcatggactacccaggagaagagaattttaagttgcaaagctatggggcctaccccacccagcccgggcagggctattcccaggagagcagt

SEQ ID NO: 715196 - DNA, 244 bp, Homo sapiens
ctatttgaatcactgacttggggcgatacagtcaactagctcgtggaaatctaagggccacctcgtctctagtcgaccagtaggcttgcacttttaatatgagtcctacgtaatagaacgtcttgtctggtatagagtgatgtttggatacacgtatatatttggtgatgatcaaatcaggctatatagcatatttttcacctcaaacatttatcatccctttgtggtaagaacattcaaaatc

SEQ ID NO: 715197 - DNA, 989 bp, Homo sapiens
tacctgtcctctttcaatggactgttgcctattgagcattgtggatgatgtgttcttcagatttaccaggatgacatgttctagagcacctaccgtgttgtggtccaacagacgtaaattgagaggaaaggccttgcgtacttgctctgatcaaccagcatataagcgaacagaggcttaatgcggatcactcaagaggcagtcatagcaatgtcaaatggcatataagtacggtgttcgggtgcctttttcctagaccaggaatggggaatatataacacctgtgccaccgctctttttaaggaggcattatgaatgagtgcagcattcctgtcctctgtgccaggttttggtcttagaatccatgtcacgattggttgcttccagaacatctatttcccaagtttcaattcaggagttggcccttggaaagggctatttggccaatccccgtgccgtataagacagggaggcaagtgaaacggaattaacgttggggttaggaccaccaaagcataaatggactttgcacacgccgggtgaacgctgcattgggagctcccagttccttgtgtgtttacgcaggaaaatactggaatggtctggtccatggtggccaagaacacgtggcttaagaaacccgaaatacccggacatttacacttaaggttacaccgggcacaattgatccctttgcaaggaagctttaacggggcctgttataaacacgacggggttccccctgtggtcactctggggtctttcaaacccaagagggcggatccgtttcttccaaataggaatgtgtccccaaacagttttatggttcttgggggcaccacattttgtgggcgcactcgcaggagaggaccatggggtggggtacccccatattacggatcctgttgggcaccataatacttgtgggcccttcattggatttagagggaagcttgcagctgataacaatctcgtgtcagggtaaaagc

SEQ ID NO: 715198 - DNA, 129 bp, Homo sapiens
agaggatgccacacgctggaaggggccctcaagttgtatgataggttccgtaaagtcgcgcatgggggtatagtctggaatctgccacaccatgatggtggtgtcgtctgaggcactggcgataacgtt

SEQ ID NO: 715199 - DNA, 627 bp, Homo sapiens
tttatgagtacaggtgatttacaacagaagagaggaccaccccgccaaccaaatgtccaggtcctattccatggaacctatgaacaggttgtcccacattgcaaaagggacttcacagatgtcggtaagttaaggccattgagacgaatgattctggattgtctgttgggcccaatgtgatcaaaagtttccctagaagagctagagaagatgcgataatggaagcggaatcaaagacagatttgaagatgctgctgtctttggagagaatggccaggaggcaaggaacacaagcagcccctagaagttggaaaaggtaaggaaatagatttttcccctaagagcctctagaaggaactcaggttcgcagaccatcacctggaattcttcatacctagtgaaactcattgctgacttctgacttccagaattgtaagctaacaatatgcattgctttacgtcactgtgtgtggtgatctgttacagcagtgatgggaaacaacacaataggtaaaatggaaaggtagagtcttgggtcctaactcttccagttgcatcataaggctccgaatgatgaatggcggaagaaccacagaataatattaaatgactgtgttttgccggaca

SEQ ID NO: 715200 - DNA, 963 bp, Homo sapiens
gacatgacttgccaaaaaacacataattggaatcaacacaacgcacccacagcctaatcattagcatcatccctctactatttttgtaaccaaatcaacaacgacctatttagctgctccccaagtccttttcctccgacgcccctatagcaagccgcccacctccgtaatagtaacataccatgactccgtaagccgctcagaatcatggagaagccaacgccagcttatgcagtgaaccagttatcacgaagaaaaagtcgtacctctctatagctacttctccctagcaaagtctccgttgaggtgtgataagcattcgacaggcaccagaactaatcatagttttcatatcttcttcgaaaccatgacttgtgccccactcctgtggcgtatcatcacccgagtgaggcaagcacaaggcagaaggcctgaacgcaggcagcatacgttcctaattcgtagcgccctagtaggctcccttccccctactcatctggactaatttacactcacaacacgcctaggctcactaaaccatgtctactactcactcgtcactgcccaaagagctatcggcatcctgggcaacaacttgatattgaatagcttacacaataaggttttatagtaaagagatacctctttacggactccagttagtgagtcgcttaaagccatgttgaagcccccatcgtggtcaagtagtactgccggagactctgaaaaataggggagggagtatacgcgtcaagatcatttcaacccctggaaacaattggtacccttgtgtgtatgccaagaagcattataaaggccgttgttcaaaaagtcaattggcttggttttccttaagcatacccgtggggaagtctcgcaaaaaagaacacagcacagaataacaaaaaaaatccgggccacagggggggagatctggtgtgtcaagggattcggtcagtcata

SEQ ID NO: 715201 - DNA, 386 bp, Homo sapiens
aatcccagattactgggacgctgaggcaggagaattgcttgaaacccagaaggcagaggttgcagtgagccgagatcacaccactgcattccagcctgggcgacagagtgagactccatctcaaaaaaaaaaaagtatcttagataacgtgatacagtcatccactcattatctgcagtataccctcaactctctttacctacttggtatctacctagcagaaggccaacaaacctagatgaatcaactctaaacatctccacacccatacctggacaacataaatgctccgtggataccatcactatacaggcatatctataaatttccggtacagaaactacgctgggccttctggcaggctaagtgatgatctcccagattcg

SEQ ID NO: 715202 - DNA, 133 bp, Homo sapiens
tttgctaatgtagaaattgtgcatctgtgcaatttattatgtttggcttactctgattatgtccaaatgctggaatgtggggacaaataattagtgtgatggctgtcagattatgaattctagttggtacctg

SEQ ID NO: 715203 - DNA, 250 bp, Homo sapiens
cggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcggtaagttctcaaatttgaatattgaaattgccagtattttaattataaatgtgtacattttcgcctactataaatgaagatattt

SEQ ID NO: 715204 - DNA, 851 bp, Homo sapiens
tccacctgagtatttggctttatccaatctaataaacttttaatttttgtaaaaaacaaacaatgctatagaataaaaataagtgcttgaaactttggatataaaaagagtatatagcatccacttcccttattttaaatcactatgagtacagctgaagtgtccctataaaagaatcaaaacttccccttttatgttatatgtattgtgaaaaaagtcagttatttttaggaactcacagatatgtgtattccctgggctctttttgtcttgatataagaaaacaaaatactattaacacaaacacaagccacagtaatcctctgtacactactatcccatgtttatatgcgctggtataaccccaaaaatgtggaaaatatacttctgtgaatattctttggatattatctctatggatatgggcccatgtatattcctaaaaaaaatctcccaccacttaagaagtgtccatatgggcgcaaccaggctatatttgggccatgggtcatccaagctatggccctaacgggtcgcaagtgtgggaaatttcctaaagggcgcctcttattgtctactggccggcccacagtggtctttaactctgcagcccacccacattgtagggaggggtgccctagaagggtcctatatcccaaaactcttgggctgttgttctttaacacattctctataaatgtgagcccttccacccatccaaaacagagctgattatctctataaccaggcccctttaaaaattcctaattgggtgaaaatgacgtacgctcaaagcgtttcccagggagttcctgtgcgctaacttctttgtgtttcaccagttccagcgt

SEQ ID NO: 715205 - DNA, 158 bp, Homo sapiens
ggtgtggctgttctagaggatccaattcctgctgctttcctgctgctcgcccgcgagctgctaccgccgccgttgccgctgccgccgccccgtccccgccgaactgctcctcccccgcgagaattattcctgctgctcccgcgagaatccctgctgct

SEQ ID NO: 715206 - DNA, 115 bp, Homo sapiens
aatagccagaaaaatgagaaagctctgacaaatatccaaaactcgtatggcacgaaaagagagaaacagtgttgatagagactcagctgaagactgtgcctctcttatacgaaca

SEQ ID NO: 715207 - DNA, 355 bp, Homo sapiens
tatagtcactgaatctgcatgtcgtgactaaaactcacatacacccttctcttaccacagaggtatcactattacaaagaatcctggccctactcattcatattcatcaaagaactcctttaattttagtagcgttcacaatctggttagagtggctctcttactttggttctccttaatgcttgcctggtaaatcttgttggactacctgcatttgtctacgtactctgttcttacgggacgccactggtaaccttgatcttcacttacttaacatcttacgtacctgtgtcactacaccaccttaacacaacatgacgtgtcaacgtcgcctttagcgggacacgacacacct

SEQ ID NO: 715208 - DNA, 389 bp, Homo sapiens
gagatgggaatctgattgttcctcaggatttacgatcaccataacatggggctgtctacatcctgtcaggcttggtaaatattcaacctgtcgcactgaggaacattatcgtgcaagcctctaaactagacctgtcagcatcttctcttgagattgaacagcctgaatgggaaaagcgaagatccatcaacctgtctgagctcattgatgtttacagtgatggtgttgaactactccagatggtgaaggcaccagattccaactgcagcaaccttctgattacaaccagacaaagcctattttgaagatgaggaagaagattctagcaacgttgatttaccttacattcctgctgaaaactcaccaactcgccagaaccacaaatatcg

SEQ ID NO: 715209 - DNA, 176 bp, Homo sapiens
aaaagggtttttcccaaaaaccggggggggggcccttcccctaatccccaattgggaatttgggaattggggaaggctgggttgctttgttttgggccctctccccggggggggtttgaaattaaacccccccctggggatttttttaatgtttaaataaaagtaagaaatgggga

SEQ ID NO: 715210 - DNA, 163 bp, Homo sapiens
  misc_feature (3)..(3): n is a, c, g, or t
  misc_feature (49)..(49): n is a, c, g, or t
  misc_feature (101)..(101): n is a, c, g, or t
ccnggtgtcactaagtgaagtttgtgccttctatagcaaagagaatatnttttacatcctactaacagtagatttttttgtagtgaacattttttgtattnttatttataagtctcataagaaaaatagcaatgttcagttgtataccttgaatctgcagtta

SEQ ID NO: 715211 - DNA, 108 bp, Homo sapiens
gtggatcgctccgtcagacgtaaaaaaaaaagttcggaggtgaaatctggtaaaggaaacccttacctatgctccagatcacaacaagacacaaaattatcaagcaca

SEQ ID NO: 715212 - DNA, 204 bp, Homo sapiens
gtggtccggacacgtacatggaggaatttgaagtagatagaataccagagcctggattactccgagtctgaactcagatcacgtacggtactttaatcgttgaacaaacgaaactttaatagcgggtgtgccatcgggatgtcctgagtccaacatcgaggtcgtgaactctatagtcgctgtggactctagaataggattgcg

SEQ ID NO: 715213 - DNA, 615 bp, Homo sapiens
gcgagccttcgccggtgtccggatccgaggccggacccgagtccagtcccgtcgcctgcgcggctgaagccagtgcggtgcctgagagggacgctgctgccccggtgcccctgtccgcgggctccttgggtcgctgccactccgcgtctgaggaggtgcggagagcctcgagggcgagaatggcttctcatcggatcagatcgatctgctccatcggagatttaaggcagctgagtggagatcatcctaccattcgcaaggatgaacttcaacaatgtcccggacctggagctcaaccccagtccgagtccaatattgttcgtgccttcttcgacaacaggaacctgcgcaagggcacccagtggcctggctgatgagatcaatttcgaggatcttcctgagcctatcatgtcctacttccggtcccagtcgacgaccaccatggacgaggaactaggtggagctgtcccggaatggagaagctgagatttctgttccacatgtactgcactcggacagcgacggccgcatcactctggaagaatatcgacaatgtggtcgaggagctgctgtcgggaaaccctcactatcgacgcaaggagtccgtctcgctca

SEQ ID NO: 715214 - DNA, 1968 bp, Homo sapiens
  misc_feature (1087)..(1087): n is a, c, g, or t
gggttcctgcatcttgctgagtgctggtgcgtcgtggttgttgctgcctttcggtgcggtgtgggtgtggtgttgttgtcgtacccgactccgtcgttcgttggtgtgtggattgtctgtctcggttctgtcgtgtgtgtgggctgatcgcgtagttgcctgctccggtggttgtgtcccggggtgttggatcagcctgcctgctttttgtttgttgctgctttcttcgcacagcacaagctccggcggcggtgttacccccccgcgggtttgttttgtcgttcggtcgtggggggggtcctcgccgtcttttctggtgtgctgtatgttagagcgagttgtgtggttgtttccgtgtagtcgtttgtctgtctcacggacacagagtttgttgtttagggcgcgaggtgtttgcctccctcgcctcccgacggagggggcggtttccgtctgtctcgttgtgagcatcggtgacgtccctgtggtgtgcctcccccgcccgtttgtatgggaggcgtggtttttgtggcgcccgttttcttttttacatccatggtgggggttggcttacggcgtgggtggtggtgtgtatttgtcgtctcctcccctctagacggtgtgttcttccttgctgtcagggggggtcggtgttccgtcgtgcccttgtggggctcctgttgtgattgtcgcctattaatgtgcgcacgagtcttgtgctacagggtccgaagcgtcgttgggttggacgaccctaccggcgtttgtctaagttcgtctgtcgcccctatggttgtcgtgccgccgcctgctcgctgtgatctccctcctcctcttcttttggtgtaggggcctcctcctacatatggccggcgagcgccgtgtgttgcctcacctccgcgagtgttgggcagtttcctccctgcgggggaattagggtattttattcgtggtgcactcatcttttgttaagatggaggggggttgcaccccacgtctcctctcgcggtgatatgtgtcgtctactacggggcatcctccatcaatagggggggcggccttcggggatgcaagagatatttttctcttncgtgttgtcgggaacccaacagcgcaagagatatgggtgcagcactcggtgaagagagaagaggagctgggcgttctcagcagagcactcagcacataagagatgtaaccccatcgcagcacaccttgtgtccccccactcctcggaggcgcccccgcgtgagatgtgagatatatagaggggatgataaatatcactactcgtttatatcatctcagcaggtcttccctccaccgcgggtatttggagtgtgaagctcccccgcgcgctacacgtgttgtagggggagcacacacccccacgggtaggccccctcctctctgggagtgcgttcgcccccacgggtccccctctggtaggcgttcttctctcacgagtggtgtcttggtcctcccacggcgctcctagcacaccagttctgttttgctgtctttctcacgcggggagtgtcccctccggtgtgacacgatgccgcgcgcgcgagatcttcttattcgccgcatgtacagtgccaccacgcctcgtccacatatggggaggctcccgagagacatgtataatatgagtggtacccgcgcggtgccacgtatgtgtgtggatgacaccacgcaccagcgaatcgggattccccagcctcttggaggaagagccctcgcatggaccaaccacctccctggccatttgttttgtgccccgcatggtatctcaccgcattgccaatagagaaagaccacaagtttacttcctctcccgccttctttgggggggttccccaggcctgcagctatgtgctataccaccccaccaccaccaccaccaccacccccggatgccatttaattaagatgagttggttctccaaacaaaaataaaaaaataaa

SEQ ID NO: 715215 - DNA, 421 bp, Homo sapiens
atggctgccaccagcctcttgagccacagctttctgtatgggacccgccaggtgtcctggatgtccagctctttttgacacctgtctctggagtttccagaacctgaacaggtcatgagccatgcttcccgcatgcctctggatagcttatatgggcagagctcctagtcttgcctgaatcctgacagtactaccaagccactcctccccaagcaaccacagggaagggtgattgtgattgccatacatgttcctcttgatggcagtactgtaccagaattaccagcaaacttcctcccctccctcaagatcctgtccctgtgccatctgttattaaagaaacagccaagaagtatccattgtagctgattactgggtgcctagttctcacaactggtacatcctgcataacctcttccca

SEQ ID NO: 715216 - DNA, 499 bp, Homo sapiens
gatgagttccttgcagagattggggccgctgtgtgtctccatctatgggctgttagtgcagagtatcatactgcaccagtccaggataggtgatgcacttgatcagccgtctcactggtggcaggatgatcttcaccacctgcccacgctttatcccaaagtagcagcgccacagtggttcccccgaactggatcctggtcagctgattctcatcggagcttatatcgggccagcagctctgtctacttcctccttgttcatgattagatgatccgtggactagctcgtgctccgtgatgttgatgagcagctcctgctgcagaaactgctccaggatgtacttggggatcatgtcgaccagggactgcttggcggagggtgtcatgccctgctgcaccacgatgagagcccgtgtgatgttctcctcctgcatgcgctggcagtacaccttgatggtcttgatgcccaccttgggctcctctgcaaggaacccacgcg

SEQ ID NO: 715217 - DNA, 264 bp, Homo sapiens
  misc_feature (214)..(214): n is a, c, g, or t
ttctcaggaggctgaggcaggaagatcacttgagctcaggaggctgaggatacagtgagccatgattgtcccactgcaatccagcctggatgataaagtgagactggtcttaaaacaaacaaacaaacaaacaaaacaaacaaacaaaaaaaaaccaagatgactagaaggtttcttaccaacttaggtaggtgaccgagtgccttacttggancttagttaaaaggattgcttgtccattgggaatcactaaaatgtacagta

SEQ ID NO: 715218 - DNA, 279 bp, Homo sapiens
tcgttcccagcctgggcatccttaagttccaatggcctcattcatgctctcggaacactctcgaagcgctcacgcccacagaatctgaagggtgaaaatattctccatccagtgatttcttctttggctggggagaggagctggtgttgttgggcagtcgtccgcatagtgctccctgggggcagctcgtggtgaggctcccctttcttgcggagattctcttcctctgtgcgccggtctctcccaggacaggcacaaacacgcacctaaaagctgttc

SEQ ID NO: 715219 - DNA, 400 bp, Homo sapiens
cttttggggctttaagggctttggctaaggttctccagggaggctgctctgccaagtctggtatttcatgaatagatctgaaaacagacattatctcttctcccagtgaagagagagcgatgaagcctcaggacaaaaggaggcagtgggatgatgccaccaagggaccattctgaagagccatcagcaaaaagcagccacacctgcttatgtggctctgggacaaatgatgtgagccgtgacgtggaacttagatgcagtaaagtccattgtattgagccttctctggcactcctcccaaaacagagagacaacagttctgttatgttttgtttggtttggtctccctcaactcatcaatgagcctttttaaaaagaataattcggtactttctttaaa

SEQ ID NO: 715220 - DNA, 481 bp, Homo sapiens
gggtgtggctatgaaggggtggctgccttgtgatgattcaatatgctgtgtttgtcctttgtggttttctgtatctatgttttatgttattttttttcagttctgtcacccaggctggagtcagtgagccgagatcaagccactgcactccagcctgggcgacagagcgagactgcgtctcaaataaataaggcaacaaggagagtctggatgcagtggctcatgcttgtaatcccagcactttaggaggccaaggcaggcagatcacaaggtcaggagttcaagaccaacctggccaacatagtgaaaccatgtctccattaaaaatataaaaattagccaggcatgatggcccatgcctgtaatcccagctacttgagaggctgaggcacaagaatcacttgaacctgggaggcggaggttgcagtaagccaagattgtgctgctgcactccaacctagggggcaaagcaagactctca

SEQ ID NO: 715221 - DNA, 215 bp, Homo sapiens
gatcctctagcaggatccccttcagagaagagacgagatgactactgagcagtaggtatgtacatggagccgagaagtacactcttgcccatcccatcttccatggtaatctagaatattaggtcttcaattcactgactcatctttatattcatctttcaccaaggaattgctcattagctatctgttcttcccagcccttttgataatgcctt

SEQ ID NO: 715222 - DNA, 142 bp, Homo sapiens
cttagcaggtttatgcaaattattctgggtattttagttgttagtttaatatagagacaggagtctccctactgtagatacccatagagctggagatgcagatggtgcagacttttggcatcactgcaacctccgccatccg

SEQ ID NO: 715223 - DNA, 177 bp, Homo sapiens
attactaaaaaattttttttaggccgggtgcagtggcttaatctgtaatcccagcactttgagaggccaaggtaggagaattgcttgaggccaggtgttaaagaccagcctggggaaaaaaaaagagaaaagggaagaagaccagcctgggtaacatagcaagatcctgtctcttag

SEQ ID NO: 715224 - DNA, 307 bp, Homo sapiens
gcaccaacgccctgcttgtggtcaaacatcgggacatgaatgagaaggaacttgaagctcaggaggcacggaaggcccagctagaaaaccacggacccgaggaggaagaggaagaggagatttgagacagaagagaaagaagcttggggctcagatgaggagcagagagaagggcagcagcagttagaaggagggcagtgaagatgtgcactctggcagcgcgagtttacgggaggaaggtgacaagggcgagggcacttacaagagtcgcagtagtgaggacgagagcagcgcggatgatgacccc

SEQ ID NO: 715225 - DNA, 119 bp, Homo sapiens
cagagaaaactctatgcctgtaaagaatacaaaagttaattttacctactatcatatgtctgtctgaaacttcttttctctctgagaattaaattttccaatggaccgttatgtcagga

SEQ ID NO: 715226 - DNA, 371 bp, Homo sapiens
gggactatgagtctaattaggaacttgtgaagtgcctgtgtctggggccagcactgatccacacaactgactttgcactatgtctcccctctcatatatcatacctggaatgggatccggcactggatgtgggacctaagaaacggcctgcagattacccagttataccagactggagctggaagcctggatcttactgtgttgctctctatggggctggccgacatgtgaagaaaggaggctcccagcatcatcttgctacacattattacattcacccagatgtctggttgtaattcttatctgcagactgcggtggaatacctgttggaccataatcatggaggggtgtagctttaccgtagtatctg

SEQ ID NO: 715227 - DNA, 190 bp, Homo sapiens
gtagcaaccggcgctcaataaaattcaaccagcaaactcgacaagtaacaaccataaaaccagccacactaagtccagccaccactactcaataaaaataacacgtatcttccaccgtacaaccaatagcaactgcaggctactgcaacgccatccatataccaaaaatgctacttacaacaccacaaca

SEQ ID NO: 715228 - DNA, 563 bp, Homo sapiens
  misc_feature (283)..(283): n is a, c, g, or t
  misc_feature (325)..(325): n is a, c, g, or t
cattcatatctgagtctttcatcccccaacaatattcctagagcttcttccagcatatgttggattagagtctctgagtcttgaatgggcatgaaggccctcggacatgatgcaaaggcctggacttcatgtcagagacctttcatgccatcagaaagatgacgtgtgagcctggaccagtggaggacacgctgtgcagctggaccgtggtgtagcgtcacacgagacggactcatcgcgtgtctccttccccatgcacagccaagtgaggagaacttccggnagcaaccctccgtgagggtggcgcaagatgctcaaggtccanaacatggcaggcaactacctgctgttcaacctactctgaggcggagacctgaacatcacgacagctccatgcacaaggcactgggaattttggctggcccgaacctccacaccccagtcctggagaagatctgcagcatctgtaaggccatggacacatggctcaatgcagaccctcacaatgtcgttgttctacacaacaagggaaaccgaggcatgaaagccctggacatgaaggg

SEQ ID NO: 715229 - DNA, 145 bp, Homo sapiens
cactgcagtgatagtcaccttctaacagtgctactgaaattgttcagttactgcgggaaggtgaaagtcaaccggcagcaactggccaaactggaaatgaacaccttgaacgtcatgctggtgaccctaaacctggcccttgtag

SEQ ID NO: 715230 - DNA, 103 bp, Homo sapiens
atagtataggctaaaatgacgcaattctccctgcgtcatggtagtcttgtaatcacctcggttaatctctttgtaaaagatcgccttcaaattattttaatca

SEQ ID NO: 715231 - DNA, 247 bp, Homo sapiens
tgacaagaacaagccaaacccttaataaatggagagcagctatgccgatgatggttgatttacggacattcaatatcagtaaagatttcagtgctccccattgggattggcagcatcaatgtcgtacactacaaattctggaaaattgagatataatagttatatgtattttagggggtacaggtgactattttgatacctgtatgcaatacatacgacatttttcttttgtgttgggcgataacat

SEQ ID NO: 715232 - DNA, 211 bp, Homo sapiens
ttgctcgactctgaggatcccctcaccgcagacgtgacgaggtatcagacactggaaatattgcgggactgattagagggaggtgaaaatgaaagatgaaagagttgtattggaaggaacaaggtctaaatctagcaagacaatggaacaactgtgcattcttagaatcttctgcaacatccaaaatttatgttcatgagatcttttatga

SEQ ID NO: 715233 - DNA, 711 bp, Homo sapiens
aaactcgtcccatcagatactatttaacaagctcttcaagatctggattgctcaccggatataccaacactggctcacagagcttactctcaaaagcatattctccaagatcaccataaccttttctctaacctgatgggagccagtcttgctcccatcagtacctaatttattgagagtttttagcatgaagggctgttgaattttgtcaaaggccttttttgcatctattgagataatcatgtggtttttgtctttggttctttttatatgctggattacatttattgatttagcgtatgttgaaccagccttgcatcccagggatgaagcccacttgatcatggtggataagctttttgatgtgctgctggatttggtttgccagtattttactgaggatttttgcatcaatgttcatcaaggatattggtctaaaattctttttgttggttgtgtctctgccaggctttggtatcaggatgatgctggcctcatgaaatgagttagggaggattccctctttttctattgattggaatagtttcagaaggaatggtaccagctcctccttgtacctctggtagaattcggctgtgaatgcatctggtcctggactttttttggttggtcagctattaattattgcctcaatttcagaggctgtaattggtctattcagagattcacttcttcctggtttagtcttgg

SEQ ID NO: 715234 - DNA, 1502 bp, Homo sapiens
tgtggaaattggaaccaaaatttttttccctttggttgggaaaaaaaaactcacggggtggttggtgtgtccgggaccccctatccctctcacccctctcccagaacaccaaaaaaagacaagcagcgcccaccaaatgtggcctcccttctgtgcccaagtgtgaaaccccgagagaggctcagcggttgtggtgtggggaggcaggttgagcgcaggccgggcaaaggccaggggcggtgcttgcgtttgcacagggcgggcgcggtgccagtgggggctcttgcgcccgggtttatagaggggacacatgggcggggggttggcttggggatcggcggggcgcagccctgtggggcgcttgccgcgcgtttggacggggtgccccccaagaacttcgagggggccccaataagcgccggtatagggggcttgcctcgtggagatgtgttgcttctgtgtccgccgcacattttgtgcaccaccccaggtgtgtgttactctccccgcgctttgtcccccttgtgagcacaggtgttggggcaccaccgcttgtatatacacccccggggtgtgcgccacgggtgtggtgttccacacgagagaactcttcctatcagaaagggggagttccttgtgggcgcaatgtgaaaccccccccacaccatagagagccagatgttgagatacgccagtgaatatggggattgacagctctataccgtgggagagaggctgtgtcctcttctctgtggcccatagggttaggaggccattgtgcattcaagccccccatgtgggccctatttggtgccacacccacctttttgtcttgggacgcttccggatggtcccccagtggtaccccctgtgggggccccccatattgtctttgggtgggcgccccccacggttgttgcgccctttatgtaatcaaaaaaggaggagctctatcacgaacccccactgatattaaatggttcattcggatggacagctatgggagttattgatggacacaaacaacggggggccctagtgaaaaattaggagcgcttgaaaaggggatttgcccccccaatgtgtgttcaagaagagccccgccgtacatgtctgggccgaatcaatagtacatcgtcacaagagcccaatgaggagatcataaggtggaggggataccctcctaggacaactaccggtgaaaacatgtttcacccctgtgtgggggcgccaaaagttgtcatacaagagggggcataaccccccctgtgcatgggttactcagaaccaaccaggatgggtcctgttgagaacactctactacaagtcgctgatgatagacacagggtggtgtctctaaacatgactccaaccaaatatagaaggcaaccacgagtggcgtgcatagacaataataactcagtagatggtgcagcatagactgatgctactcgatccactaggtacatttcaacacgaataagtcttgacaacatccatgt

SEQ ID NO: 715235 - DNA, 235 bp, Homo sapiens
tacccgtcagtagccaaggagagggtctttattgaggctagtcgtctgcttttctgccctgtgtgtgatgttgttatcccggataccctgtgtgatgttgtcttccgaggaaggcatgaggcttctccgccagcctcctctggacggcaggctcactgccaggccagcctccgagagggagagagagagagagaggacagcttgagccgggcccctgggcttggcccttatcgag

SEQ ID NO: 715236 - DNA, 212 bp, Homo sapiens
agccgacttagaggatcccggctgaggacatctgagccacggagcctgaacagcctgggaacatggagaaaccacatctctactaaaaatacaaaaaaattagccaggcatggtggctggtgctgtaatcccagctactggggaggctgagcgaggagaatcgcttgaacccaggaagtggtggttgcagtaaggtgagatcataccactgc

SEQ ID NO: 715237 - DNA, 200 bp, Homo sapiens
gtacgacttagaggacccctctgataggagctactgagaagcaggtgacttcgcagaggagctaaactgtaaggaagttcgcattgaaatgctggagccaaggtcggtttcgtgggtatgcatcaggcatagacagggcctcgtgctacagaagagctctgttcaaaagggtcctgcactggggggtccggctgtctaga

SEQ ID NO: 715238 - DNA, 724 bp, Homo sapiens
  misc_feature (350)..(350): n is a, c, g, or t
  misc_feature (398)..(398): n is a, c, g, or t
  misc_feature (467)..(467): n is a, c, g, or t
  misc_feature (508)..(508): n is a, c, g, or t
  misc_feature (623)..(623): n is a, c, g, or t
gttttccttcatcaggggccgccccgcccgggtggaggaagccctaggagcgtggatccggtggatggacggcttgtccagcactccttccaggctttggtcctgaaggagcagggccggcagttctataatgtggcaccagaccctgtcccccaaggcctgaagggcctaaaggaaggggccctgaaaagccctgtttctcagaaacgcaggctgtgtttcccatgtgcacagattcctcaaactcaccttgtggagaggacacggctgcgttgctctgaagcccaggggatgtgtgcccctcacgggtgtgacctggggcaccgtcctcagagcgctcggtccctcanaggtgtgatcggcccaggtgagcacaccgcccgccttgcagccacctntggaaggctatgaactctcaggggtgtgatcggcccaggtgagcacaccgcccgccttgcagccacctntggaaggctatgaactcaagtttgatgaacagagagacagntgtttgtccaggaccatcagccctgagggcagatgagctcaggctgatggcggccaccctgctgctccttgcagaggagcggcctgcgagtgaagccacacagaggggagacttntgagcgacaggcagggtgggggcccagtgaactgtggatctctagatacactgtcagctgcaatccggtctttattatgttttaaatgtcattttgtctga

SEQ ID NO: 715239 - DNA, 132 bp, Homo sapiens
ttatccgtgcgtaaaaagacaaggaataacattctgtagtcctaaaagtactgacttttttcactactatacattaagggaaagttttattctttatatggaacacttcagcatgtactcatgtattaaaat

SEQ ID NO: 715240 - DNA, 800 bp, Homo sapiens
tagagcctttattttaattcaggcccttgtaggggccgcatgccaccgccaacttctttctctgcagtggctgttccagcgcctataaggcataaagtgggatccgttttgtcccccccagagcccttgtgtttttgtgagggcctcactggtggctcctctgttgttacagactcatttagtaatgggaggtcccctggggcaactatacgctggccaccatttcagtgtttgtgtttcaccaaggggacggtctggacagcagcttaagtgtgattttagtcacaactcctgagtgtcccgctctcctgcttacctaggaggtgtattgccaggagataatacacccaatgctgtctagtattgtttcccacacttaaaatagttgccgtgctttaaattcacactggtgtggtctgatgttctgagagcatcaggaaatacaacccttttgcccattgtacccttcctccccggatcccaaggtggtctgttgctctggctgtcctttcattgtcttaggaccttcatggagtagggatagctgcctcctcctggctgtttttgtgcctgtttgaagctagctgctagcctccatttctgggaaagacctcttgagactcctagcccaggcctaaggggctatcgtttggtaccagtattttgtctttagcttttcatatgtgattgtgccgtcattttgttttgaagctacatggatcaatggatttgtttacaatgtcgataatgtctattaaatccagccattttgcaaatactaaaattacaactgcataaaa

SEQ ID NO: 715241 - DNA, 905 bp, Homo sapiens
tcgcgggacgttatgccctgccttgtggggaagcccctgtctgccccagctgcttcgagaaccgcgtagtcggatgcaggctcgagcctgtggccggggcactggaagggcaggcattccttggggagactggactcgaccgaactgaatggaagggaccaaacctcggatgaactctgcaaccctctcccgaacactccttctcgctgctgccggcggttccagcctgcaaactctagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggcatttttcttaggcgagcgccttccccagtcctggaagacccccggaagcctccaagcagaggacagcaacgcctctaagcacgcactgcaccatgatcctagctggcgcagcctcagacgcaggggcatgtcgaagctggcgcacggacacaggggctctgtaaaagcggcgcagcaaccaagggcctagcctccccctaacaagtcctagactgagacgcagtcaggcgcacgcccgccacgcaggcggcgagcgtgaccacgctcccggagtgcgccccccttcacgtccttgccgcggcttctccgcactttatgcccgtccctcactttccttggcccaaacccattccaccaagcctcacgccttcaccctgacatcaacaataagccccccacaaaaccacacactcccacaacaacaccataaccctctccccactaacacacaccatccaacaacaaacacacaccacaccacccaacaaaaaccaaatcacaaatcat

SEQ ID NO: 715242 - DNA, 305 bp, Homo sapiens
  misc_feature (114)..(114): n is a, c, g, or t
  misc_feature (120)..(120): n is a, c, g, or t
  misc_feature (145)..(145): n is a, c, g, or t
  misc_feature (175)..(175): n is a, c, g, or t
  misc_feature (177)..(177): n is a, c, g, or t
  misc_feature (181)..(182): n is a, c, g, or t
  misc_feature (184)..(184): n is a, c, g, or t
  misc_feature (186)..(186): n is a, c, g, or t
  misc_feature (240)..(240): n is a, c, g, or t
  misc_feature (256)..(256): n is a, c, g, or t
  misc_feature (263)..(263): n is a, c, g, or t
  misc_feature (276)..(276): n is a, c, g, or t
  misc_feature (283)..(283): n is a, c, g, or t
  misc_feature (296)..(296): n is a, c, g, or t
  misc_feature (300)..(300): n is a, c, g, or t
gaaaaaagtgctgagattacaggcgtgagccaccgtgcccagcctactctggttttcaaagaaaataactcatgatcatcatatgtgttatagtcagtcttaaaagcctaagtnaatgcnaatctgacttggaacatttactganacattacaaagaaaagcatggccttcacgntntttnnangncctgagtccccataaacctggcatgtgaccctgaacgtgccagtaagccttcangttaaatgtagccgcngtttgcnaattgagaaaagntcactcnacagtacagccangcangcagg

SEQ ID NO: 715243 - DNA, 479 bp, Homo sapiens
ttttgcccaaacaggggtgcagtggcgccatcttgactgactgctgcctccacgtgcctggatcaagcaattttcctgcctcacagcctactgagttggtgcgattacaggtgcactaccaacacacctggctaacaattggaattcttatgagagactgcgttccaccatgaagggcaggctgaaatccaactcatgacctcgtgatcccttgtgatacttactgccaagtgctgggattactggtgagagccaccgaccccggccgctcattgataactgacgcaaactaataacgaccttgccttatggttagtaaaagctagctcatgacatgccacctttaagctgtcctgtgcttaaatatcgatttcaaaatggtctatcggcgtgatggagccatcaagctccctcggttctaaagataattatggtgtagatatttggggggatctttccatctgcaagaaataataccg

SEQ ID NO: 715244 - DNA, 175 bp, Homo sapiens
tatctgtgtggtgtaaaccagcctatatcagttttatgtcccacatcgtcctgttctcttgcttgcccgactgattttatttctccatcattaacaaaaataaaaaaaagaatttgtgacaccggatctggagtgccctaaatcctataagaacctggaatagcccaggggaccc

SEQ ID NO: 715245 - DNA, 407 bp, Homo sapiens
gagctcgggcccgaaattctaattacgggccaaggagggtctgggctgctctgtggctccgtgggcactgctgcttggctggtggtctccgccggtggaaactcaagctccatacgtcttctccttcgcggagaaggctgatttggcctgaagaagccctgtgtgcactggccctagtaatccccccagagccagctcgggagggcccctactcgtagtggcctagctccgaatccgcacaaataggcgctgctaggagctgcattctgcaaagggaaactgggctcggggaacatacctcagccccgatgcggcttggctcaggagcgcagcgctctgcttggttcttacctagccctaggctccccatagggccagggctggtctgagcttgcgtaatagggtat

SEQ ID NO: 715246 - DNA, 317 bp, Homo sapiens
gccaccacactccagcctgagtgatgagagaccctgtctcgaaaaaaaagtcttatggtcaggggcacagtagctcatgcctgtaatcccagcactttggaaggctgaggcaggagaattgcttgagcccaggagtttaagaccagcctgggcaacatagcgagatcttgtctgtgaaaaaaacagagaatttccaagaccaggcatggtggctcatgcctataatcccagcactttgggaggccgaggcgggtggatcacttgaggtcaggagttctagaccagcctggccaacatggtaaaatgctgtctcttct

SEQ ID NO: 715247 - DNA, 180 bp, Homo sapiens
agagttgggaagggcagcccacagtacgcagtcctcaccacccagcccagggtgctcacactaaccagtctatgtagttagaggaatgatagctggctcatcctcggagatcagacccacatctctattcttgcgcttaaatacgcgcttttaactttcttgctcagaacaccgtcgaag

SEQ ID NO: 715248 - DNA, 658 bp, Homo sapiens
cgcggtggctcaccccgtaatcccagcactttgggaggccgaggcgggcagatcacgaggtcaggagattgagaccatcctggataacacgttgaaaccctgtctctactaaaaataaaaaaaaaattagccaggcgtggtggcaggcgcctgtagtcccagctactcaggaggctgaggcaggagaatggcgtgaacctgggaggcagagcttggcagtgagccgagatcgtgccactgcactccaaccgtgggtgacggagggagactccgtcttcaaaaaataataataaaataacaataacaagtgtgcatttcattcattcattaaactatttactggagtgcctgccaaagtgccaggcattggtatcaattaataacgaatgttaccaccaaaaaacaaacccacagaaaaaaaccttggggggggatagggccccggagaaaagagattacaaaacaatacggttgggagccgcgggccaagagggaacgcaccagtgcgcacaccgggccccaagagaaccggggcacgacaagcgggagaatctccaaaaaaaaaaggccgggggaaccgaggctggagaaaaccagaggggacggagacaaaaggggacaaagggggcccgggagcgaacaaaacccgagcgggcgg

SEQ ID NO: 715249 - DNA, 469 bp, Homo sapiens
  misc_feature (456)..(456): n is a, c, g, or t
tggctgttcccgcctgtccacagggctgcatcaactgctatttacaagcaaagcaaagaggttttctagggtttttaaatttcacaattctgaaatcatattttctaaattacatcctgaaggaaaagtagactgaaaatcatgtcaaacatgataaagggcagggccaggacccatgggctatgacaaacccgcccctgactccaaggtgacacctgtgctgggggcagctgggtagagaatcttggggcaggattccgaggcaggcagatgagtgaggataaattgggttctgacggcacgttacaccagtggactctaacgacgacctcacctcgtgcacagataattctgccttgtgcttaaccgttagaaatgtgtcactgaagtgtgaacatattatgctgttagatttcccatcatttctgttctttcattccctctcatttgcatggnttactcataaatg

SEQ ID NO: 715250 - DNA, 306 bp, Homo sapiens
gaaaatgaatacattagaatggaagtggggggaagaaaatgcatgtaatggaagaatgctgtcatgccactaggtttcttttttttttttgaaatagaatcttgctcttgtcgtccaggctggagtacagtggtgcgttctcagctcattgcaacctttgcctcctgaggcaggagaatggctgtgaacccgggaaggcggagttttgcagtgaccatgagatcgcgccatttgcactccagccgtgtgcaataggagccagactcggtctcaaaaaaaacacccaaaacaaaaaaacccccgggg

SEQ ID NO: 715251 - DNA, 1614 bp, Homo sapiens
  misc_feature (850)..(850): n is a, c, g, or t
  misc_feature (1177)..(1177): n is a, c, g, or t
  misc_feature (1350)..(1350): n is a, c, g, or t
  misc_feature (1413)..(1413): n is a, c, g, or t
ccaacggtttttgtagggactcgttcgtctacgaatactctatcgttcgcgcttgtatttgtcgccgcacacgttctctaaaggttggtggtgcactctcggagcctctgcaggttggtggcctgtcgacgacatattctccccggcacacacctgtttgtgtcgcaccgacacgccttcgtggcgacaacagggagtatggtggggtaccacgtcggtgggagcggcttcgttcgtcaataaaacgggggcctatctacatatccccaccacacacaggggatgcaccccaagaacgccgcggtgtagtgttcgttgcccgcccggttttcgggcccccaacgggccatcaccagatccaattgggcgcggtcgccaagccctggggaccacaccatggggcccacgggggcgaccccacatgcaaccaccctggtgttgtcaaaagacgacccacgggagaagtgtgttaatttaaaggttgttgtgccacaacacctaccccacgaagctgctgctcagagagaacccactacggagaaggtgtgtgtgaacccgccggcattgggtgtgttgtcttctcacccggggcggggcccttctcgggatgcccacggtccctttgtatatgggttctcacaccgccgcgtttctcactggtggccacacagcgagcaccaccagtgtcgcccctcccacaggtaaccccctggtgtggcgttggcactcccacacgccttggcgcgccaccaaacatttccgggccacagacctcccgtgggagagacacacaccctttgtgaagggttcttttcccccgtcttgtgctccctcaggggccatacaatanaccccaagggtgtctgtacacacacaaacacaaagactttggcgcccttgtgggttctccctggacgcccactgaggttccgccacacccccgcctcgccacaagggcgctctcccacgatgggtccccggagaaacaccccaacgcgctcatgcgtgacaactctctctcgcgcctcaacactccctacgcacacaggtctcgcgggagactctctcgcggccccctcgcccacagagggtgaaagccgcctcgtccgctccgcgagcacctcgagactcgagactgttccacacgctgtgagaactcgccctctttctctggggnctcgggaccacggccccccgctctttgtcctctctcgattcacactcttctcttgtctctctgtgccctttcctttccacagccaccacactccccgcggcgcgagacttggagatgaaggccccgcttccgcgagagggagagccactctttcttggctccccagagaggcntgggaccacagctgcctctttctcgtgggggtcttctatgggccccccttgctgcgtgtgctngggtggggaaagccggctgcccctgaggcccccggtctttgttgggaaggctgcgaggacgagagccctggctggaggccccgccgttgctgttccccccgggccctccggtttttcctaacttgctctgcaagcctgtcagacggctgcccccccgtcatagacttaaaggactgccataaatgtagagttgaagtctaa

SEQ ID NO: 715252 - DNA, 653 bp, Homo sapiens
agacagctgtcttctctccatgccctcatataacagaaggagcaggtagctctctgaggtttcttccataagggcactaatcccattcatgagggcttcaccctcataaccttatcacttcacaaaagccccaacatcagtaccgtcacattggggattagattttgatgtataaatttgatgagggcacataaatttagtctattgcagtcttctttaggattagctaatgtaattcttatgattctttgatgcaactagacttgccatgattaaataaatgggaaaaaagtccaacttcactgtgctagcagcagatcccaaatttgaaccaaaatttgtctgtctctaaaaccagcatacttacctcaaaaataagtattaaacattattgctaatgaatgctaaaataaattatatgctattcagtaaataataatatcgtataatcaaattaattatcaaataataattgatatgatttggtcgtatcccaacccaaatctcatcttgaattgcagttcccataatccccatgcatcgtggaagggacctggtgggaggtaatttaatcacaggaacaattaccttcatgctgttcttgtcatagtgagtgagttcttacgagatctgatggtttataaggggctgtc

SEQ ID NO: 715253 - DNA, 146 bp, Homo sapiens
cccccgtgtctataccggcagtgctgggattataggcatgagcctctgcaccagcccaagggagactttttgctgtgggtctgtgcttctgcacgtgtgtgaggaggagaccaaggcgcagccctggtgtgaggggcacatgtttc

SEQ ID NO: 715254 - DNA, 278 bp, Homo sapiens
gtgtcttttccaagcatgttgctgctgcatttattatgtgataagctctttgattgcccattggcatccataatctgctctaagcctggccgatccatcattcactagctcttagatgtatataattcatgatctaatagcctgtgaatgctcactgttatccttccgatgcattaactctagatcatggatacctaaacctggaatgtcaacaacctagcatacgtgatcttgtaatttgagcagtgatcagagcacttcttcaaaaatcagtgcta

SEQ ID NO: 715255 - DNA, 556 bp, Homo sapiens
accttggtgggatgagcccgagtcgatggtgaacctggcgttcgtcaaagaatgactcgtatgagaacgggcccggcattcagatggatggtgcacgtgtacgtgaaggacgatctgctgggacacctcaacgagtacttgtaccgtgagcaggacttcacgctcatcttccataccatgggatggaaacttcctgaggctgcacccgggctgtgggccccataccaccttccgttggcaggaatctgattgagccagagcagtgcaccttctgtttcacggcttctcggcatctgacatcgtgcccttcggtacacgaaggcgagacgttcagtcgcctggcggaggggccctggatggcccccgggtgcacgagcgtgcagttgggtggtgcacaggttgccgtgccgacgggtccaacccctctggatttcacccaccaggaggtgctcccgatcccctgataggccatggaggaggcccgggctgttggccgaacggatagactccaggcagggatctggggacacagggtctagacagtgtggcaacccga

SEQ ID NO: 715256 - DNA, 1183 bp, Homo sapiens
  misc_feature (34)..(34): n is a, c, g, or t
  misc_feature (63)..(63): n is a, c, g, or t
  misc_feature (113)..(113): n is a, c, g, or t
  misc_feature (126)..(126): n is a, c, g, or t
  misc_feature (133)..(133): n is a, c, g, or t
  misc_feature (135)..(135): n is a, c, g, or t
  misc_feature (150)..(150): n is a, c, g, or t
  misc_feature (245)..(245): n is a, c, g, or t
  misc_feature (268)..(268): n is a, c, g, or t
  misc_feature (273)..(273): n is a, c, g, or t
  misc_feature (300)..(300): n is a, c, g, or t
  misc_feature (326)..(326): n is a, c, g, or t
  misc_feature (362)..(362): n is a, c, g, or t
  misc_feature (368)..(368): n is a, c, g, or t
  misc_feature (377)..(377): n is a, c, g, or t
  misc_feature (386)..(386): n is a, c, g, or t
  misc_feature (419)..(419): n is a, c, g, or t
  misc_feature (440)..(440): n is a, c, g, or t
  misc_feature (496)..(496): n is a, c, g, or t
  misc_feature (539)..(539): n is a, c, g, or t
  misc_feature (544)..(544): n is a, c, g, or t
  misc_feature (548)..(550): n is a, c, g, or t
  misc_feature (553)..(553): n is a, c, g, or t
  misc_feature (601)..(601): n is a, c, g, or t
  misc_feature (720)..(720): n is a, c, g, or t
  misc_feature (1110)..(1110): n is a, c, g, or t
  misc_feature (1148)..(1148): n is a, c, g, or t
attaaaattgggttttcggctggccggctgcttnagccacccacaccacaacccgccttcccntttttaccgggctgtttgggcccctaactggggctggtggaactcccccntggctttctgctnaaggctntnattggcattaccgcnggtgccaaatggtgcctttgtgggaacaccagccgaagtggctctaatccgcataactgccgatggccggcttccagctaaccagcgccgtggcnacaaaaatgtgtttaacgccctnattcnaatcacccgggaagagggtggcctcanactgtggcggggctgcatccctaccntggctcgggccgtcgtcgttaatgctgcccagctcncctccnactcccaanccaagcagntctaactgaactcaggctacttttctaacaacntcttgtgcaacttctgtgccngcatgatcagcggtcttgtcacaactgctgcctccatgcctgtggacattgccaanacccaaatccagaacatgcggatgattgatgggaagccggaanacaanaacnnnctntacgtgctgttcaaagttgtccgctacgagtgcttcttcagcctgtgnaagggcttcacgccgtactatgcccgcctgggcccccacaccgtcctcaccttcatcttcttggagcagatgaacaaggccaacaagcgtctcttcctcagtggctgaagcggccgggngctcccactcgcctgtgcgcctatagccactgcgccctgggggcctgggctctgctgccctggacccctctatttatttcccttccacagtgtggtttcttcctctgcggtaaaggacttggtctgttctaccccctgctccagcttgccctgcttgtcctgatcctgtgatttctctgtccttggctattcttgcagggagctggaaaacttcctgaggatttctggcctccccctgggttttagtttcagggcacacaggacagcagaagatcccctttgtcagtggggaaaccaaggcagagctgaggggacagggaggagcagaagccatcaagatggtcaaagggcctgcagagggagatgtggcccttcctcccccacatgagnacttaataaattggattgatgacaccagccccagaatntggagagtctggggggtggctaggagaggggagga

SEQ ID NO: 715257 - DNA, 144 bp, Homo sapiens
ccccccggggggggccgggggggggtttttttttccccccagggggtttgggttttaaaaagcttttggggggcccctgggtcccccccgggggggagccccagcccccggtttttttgaacctcacctttttttttggaaaca

SEQ ID NO: 715258 - DNA, 86 bp, Homo sapiens
gggtttgctttggtttttgctggaaatttaaaacagggtttgggctccccaaaacaaaaaagttattgcccaagccaaaaaaaaaa

SEQ ID NO: 715259 - DNA, 730 bp, Homo sapiens
tgggccctaaagggggtagagggggtgctatagggtaaatacgggcccaattcacaaaaattttaaggggaataaattctaggacgatgggcatgaaactgtgtgttgtgccccacagatttcagagcattgacctgtagtatacccccggtcgtgtacgcggtagaaatgtgggttggtgttaaaactgtccgggaatggcatctggttttaaacgcctaatggtgggggacagctcatgagtgcaagacgtctgggggatggtaataattatacagaaggggggctatcaaccgggagtacaaacccgattggtgcaacgcgccaaggaggtccgcaggtcgccgggtcctaggaataaggggggaagtattgtaggatgtggaaaataagcccgccgaatccggggacccgaaggtcacagtcccatggggggcccatggatctggagggtaagggagggaccgtggacctcgtcggtaatgtaaaggatcgcgaagggatgggaagggcaataagcgacacgagggaatgaaagggcggcccagagaattgccccacaaggggtccatattacccggaagcgctcagaagaagtggtcagcatcaaggcaaaacatctggtctggcagcgggtttctaggacaaaggggccaacggcgactagagacgcgcaaatccgggcaaacggctctcacaggggcgcaacacgacagggggaaaagcgcct

SEQ ID NO: 715260 - DNA, 522 bp, Homo sapiens
cacagtgactcacgcctataatcccagcactttgggaggctgaggccggcggatcacctgagattgggagttcgagaccagcctgaccaacatggagaaaccccatctctactaaaaatacaaaattagccgggcgtggtggcgcatgcctgtaatcccaggtactcaggaggctgagacaggagaatcgcttgaacctgggaggcggaggttgcagtgaaccaagatcgtgccactgcactccagcctaggcaacaagagcaaaactctgtctcaaaaaaaaaaaaaggattaattttcaaattggccaccaacctggttcaaaatcatttccatgggttcccaatggtctttaatagtaggtactggagtaattatgatattctagagctacattctggcagtatctattaatcaaaacaatgggttagggtaatggaagtggtctataaaatacctaaaggcaatattacaacatacaattggggtattaaggagaacccaatgttatgggatttaaaa

SEQ ID NO: 715261 - DNA, 746 bp, Homo sapiens
  misc_feature (24)..(24): n is a, c, g, or t
  misc_feature (72)..(72): n is a, c, g, or t
  misc_feature (75)..(76): n is a, c, g, or t
  misc_feature (85)..(85): n is a, c, g, or t
  misc_feature (127)..(127): n is a, c, g, or t
  misc_feature (137)..(137): n is a, c, g, or t
  misc_feature (177)..(177): n is a, c, g, or t
  misc_feature (203)..(203): n is a, c, g, or t
  misc_feature (218)..(218): n is a, c, g, or t
  misc_feature (246)..(246): n is a, c, g, or t
  misc_feature (255)..(256): n is a, c, g, or t
  misc_feature (309)..(309): n is a, c, g, or t
  misc_feature (319)..(319): n is a, c, g, or t
  misc_feature (513)..(513): n is a, c, g, or t
  misc_feature (558)..(558): n is a, c, g, or t
  misc_feature (589)..(589): n is a, c, g, or t
  misc_feature (592)..(592): n is a, c, g, or t
  misc_feature (622)..(622): n is a, c, g, or t
  misc_feature (641)..(641): n is a, c, g, or t
  misc_feature (654)..(654): n is a, c, g, or t
  misc_feature (674)..(674): n is a, c, g, or t
  misc_feature (724)..(724): n is a, c, g, or t
gcccaccagctggttttgccatgntgatctgttccactttaagtgcagtgactgccgctttagtagcgagtntgnnagcccaatnttttcccaggtaagtttctagatttccagcttccagcatgtnctttacagcngggacttcagcctcaatatctaatccaacgtttttttttncttcttgatgttctgcataaagtttngttattacttcattngccttaactccagatttttctgccagtncgcgcgggnntagcttcaaatgccttagcaaacttcttaatagcatactgttcaagttcaggncatgtttttncatatgatgtgatctgtttggctaattcaatttctgttgctccacctccgggtacaagacgtttatcccttgttagaactttgaaagtattaacaccatcgtctactgccctttctatgttatccatcagattgtctgttgagcctcgaagtactatggtagaaatggcgccatctctccttttcatgcttaanaaccaccacctgagtatcttcaacttctgagaggtaaacactgtnacagtgtcccatttcttcaaggacaggaggngtnaatctaggaagagctgtagcaccaacagtnttacaaagtcttcggagancccattttgagtntagcctcactaacatgaaantatatttatttgcataatgaagagccatgtctgccactctgccacctgtnactacgacatttgcaccagtat

SEQ ID NO: 715262 - DNA, 1525 bp, Homo sapiens
  misc_feature (1)..(1): n is a, c, g, or t
  misc_feature (929)..(929): n is a, c, g, or t
  misc_feature (1147)..(1147): n is a, c, g, or t
ngtgcgtatcttctccctaccttgtggtaaacttcttcttgttgctggctgggtggtggctctttcttctctcgtgtgggctctcttttctcgccctctgaggggtgtgccttatttattttctttgggggaaaacatggtgttttgggagcacccccccaacacagggtgctcgtaaccgccaatgtttttgtttttctgggggccacaccaggggtgttttttcccccccaccttgggtggggcatctttttttgttctctccctctccgtgtgtgtgttttatccacccgtggcccccttgttgtcgcccgcggagttttgtctctcccttgtgtgtgggccaacctttgtgtgagacaccctcctctcccctcctgtggtaactttttgggccgcaatttttccacgagaaagccccccctttggaaaagaattgttcctattaggaagtgtttggtgattagctcccggggtgaaaatttggagaggcggtttatttttttgggcgccacaagaaaaatatttttgcgaaagaaaaaacattgtgggcgtgcggtgcggcaaagaccaacactggggtgcgctctttcctgagcacttgtgcgctgtcgtgtgaaaaagggtttatcctttggagagaggcccttctttttctctctctataatatttatatggcgtgtttttttctttctctaaagatggctggaagtgtccccccttccactcttgtgagagtatattatagatcgggcccgttttttgcccacgtctataaagagaatttaaaaaatattttttgggaccacacatgccccgcagttaaaaaagggtatatagagaagatttataggagtgtcccccaccctccatcttcacaatttatctcgagaggagagatgttgttgttaagccacgctagaacacncacactatatttttgagacagtggagaacacccacagagatgttcttctttctctcccccacacacaaactctttttataaccacacaaaatcccaagagccttcttgtttctcttaagaattggggtgccacacctatattgcccacccacccaccacgaagagtattttcacaaatacgggaatatcccgcgggtctcacctctgagagagaactngatatgttctctcgcgcccaataatatgtgggtgtctcttggggcgctgtgtcttctttaatggagcttaatattatattaaaggagatatcttacagctgggttaaaaccagatgtcacaggcgtttcttatagttgtttaatgagaccctcctaaataagcccgtgttaagaacacatggaataaccacgccacgccagggtacccaaagcgccacacaggtgtagtttcgcatattatagtgtaaacacatatccagaaaatagaagattttgaaattgtttgggcaccttccaaggacttgagagacattttatgtggaaactttaaaaaaattaaaaccactgtccccttaataaaaaagaaagaaaaataaa

SEQ ID NO: 715263 - DNA, 730 bp, Homo sapiens
attgacagtattcagcatgtgagcgtaagagcctacatgccttggccctgctctctgtgaccatcagcttataggatatacaagggtgtgatccatgctatccagaaatcagatgaaggccacccattcagggatatatctggaatctgaagtagctatatctgaggagtaggttcagaagtacagtaaattctgttcttgtgtcatgttgcaactgctcgtatacttggacctcagtgcgcctcttcttagttgatgcattgagttgattctctgaagttgcagtgttgatgtgggtatgtacctatgttggtgccttgtctaatgtgtgctgacactactgatttccggcctctcatttcactcttcagtggttcctgtaatttatgaacggcatcaggcacagctagatcgattatctaggacttgcaaattaacgaatgtcaaagatgctatggtctaaaatccaagccaaacaatcctctgtgatcgaacgcgcaaaagtctgaatgcaaaagcgcccaaattacagttagtaggacgtatcatcgtattaaaaggggggcaatcttccattttagatttaattacggccggaagggtcccgggaagatacgtaaaccttggacgtttgccaggtgccgtctttcaccagcatcgtcggctagcatcttaatcttaagtccttgcgcaccgtcggttgagggaaacatttaccggttctggctgc

SEQ ID NO: 715264 - DNA, 550 bp, Homo sapiens
  misc_feature (387)..(387): n is a, c, g, or t
  misc_feature (399)..(399): n is a, c, g, or t
  misc_feature (426)..(426): n is a, c, g, or t
  misc_feature (456)..(456): n is a, c, g, or t
gcgaggtgatctagaggatcccggtcgctgtatcgagggatagtttgttgagttatcttttagaatatttgtaaagctaaaaaatcaagttccaggtagaccatcactacagcaagcccactgcagtattaatctattaatactgtcaatgttaattaaaccattattcgtgtagcccctacccatcccattccagtctctcaggaggcttagctgtatcccagagaccccagtgctatgaccgcaggtctctcctggggcgggaagaggtaagaagtggctgatgtcaaagtcaacagccagcaagtggcgtgagcagtctcgatgaattctttcaaataagcgtttttcagatccactctagggcttgccttttccctctgttgnagtctcagaagntcttgaggtagaccttgtgagacctgnagcagtacttgctgtcttaggtacagaagncaggatattgattatttctccctgactcaacaaagagttgagatgtttatccaggttaggatgacactgcccccctgtcccccccgccccccaa

SEQ ID NO: 715265 - DNA, 498 bp, Homo sapiens
  misc_feature (95)..(95): n is a, c, g, or t
  misc_feature (107)..(107): n is a, c, g, or t
  misc_feature (242)..(242): n is a, c, g, or t
catcttaactgggtcgagtttggctctaagattatagtcacctctataggaggtctatctagtcaaccgttgatgataacactcgctgccaatcnagaacagcaaanctcaaatttgtgtcacgactatactgaggctcaggaacgtaccaatacggcacgaaatgagcaacgggcgactctgaatagtattaccctgagacacagaacgggacaaaagttaagattcgtcactttccaaanaaaacttggtaaggattcttccccccagatagctctcacgggggtagagggaatactggcaaaggttgaaagtggcagtttgcatgtttttaaaccctctccattttctaaagaagacaacacagtcaatacatttgattgtcttgaaaatgaagcaaccgatgagagctttaaagtgcccatgtcacctaacgacaacgactgagatgactggaattgagagaagacgcagtcttccttccagggaaggtcaatc

SEQ ID NO: 715266 - DNA, 141 bp, Homo sapiens
cgtgatctagaggatccgtgcaatggccggacgttcacggatttgtgtcacagatagcattctcgtggcaggggttgctgacacaggcgtcatccaggtgacacaggaggccagtcttgcccacgcaactggtacggcggg

SEQ ID NO: 715267 - DNA, 171 bp, Homo sapiens
gccagcccacagagagatataacaagatatttggtatattaaattatatgggaacatcgtcaataagaaatgatgtttaacttccttcgagttatatttgtatggatacattatttcgtattccaaagtcgtatgagattcctaaaaatctggtatgtctggttgggagct

SEQ ID NO: 715268 - DNA, 133 bp, Homo sapiens
tgtgttggctactagcacggttggctactagtccacgggttggctcctttgacactctctaatccgggctgattctaatttccatatactacctgcctcccccagccaagcgtggactagtagccaaccgtgg

SEQ ID NO: 715269 - DNA, 176 bp, Homo sapiens
tcatcgagctcggtccaggtgtgcattctccactccgcatcctgggctggggagtggagaatggcacacccgtactgtgctggttgccaactcgctggaacactgcactggggatgacaagtggacttctttaaatatactcagagtgacaggatcactgctggaatcgaattcag

SEQ ID NO: 715270 - DNA, 362 bp, Homo sapiens
gtaccttgcatggatacggtgttaataccaatatggattagtgtgaccacacctgaatcagattcaataccgaccgcatgacgtgttgagaaggttgaacgaatcacaccatcaatggggcgtaaacacggccatcggttggtttaatggcaaatccttcgccaagcgcacctgaagcaaaggcaggatccgagacgtttgctaaaggttctaaagtaccggcaattggcgcatagtattgtgtgtgtgcttgatccaaatcaatgagatctgactgactattttcaaactttttaccccaagtcttttcgagttggtaacaatttcggcatgtttgtcttctgtaacggaacgccgaaaag

SEQ ID NO: 715271 - DNA, 219 bp, Homo sapiens
gcggatcttggaagagtacgttgagctccagtccgcagcgttttgaagtagctggacgcgtacctgctgtatatactgctgaccggggcgctgcagttcggtaatgtctcctcgatggggaccttccccttcaactctttactctcgggctacatctcattgtgtggggagtatcatcgtagcggttagactgagaatagagttcgtccccagcgaggg

SEQ ID NO: 715272 - DNA, 706 bp, Homo sapiens
  misc_feature (17)..(17): n is a, c, g, or t
  misc_feature (24)..(24): n is a, c, g, or t
  misc_feature (35)..(35): n is a, c, g, or t
  misc_feature (39)..(39): n is a, c, g, or t
  misc_feature (42)..(42): n is a, c, g, or t
  misc_feature (81)..(81): n is a, c, g, or t
  misc_feature (155)..(155): n is a, c, g, or t
  misc_feature (170)..(170): n is a, c, g, or t
  misc_feature (218)..(218): n is a, c, g, or t
  misc_feature (229)..(229): n is a, c, g, or t
  misc_feature (271)..(271): n is a, c, g, or t
  misc_feature (322)..(322): n is a, c, g, or t
  misc_feature (343)..(343): n is a, c, g, or t
  misc_feature (376)..(376): n is a, c, g, or t
  misc_feature (434)..(434): n is a, c, g, or t
  misc_feature (454)..(454): n is a, c, g, or t
  misc_feature (479)..(479): n is a, c, g, or t
  misc_feature (490)..(490): n is a, c, g, or t
  misc_feature (493)..(493): n is a, c, g, or t
  misc_feature (502)..(502): n is a, c, g, or t
  misc_feature (572)..(572): n is a, c, g, or t
  misc_feature (695)..(695): n is a, c, g, or t
cttcttttgcgtctgcnagccgantcacattgctnaganaanatggggaaggtgaaggtcaggagtcaacggatttgagtngtattgggtgcttggttaccagggctgcttttaactctggtaaagtggatattgttgccattaatgatccctanattgacctcaactanatggtttacatgttccaatatgattccacccatggcaaatttcatggnaccgtcaaggntgagaacgggaagcttgtcatcaatggaatatctccatcacnatcttccaggagcgagatccctccaaaatcaagtggggcgatgttggtcgntgagtacgtcgtggagtccantggagttttcaccatcattgagaaggctggggntcatttgcaggggggagccaaaagggtcatcatctttgccccctctgctgatgccccnatgattcgtctatgggtgtnaaaatgagaagatatgaaaacagcntcaagatcatnagnaatgcttcntgtcaccaccaactgcttagcacccctggccaaggtcatccatgataactttggtatcgtggaaggactnatgaccacagtccatgccatcactgccacccagaagactgtggatggcccctccgggaaactgtggcgtgatggccgcggggctctccagaacatcatccctgcctctactggcgctgccaangctgtgggcaa

SEQ ID NO: 715273 - DNA, 245 bp, Homo sapiens
ggagactcaagagtctctgtgcatcgtctttctagcaaaggcacttgaatgtgtctgcatccctgttaactcgagtgtgaggaggtggagagacagcccacccccgagtccactgtgacccctgttcccatgctgacctgtgtatcctccccagtcatactttcttgttccagagaggtaggggctggatgtctccatctctgtctcaactttatgtgcactgagccacaacttctaaggttaag

SEQ ID NO: 715274 - DNA, 170 bp, Homo sapiens
  misc_feature (7)..(7): n is a, c, g, or t
  misc_feature (45)..(45): n is a, c, g, or t
ggtccgnctctgctcccatcagcggattctatacattgacctctngtggttataaaaacagcagtaacgacgtgtcagacaatgacgctgttgatgggactgatgggacgcgcatcttctcccatcagtatgagtcacgttttcctacttctttgcatgcctagtaattt

SEQ ID NO: 715275 - DNA, 1517 bp, Homo sapiens
  misc_feature (111)..(111): n is a, c, g, or t
tgggttggccacgggtgagtttattaacccgactaaagttcaaataaaaaaataaaaaccaaaatctgtggcagggaacgctagacgccaaaattcaggaaaattcttgcnttcctttgttccccaggactctccctgtggccaagccgcagcttccactataacttcattctgtgacctcgattcaagtttccctcatctcaagactttgcattcttgtaccgctgtggacattctctctgtgcgtgctctcccactgtggacgacggtgagtctcgtgggagtctccctgtggcacctgtgggggctttgtgggtgaggggcctccatatatttacacccatgtggcccgtgaaggcacaccatgtggcgtggggtgaccatttccgcccaggggtttgtggaaggcgccacgataagagaataaggtgttggagaggctccctgtgtggccccagtttgtgggaagaaacgagccggctgtgaccatatactgtgctctcggggcacacaatgcctcaggttagaaccctttgtcgttgacattctttcccatatattagtgtgtttggtgtctacacaacactgtgtacagacacaagagacactctgagaaatataggctttcacgcgttttatagcccctttggcgcgcttttcggcccgaaaacatcgtgggacctggtgggccctcttccccgtgaatgtggcccgttgaaatttgtaacatctgtgttctacaaggccctttatctgtcgggtgcctttgggaaaaagggcccaaggagtaactcctgtgggggccctgtggtttttactttttccccctttttttgttggcccccaccatttttggctgtggcgccccggaccacctccttgcgggggttctcccccttctctaagaaccttctttaaacacaccttgtgggtggcgccgcgcgatatacccagcgcagacatccgtgggccatacaaaccgttggaacaattacttgggcatttaggaacctcttttttgtcacacccccggggggtgtgttggcccaccacgtggggaattacttccccttgagaaatccttcaaatacaacggcgacagaggcacgccgggagaatataacccccaaaggagatatcaagcacacgcgtggggaatcgcaaaggggccccttcctccccacaagaggcgtggcagcaaattcacggggagaccccccccggatttccccccgggaagacacaacaatttttggtgccaccacaaagaagagaagcagtttgtgcgccaagaggctaccgagcataacctcaacggagcgcaggcttacgacaacacaacaaccagtggcgggtcaaagaggaagaaacacgacgagggggccctccccaacaaacagagccagaaatagtgacctagctagtagagaggagagcactcaacaaatacgacgcgcgacaataggagagacccacacactacactgaggctgcagagcaacaatactagtcgtaga

SEQ ID NO: 715276 - DNA, 390 bp, Homo sapiens
acttagaggatcccggctgagtgcatggtcggctcacttcatcacaactcttctcccggttcagtgattctcctgctcagcctcacagcagctgagattacaggcacccgctacatgcccggctaatttttgtattttagtagagatggactttcaccatgttgggcaggctgacctcaagtgatcgcccaccccggtctcccaaagtactgggattacaggcgtgagccacaacgcccggcccttgggcaagttctttgaaatgttgtttctaatcttaacaactcctagagataggtgtgcagtttcttgtacagtgtgctgggattggaaaccaagtctgtttggttctaagccctgtggtgtttccacacagccattgcacaccgg

SEQ ID NO: 715277 - DNA, 325 bp, Homo sapiens
cctcccaggttcaagggattctccggcctcagcctcccaagtagctgggattacagggtgcccaccaacacaccgggctaattttggtattttaagtagaggtggggttccaccaggtgggccgggctagtcttaaactcctgaccggaggtgatccacccgcctcaccctcccaaggggcgtgggattacggggtgtgagccaccacgcacagccaagggtttctaacggagggtcagtgtgctgagattctagcttcttcggtcctgtgaatcaaaacccctttcttcattccctctctatccccaggtagagagccgggcaa

SEQ ID NO: 715278 - DNA, 243 bp, Homo sapiens
gtcgtcgctcgaactcgtgaccagatcatcatccacagaggccgaggggaagttgccccaggtctaggtcaagataaagaaagcatagtacttctcagattccccttgtggtgaaaaaaattctgctgtggctatgaaaataaaaatggagagaaaacactggcaaagtattttcccctcctatttacatcctttgctgtaggtcaacgtagtgtccaagaggaggagtgagagagcatatca

SEQ ID NO: 715279 - DNA, 884 bp, Homo sapiens
agcggtaatacatataatgaaagaagaaatatagaaaagatcgtgggactatttttgaatgcatgttgttttatagataatgaccatgtaaaaaaatggagtgataatcagctatggaagaagtattgctgaaatcattcctgttttcttatatgtaccattgtcaatcaaggtaaggtaataattatttgaaatcaaataaacagacaaaatttaagaagtgtttctatataattatatatataatgtgtatatatagtgaatgagtttatacacacacacatatacaaactatcttgtgtgtttaatatatatgaaccaaatggattacctatatatgtgaagatagaaatatttttaaaaactctaaaagtttagtaaactgactatatggtactatttaaattagaaagtttggataattctacggcatttgttttaattttccagcaaagaaagattacaaatgatcctggcttttgaataaaaccagtccctcttcaagaacagaacattttaagatctaagattctgtgtggctgctaaagtgtttaagccatttcaagctgtgatctctacagtaccactgcaaacagttgggacacaagtgaacaaattttatcagcctggtgttaatttgatgctttctttcctttttctgtccccccccccttttttttgcctctttccttacttcttccctttctttctctctcctttccttcctttactttatttctaattgaatgcatgaaatttcttgcaatgtccccagggtcctgtaatcagagtattgacactctaaaattgttcatcacctttgtcttctgcaaatttctgaaagcgtgcttaacagaaatccaggaaaagccagttgaatactc

SEQ ID NO: 715280 - DNA, 131 bp, Homo sapiens
tagatcgaggacaaatagacaatgagaggtgacactgtatcagaaaacaggagaacagtactaaagaggagccagttcagccaatactatttctgttccacaacgaagttccactggtgttaagtttcagg

SEQ ID NO: 715281 - DNA, 848 bp, Homo sapiens
agaccggggacggggacaacggccccaggcccctccccagaggggttacagccggagtccaggatgtggcgccccccgtcgcccccgcaaagctttttaacggactcagcagaagcgtagcatttcccgcagggttaattgcagaatagaaaattgccccggccaatggcacaccccctcatgctagccccccggaactgggatacagcctcgcgaaagaaattggcccctgaagctcgttatctagattatcccacctgggttgttacagacctgtttgctcgatttcgaccctgtattgaaggttacgtgtccccctgggatgttggttaaaaccccggacaaaatcttggagggtccaaccctttagtacgtgtggcttggtccaccttctgtggctaaggtaagaaccgtgcttgttggaagaccaagtctgttggcttggtgacatcttctgtgggccccccacgccctttgatctttcccgggtattaaccgtttccggctgagtttctgggatttctctagaggctggcacagaacccgcttgttttgtcttcgggtcttcagggttggaaagtcccagccgtaggaccccgtttcccttctagctgatgtctttggcacgaacaccctgggctgttacttgctttgagttggaagcggtttgcatttacgcccgtaaaagtattcattcctaatttatgtaaggttttttttgtacgccattttcgattttttgaagagatgaccaccaattttggttttttactgttatgtgagaaccttaggcccccgcaacacgtccttgtgtaaggaaaaataaaagtgctccgtaacccaaatta

SEQ ID NO: 715282 - DNA, 369 bp, Homo sapiens
gaggatcccttcagcacataacgttggaccccattttattcatagttgggggttttttaaattagttcacaaatctggtacataccgggcagttaaaacgggttatcactttgataatcagaagcctcgggggtaacatagtcttcatgaaaacatatggtaaaacagggagaatacacagtaataatctcttggaaagcaagggcggtaaacatccatgtttctaagaaaatataactttacatatatttgtatttgaagcaagctatacctcttacataaattcagacggtagaaggagtgtgcaatcataaggcttatttaagggaaacaggggaaataattttaattatgactaaaggtgctgaa

SEQ ID NO: 715283 - DNA, 278 bp, Homo sapiens
ccccaagcaaacataggaacttaggtataatgtgtaatcagacccatcagtgaattctgactttggtgtgtgaaatccgtttgctttgctggagagagcaggaatatgcataactgatcaagattgtcctataggagatacataatgtctcgcaacttttaataactttgcaaatagctctgtaaaaaacggtggggggagggattgattgtccaaatgtcgtgaggtcaagaatgctcttcaagtgaaattgcttggctgcaagatggttttaatta

SEQ ID NO: 715284 - DNA, 139 bp, Homo sapiens
tgggcccgttttaaatggcatttgtagctgcagcaggatgcaggaaccagagcctggacctttggcggtatgtagtgtgtgaagaggagttctgaagagatgtgggccaaagggaaggttggtcttgaacggacagttc

SEQ ID NO: 715285 - DNA, 259 bp, Homo sapiens
ccgatgtcagcagctcatcagctgcaggccatgcacgcacagtcagactgagctgcagcgcttggcgctggaacagcagcatgtggctgctatgcccatcacccgctgcacagtgtgccgctgcctgcccaggaggactactacagtcacctgaagaaggaaagcgacaagccactgtaaaacctgcgatcaagagagcaccatggtctcctacattggaccttggagcacccccaccctccccccaccgtgtgccctt

SEQ ID NO: 715286 - DNA, 323 bp, Homo sapiens
tttctggacagcatttggtctggctcctgttgcccaggtgggcgtgtagcgttgggctcactgcagcctcgacctccggggcccaagtgatctccctgcctcagcctcccacgtaatgggaccacaggcacacgcaatgcctagctaattttggtagagatgggtctcactttgtggcctaggcgggtctcaaactccggggctcaagcagtcctccggcctgggcctcctaaagtgcggggatcacgggcgtgaactaccacacccagcgggaatggatttttaaaacctaccattcattataatgggtatggtagctaagg

SEQ ID NO: 715287 - DNA, 180 bp, Homo sapiens
tgacaacgaggcataatatgtcgacactaagtcaaagcctattctgaatactagtagctgacctcattacactaacatgaattggaggacaacccgtagaacacccgtgcatcatcatcgcaaacagctattagaatgacgagtctgtgtagtatatcaaataccagaccggtcttaccg

SEQ ID NO: 715288 - DNA, 130 bp, Homo sapiens
aaggctccgaacaagagaggatagcagtctatttcatgccaagcaagaggtagtcagtataatccccgtctaccagaagcaagtatctcagctttctgtggaaaagcgtgcctcccagtccgctgtgttg

SEQ ID NO: 715289 - DNA, 310 bp, Homo sapiens
gggccctgggtttttaaaaacttgctggccccacagttggcccctggacccggccgcgcaactggtggactgtaagggctccttactgggcacaggagcttccagcttttgtccccggccagcaggattggctgttgtgtatataacttgggcgagggggcaggccccccttgtgcaaaaccaggggttttagggcacctggctgtgtttccaacttaaggagggcttgggcgggggccgggcttggaaccatgtacgataccctcatagtggccctttaacctgatcctcccccgcgaaaaaaaaaaaa

SEQ ID NO: 715290 - DNA, 220 bp, Homo sapiens
aaggatcccgcgtggtacttgcagatttcctgttctggacgcaatgacctagaagataaaaacaggctttttaataataactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctca

SEQ ID NO: 715291 - DNA, 81 bp, Homo sapiens
  misc_feature (12)..(12): n is a, c, g, or t
tttcggcacagnggtttttccagaaacgttgtcaccaaataagtatgagactgttaatttggagaaacaattagcccctac

SEQ ID NO: 715292 - DNA, 813 bp, Homo sapiens
tccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgtcttctttctttaagctgaattcaacaatttctgtgagtggctctttgcatgaacactgtgcaaggtgtcgcgagaaatccaaagctgaccaaaacatggtccccacctttcggagcttacagtctagttctggggaacagagattcagccaaagtcaagaaacactggactgccagctagattatctgttctgtgcttcggctgtctactaacgtacatatgtggatatgggttcactttccatccctaaacttagtaccaaaccagcactttaatatctaattataactctaactccggcctaaactttattattgcacactgcctgaacaaaacctatttgtctctatgtcacattttcacctcatggaacaagggtgtgaacatgaccaatactcttaccgatttattcaaccaccacagactattctgtttctcagcttcagcaactgtcctctcgaatcctaaggaacctctgtcaacagttgacggttgctgcttgaacaagcaacgcagcacggaccgcggacaatctcctaacggcacaactacatcccttacccaccaaaccacacgatacctggacgggctgcgcgcacagctcagacctcgtaacgcgacgggccccccactgccgacatctgcgccccgccgaccgaa

SEQ ID NO: 715293 - DNA, 565 bp, Homo sapiens
ggaaagtagtatcttactacaaatcaaacatataataagtggaggctacatcaagcaaggggaggtccagccctcttgcaagtgtggtgagaggctctactagcagagccatgtacgtcactgaattctctacagcaccgcatgctacacgggacctactccggagcccatgtagcatgcgggatgctgtcagagaaactccagtgacgtacataggcgcggagtagacggaccacacaagccgacaccgggagaaggcacagagaaaggcacaagagcacaggcgctgcctcacatcatccgagcctggccaggcacaccagaagacaccacgacacggaccatgcgcagagcagcggcggagggggagagcgcgcagaaggaggacgaaggcgcgggatacgacatcatggcggagcaccgaacaagagggaaatggcaggcagaggagccagcgagaccgcgagatcagctgagaagcagcagagaggaacagcgaggggccagcaccgacagggggacaagaaaggggacgggcgggaacacagccgaagcaacaacagcc

SEQ ID NO: 715294 - DNA, 320 bp, Homo sapiens
gtggtgggaagcgcctttgatctcccttgtgattcgccccaagaatgacgtctcatctgagttctacgcgccattggtgcgggcactgcaagcagctagagcccgtgtacaacagcctggccaagaagtacaacggcgccattcagggctctgttctcttgccctgatgtatgtcacagacaacgacgtccccagcgaccgctataaggtggagggcttccccaccatctacttcgcccccagtggggacaaaaagaacccagttaaatttgagggtggagacagagatctggagtagctcttattgcccaggctggagt

SEQ ID NO: 715295 - DNA, 601 bp, Homo sapiens
  misc_feature (68)..(68): n is a, c, g, or t
  misc_feature (98)..(98): n is a, c, g, or t
  misc_feature (190)..(190): n is a, c, g, or t
  misc_feature (231)..(231): n is a, c, g, or t
  misc_feature (235)..(235): n is a, c, g, or t
  misc_feature (240)..(242): n is a, c, g, or t
  misc_feature (244)..(244): n is a, c, g, or t
  misc_feature (247)..(247): n is a, c, g, or t
  misc_feature (252)..(252): n is a, c, g, or t
  misc_feature (255)..(256): n is a, c, g, or t
  misc_feature (258)..(258): n is a, c, g, or t
  misc_feature (324)..(324): n is a, c, g, or t
  misc_feature (331)..(331): n is a, c, g, or t
  misc_feature (354)..(354): n is a, c, g, or t
  misc_feature (361)..(361): n is a, c, g, or t
  misc_feature (368)..(368): n is a, c, g, or t
  misc_feature (400)..(400): n is a, c, g, or t
  misc_feature (447)..(447): n is a, c, g, or t
  misc_feature (462)..(462): n is a, c, g, or t
  misc_feature (468)..(468): n is a, c, g, or t
  misc_feature (530)..(530): n is a, c, g, or t
  misc_feature (537)..(537): n is a, c, g, or t
  misc_feature (548)..(548): n is a, c, g, or t
  misc_feature (555)..(555): n is a, c, g, or t
  misc_feature (567)..(567): n is a, c, g, or t
  misc_feature (594)..(594): n is a, c, g, or t
gcactttgcctgtatactctgtaaaaatgaggaccttagaaaatcaacatttcctgtgaacttgaganactatacaagcagtgcccaaatcagtaggnttaggcaggtaaaaccagttggatagcagatatattatgatctgttggacaaaggtatagttgtgtgcatgtctacaaggtcatcgtgattngccattagcttaaggatcatgtaggttgaacagggtgaggnaggnttatnnncnggnttgtntanntngtggtaggggatgcagtatacaatattcatgaattaaacacttagctaactgccttcctgaaaatngtctgtnttctaaaagacaaagatctaggnttttgcngtttttnactttaacttatgaagattcaagtcactaatntgttacttgctctggtttaaaatgaaagcaactggctatggtaaggnagagaagacagctgnattgtntcagaatatttaagacttttaaattaagttctgagttacctcaccttataaaaatatatgtnaatatantaaataccaanagagatncagggtgtgggntatttaaaaatagatttgtgttgtatnagcacca

SEQ ID NO: 715296 - DNA, 211 bp, Homo sapiens
aaattgggggaacccccttttggtttttaaggggtttggggtttggggggggaaaaccggaaaaaaggggttgttttttaaggggggttttttttctcccgggggggggggggggccccaaacttttccttggggggggaccccgggggggggcccggccgggttttccaaaaatttttttttggggggggttaaggggttttccctttta

SEQ ID NO: 715297 - DNA, 87 bp, Homo sapiens
agcttctaacgatgtacggggacatgttacttttctggtcttttcatggcatatgagcaaataataaactatttacactacaaaaaa

SEQ ID NO: 715298 - DNA, 160 bp, Homo sapiens
atagatactcatgctgtcagcacttgcaacggttttgagggaaaagatgggctaagcttctgtctgataggagatgaccgacctgaatttattcaagatgatggagccttcatcaaattcatatcccgaatttagtcattcacgggccatgactgacgct

SEQ ID NO: 715299 - DNA, 1500 bp, Homo sapiens
  misc_feature (703)..(703): n is a, c, g, or t
  misc_feature (836)..(836): n is a, c, g, or t
tgtttaccaggctgagtgcagtgagctgaggtcatgccattgcactccagcctggtgcgacaagagcaaaactctgtctcgaaaaaaaaaaaaaaaagcaaggaggttgacatcaaatacggttgattccaaggctattttatgttccctcttgctggctactaacaagttaactaatgaacaataatgcgacttggtaaacagcaacacgaattggatggctgctaacgagttccttgcaggtcttttaagttcggcaatgagagcgtgatgggactctaaaaatggcaagacagggcggttgtgggcatcagagacggagctgtgggcctccagaagagtgtctcgtggtctccttctcggtggggggccctcctgtgaggcatacactctcatgtgtctcctgttgtgcccttgtctaccccacgtctttctccagaaaagctcgtgcctctcctctcgcctttgtggcctctcatgtgcgaccaagtatgtctcagcaatatctctccgctgttctctctctatctgtgtgccacgctctcttctcatctctcaccgtgtgtggatgccctgtttctctctctcttccctagtgtgtgcctgtctccttgtctcctattctccccagctgcttgtatatctcagacggggcccataatgtgtggggtgaaatttaataagacatctactactgttgagngagaacgccctatataccacatacgaggaaagcatctccccacagggggcaatataatatgttctttcccacacatctctctgctgaaagaacatctcccctttataacacgctttataaaacaacgagaagnatctccggtggacagaaaagactccccgtaatgatcaaatatgtggcgggccacaaacagcttgtgttgtaccacatttcgtgcaccaatggttgttgtctaccacccccctgttttaattccccccccttattttggcgccggggcgtggccaattctatttctggaccctggctgagtcgtcttgtatcgcgacaatgcggtcggattgatctgttctccaagtgtggttggccgccccccagacagagtgggggacattcaaaaataagccaccgcctcatattgaggggcgggggcgagccaactccatttcgcgcacgacataatcgggcgcaacacaggcgcataattggcggatgcgggaaacagacccaattatgtacgaggggggagggccaacacgcagaaccctccgccatatttgggacgcgagcgccctccccccagagggcaaaatattgcgaacgtcgtggtgttgctatcacgcagatgccctcccccccgtaacaagggccctccctcacatgcagtggtcgctcacatggtctgtgttttcacacaggggtggtgtgccatccatcttgagccacgtcttgtttatcgtccacataactctgccgatatcgggaaacatgccagtggagtgtgctaaagactcaca

SEQ ID NO: 715300 - DNA, 83 bp, Homo sapiens
tgtgctgcgtgggctcgagtcagctacgatggttcaagatatttgctgaagggactaagctcatagtaacttcacctgataac

SEQ ID NO: 715301 - DNA, 792 bp, Homo sapiens
atcaccctcctctcaagggtcctgtgcctataggtggtggccagcctgcactgtccccagaatcttttggatactggaggtcagattgcatagtgtctccctcttctagggtcatccagtggactcacgctccacgccacaagactacctctgcgttgctagatcgccatccccagtcgtggaggcctcttctggtacgacctcaagtgaccaggcattctctacacggtgtctctataatagagccaacaatgagacgacgtgggttggagcgaacgcagttgaggagtgagtttgacgtgacgcagggagacccgtaatagattgccctcagttgatttgacatgggtagcatgtacgaacacttagtagctgttttcgttggcgactgagataggtctccgagttagtttatggccgagaaagaagacaacacaatactagggaggcctaagtttcgcttacttgagacatgtattccacgtacagggggtgtgcgcactaaaggaatttgtcccaggcatattaacgctacacgaggggactatcctgtaggggaatcggccaagcagatggtcgtacccacaatattatcctatgaattcgtcgtcctactttgaaataaccatgcaataggggcgacgataggtcccacttggacaagttcgttcaacatacaggagtgctaaagctcctcactttgtgagatagaaacactgatggtggatccccatagtggcgggacatcctctataggtagacacagtgaagccatcgcctaggttattcatg

SEQ ID NO: 715302 - DNA, 1051 bp, Homo sapiens
  misc_feature (302)..(302): n is a, c, g, or t
  misc_feature (352)..(352): n is a, c, g, or t
  misc_feature (365)..(365): n is a, c, g, or t
cttgatgaatcattcacgactgtcttccaactcttgtgttgatactacctcttactacgtactccatctatccagcgtggacgtgcgtgtcccatatggtgcatcttcgagcagcagtcacctatgccatctgatagtaacgctgtatttcatctaatatattgccgacttcgtagcatggagtgagcaattgtatcattctgtctaatggattgtaggagtatatgcgaatattcacgtaggagtagacacctcggtctgcactagagtagacgatgtactatacagtgtgctcttagccntgagacgtagagtaggtgttgtcgtcccctactcgaaaaagctgtgctgntctcattgcttcntcttttggcgcctactttgttggttgactagggtgtcgcgccggaggtttggccttgctagttcgttgccggtatcctttatgtgagtatcgcgcggatagtatggacgcatttgacatattgggttagagtgctagggagttggtctcctcgacttgcgtggtaagggtgtgctcgttcacctatggtgatggtttcttatggctagtagcgtgaggctcctttggtcagagaaggctcccatttggctgtttcgggcttttgttgccattggtatttgctgctattggtcgtgtatgcctctggccgtgcctggtgtcctgaatgcgtcgttgccgtgtcttccctctctcagggttattgagtggcttcgccgcgtcatactgattcgggaggctctgggtccatctcgaaatcatctcaagtgatgggagtgtgtaggacagggggtgcagtcgctgcttactgcatgtgtgtttacctattttcccttagctccagatctgttagacttgatgaagatcctttcccccctttcgcttgagggcatggttcgggtacgtacggacgtcgagtgggatggaggatagtgtggagggccgatctcccggcctcctggtcgaccggccatggaaacgcgtagggggcagttcccggcgggttcggtagcggcccctgtggatggg

SEQ ID NO: 715303 - DNA, 248 bp, Homo sapiens
cattcaaccatccaaccactcattcattcaaatatccatgcactcagtcatccatccatccactcattccttcatttattcatccatctccatccatccagtcacccattcaccctcccaaggctgaggaaatgctatgaacagagaagagcgaattcaagatttcaaaaactctatatctatacagtgacatataatcatgcaaagtacatttataattatataggtaatgtgtgtatcagaaagtc

SEQ ID NO: 715304 - DNA, 312 bp, Homo sapiens
ttcatgtcagggctttcatccccaggtgcagtgtatgagttgttgggaaagggctttcgagggggtgggggccaatggaagggctcgacatgaatcatgtcgagggccttcatccccactaaatacaaaaaattgaagctactggccgggtgccatggttcatgcctataatcccagcactctgggaacctgaggcaggcggatcacctgaggtcaggagtttgagaccagcctggaaaacatggtaaaaccccgtctctactaaaaatacaaaaattagtagggcatgaaagcgctggacatgaagggtac

SEQ ID NO: 715305 - DNA, 370 bp, Homo sapiens
cccattcctcctgtgctcccagctaccccgttctcttgctgtttttcttgagtagaccaagttggggcctgcctcagggcctttgcacttgctcactctacttgcagtgctctttttgtagctctctgcatttcttcttcttattatttatttttgaggagtcttactctattgagtgcagtggtgtgatctcggctcgctgcaacctctgcctcccgggttcaagcgattgtcctgcctcagcctcccgaataggtcggattacaggtgcccgccaccatgcccagctaatttttgtatttttagtagagacggggtttcatcatattggccaggctggtctcaaactcctgaccttgtgatccaccca

SEQ ID NO: 715306 - DNA, 116 bp, Homo sapiens
ccgatcgagctcggtcctcctcccacctcgttcccaaaaaccctggtttttggatgatgaggagaagtccaagcttttagccaagctgctgaaaagcaaaaacccagaggacctgc

SEQ ID NO: 715307 - DNA, 262 bp, Homo sapiens
accctccagcttctcgtccctggacacagtcagttcccgtggtttcctagcttccagctcgtacaagacttgcattttcaggcctggcctgggcaggttctggggctcggagggcctggcagttggggtccccagagctgagggtcatggttgctgtgtcttctcctgcaagaaagtgtgaggtgctccctaacctatgacttccccgccgaagggaaacagggtcctggtatcctaagggtgcttggatgaagcgtgacag

SEQ ID NO: 715308 - DNA, 180 bp, Homo sapiens
ggagaaggactggggtggcagagacagccagagattcaggcgacaagggacaggacaggaataggatgagggacaggagaggggacagtgacggggtaagagagcacctcggttcccggccaagctgtacagactctcccatggggtactgagcacggaccagtccccattcacgaagaa

SEQ ID NO: 715309 - DNA, 111 bp, Homo sapiens
cctcagttagggtgtgtaaggggaatttgttaccccatggtttcaataccttgtatgaattttagtttgggaaaaggagtcgttgcatgtgtccacagcggtttcttgtac

SEQ ID NO: 715310 - DNA, 470 bp, Homo sapiens
atcccccgggctgcaggctccacgagggttcagctgtttcttacttttaaccagtgaaattgacctgcccgtgaagaggcgggcatgacacagcaagaccagaagaccctatggagctttaatttattaatgcaaacaggtcctaacaaacccacaggtcctaaactaccaaacctggcttaaaaatttcgggtggggcgaccttcgagcaaaacccaacctccgagccgtacatgctaagactttaccaggcaaaggcgactactatacttaattgatcccataacttggcccacgggacaaggtaccctaagggatacaacgcaatcctattctagaggtcctataacaataagggttacgacctcgatgttggataggacatcccgatggtgcagccgctatggtttcgttgtcaacgatgtctacgtgatctgagttcagaccggagtccaggtccgtttctatct

SEQ ID NO: 715311 - DNA, 149 bp, Homo sapiens
tcactgtatgtgaatggtccagagaaggggagtgagagaaagcgacagggagcatggattcggtgaagattaggaggattggggggctgtagcccccccagtcagtggagacttaaccaaagaggatattgactctgggggctgggcgt

SEQ ID NO: 715312 - DNA, 212 bp, Homo sapiens
atcctctagtagcgcctgctactactactgagttcgcggccgcgtcgacgggccaggcatggtggtgcacatctgtggtcccagctacttgggaggttgaagtggaaagatggcttgggcccaagaggtggaggctgcactgagccatgattgtgccactgcattccagcccgggcaacaagcaagaccctgtctcaaaaaaagcatagatc

SEQ ID NO: 715313 - DNA, 836 bp, Homo sapiens
tattttgttttttttcctttaaaaggaagctttaatacatagctacccacttttgtccaagcagctcttagggcaagagaagttaatcccaaatttatagagccaggggggctctacagattatacggagttaacacccagggattaaatctgaggtcaacagctatcgggggaggctcagccttaagccacgggaggggggggaaaaattaacgccaagagtaaatatcttcactattctggaaatataatagtgggcaaacactataacactccgggcacggggggaaataaatatggagagggcactatgattcagaagtaacacttctagaattctcactattcccgggttctcttcaattggggtcccaacgggtgcacatccccgagtagtccccagtctatccacttcaaagttggatagagaaggtatgcccccacggggagcagcctgtgcgggtgctggaggatggtgcacaccactggaaatggagctctgggatcagttctgggctgaagtccaccggggcccctttcacgagggccagctatcagagtcaaccaccactctggccccacccgggttcaaatccccgtgtcgctcggggtggataccgtgtttcaccgtgacactctggtttgtggaatccggagcatccacctccctccatttgcagcttgagggattcttgaccctgcggtgatttcccaaaacctctggaggcgatgtctgtaggggcgttctggccttgccggctcggggtgagagagaagccccgaacgcctgggtcccggagcggaggactgcctcgcagggggaccgtctggtaggg

SEQ ID NO: 715314 - DNA, 1076 bp, Homo sapiens
cgcggtggctcacgcctgtaatcccagctctcagggaggctaagaggcgggaggatagcttgagcccaggagttcgagacctgcctgggcaatatagcgagaccccgttctccagaaaaaggaaaaaaaaaaaaacaaaagaccaaaaaaaaaaaaaaaaaaaaaaaaaaaaaacgacctgctgggcgcgcgcgccgccgcgcgcccctcagacaaagagccttctctaaagacacaaccctcggcggggaggcgcgcgcggcggcgccaaacagaggagtcatagcagacaactagcgggcaacaacgcgggggctcctcaacggaggagaccccgggcggccacggacacaagacaggcggcgggggctccttcactcacaaaatcaacaaacagccgccgcgggcggagacaccggagagggtggctcgtaaggaccaactccagcagaggaggagggctatcagaagggccgaaaaacgggaggatactaacaacacagaggggagccacaaaaacgagggcgcgaggatcacaaaataagaccccccagcgcggggcgggtccccacacacacacaccaggcacaacacagcaaaacgagaggcagccaccaaggagccaggcagagagagaccacagaagcaaagaacacgagaagcagcggaaagacgagaggagcgggagaacgagcaacagacagcaacgacacacggacaaacgaggaaacaagcgaacacaggagacaaacaacagaacacacagaacaaagagcaccaacaaacccacacaggacaaaagcaaccgccagcgaacgccagagccggcgacggcagaggccgaccaaccacagagagcgacagagcccaccagagacgaaagggggcgccagaacaagaggcgcacggcgcaaacagagacgcaggaaggagaggaggcacacgaaagacgagacgaaggggaagacgagcagcgcgagaagcacagagacggcagacacgaagagcagcggagcacgcagaagcaaggcagagagacagaagcgagagccgagacagccggcgaggagagaaag

SEQ ID NO: 715315 - DNA, 983 bp, Homo sapiens
cgagacgaattacctggttcagggaattggagcccagggttttgagtgcagcgtttgggatacggggccatattaagccaaccctgcttgttgaaaaaacttacaggctgaaactcccaagatctgaatggggctttccctgaagtgggaattctaagagctttagccctatagaatgattaccttgggaattgtgccccacaaggtctactgaagctttacgcgaaggactaataaatgggactaccagtagctcacgttacagggaaggaggttagcagtgagcttctgtgtgttaaaatgagggtctccctgctttaggattgaaatggctggaaagagtgatgcctggggaaggagaatggagttatgagggtactgtggctggtactttctgtactgaaccatttcccttttctattttcacccctaattttgttttaaactgtgacccgcgtcccaagtccagaaggaagcaccaccccaataaaacgcccactttttccccacaaaaccaatttacacttttaatacaagtatgaaaatttccattttggagaaccattcccctggaaattgcccaccataaattccattaaaaaccatattttttaacgccacaccaccttggaaccagatgtttacactttaaactcccttaaatggccttaattaatttctccagattcctgcccccatcacttcccagaacccattccacttttagagtgactaaaaggaaaccattacccttagacttttctaaagacccccctgtgtccctccaattaccagagggttaggaatgggtataacctctaactgtgccaaagccagagtgaaattccaattcatagaataacaccaactgctgggaataatccgtgcccaggaaaagaaaaatttttggcaaatattttgtcactgctgtaaagccaaatatttgtgaaagtgcccaaataaagtctgtcatgcccaaagta

SEQ ID NO: 715316 - DNA, 610 bp, Homo sapiens
  misc_feature (77)..(77): n is a, c, g, or t
  misc_feature (499)..(499): n is a, c, g, or t
  misc_feature (519)..(519): n is a, c, g, or t
  misc_feature (543)..(543): n is a, c, g, or t
  misc_feature (565)..(565): n is a, c, g, or t
  misc_feature (582)..(582): n is a, c, g, or t
  misc_feature (598)..(598): n is a, c, g, or t
ccttccaacatctcatttctaccgaccacttcatcaacaacatcggcatcgttggggttgccctgctcgcatgcctngtcatttcctgggcgctgcggaagctgccggtgttgcgcgatcacctcaacgagtactcctcgttccaggtcaacaaggtgtggatggccctggtcagtgttgtcgccccgctggtcttgctgagcctgtggatcacggagatcatcactgtcgcgagtaagggatatggcgaaatgcccagaaacttcgttgggatcttcggctggggaatgtccatcctcgtcgtcgttctggcgatagtgctgtcactcatcccgtggccacatcgctcggcgattcatcatgagcttacccacgaggaggagctggcctgcgaaaacttccaagaaaccgaggaaggagccctgtcatgagcacttcagcgatcatcatgatgatcagtgcgatggtcacggtgtggggcggactaacttgcgtcggncatctcgctctttcgacatnctgaacaggactgacgtgaaagangccatgaacccgagtcgattantgggacgacaaatccanttgatggagaaatganatgtttggaaag

SEQ ID NO: 715317 - DNA, 494 bp, Homo sapiens
gcatggctgttctagaggatcctcgtatccaccaggagctgagtttatcctcaaggtattgaggtgtgaaggaggggatgggggtgtgaagctggtagactgggagtgtggttatggtgtgtggtgggtgtgtggtgggttatggtgggtggtgactagcttcatgttgggggtgggaggagcttctcttaggaaggatttctgggtgagtctgcggcctagtccctgtggttcagtgaagagtggggaaagagtatactagacttggtttgtttagtaagtacccattctctcaaggagcttatagtattgtcagggaagcaaaatacttttccaaatatcatacaaatacagctggaatattagatagtgaacatttctgaagcaaagaagagcgcggtgggaaatatcttctatgatgctttggaaaatggcaggtttactcaatgatttgaacccagaataaatttttgatagctgttgatgcaggtggg

SEQ ID NO: 715318 - DNA, 270 bp, Homo sapiens
tgtgccttcaaaaaatgacttttctaacttaagggtgggtatttgttaagtgtgctactaacttaaaaaatagtgggtggtcgcggtggctcatgcctgtaatcccagtgctttgggaggccaaggcggggggatcacgaggtcaggagatcgagaccatcctggctaacacggtgaaaccccatctctactaaaaacacacaaaaaattagctgggcgtggtggtgggcgcctgtagtcccagctactcgggaggctgaggcaggagaa

SEQ ID NO: 715319 - DNA, 878 bp, Homo sapiens
  misc_feature (68)..(68): n is a, c, g, or t
  misc_feature (70)..(70): n is a, c, g, or t
  misc_feature (86)..(86): n is a, c, g, or t
  misc_feature (94)..(94): n is a, c, g, or t
  misc_feature (117)..(117): n is a, c, g, or t
  misc_feature (124)..(124): n is a, c, g, or t
  misc_feature (135)..(135): n is a, c, g, or t
  misc_feature (155)..(155): n is a, c, g, or t
  misc_feature (157)..(157): n is a, c, g, or t
  misc_feature (169)..(169): n is a, c, g, or t
  misc_feature (176)..(176): n is a, c, g, or t
  misc_feature (178)..(178): n is a, c, g, or t
  misc_feature (181)..(181): n is a, c, g, or t
  misc_feature (184)..(184): n is a, c, g, or t
  misc_feature (189)..(189): n is a, c, g, or t
  misc_feature (192)..(192): n is a, c, g, or t
  misc_feature (198)..(198): n is a, c, g, or t
  misc_feature (201)..(201): n is a, c, g, or t
  misc_feature (218)..(218): n is a, c, g, or t
  misc_feature (222)..(222): n is a, c, g, or t
  misc_feature (224)..(224): n is a, c, g, or t
  misc_feature (230)..(230): n is a, c, g, or t
  misc_feature (236)..(236): n is a, c, g, or t
  misc_feature (244)..(244): n is a, c, g, or t
  misc_feature (251)..(251): n is a, c, g, or t
  misc_feature (254)..(254): n is a, c, g, or t
  misc_feature (259)..(259): n is a, c, g, or t
  misc_feature (265)..(265): n is a, c, g, or t
  misc_feature (269)..(269): n is a, c, g, or t
  misc_feature (279)..(279): n is a, c, g, or t
  misc_feature (281)..(281): n is a, c, g, or t
  misc_feature (290)..(290): n is a, c, g, or t
  misc_feature (297)..(297): n is a, c, g, or t
  misc_feature (305)..(305): n is a, c, g, or t
  misc_feature (314)..(314): n is a, c, g, or t
  misc_feature (332)..(332): n is a, c, g, or t
  misc_feature (348)..(348): n is a, c, g, or t
  misc_feature (358)..(358): n is a, c, g, or t
  misc_feature (373)..(373): n is a, c, g, or t
  misc_feature (441)..(441): n is a, c, g, or t
  misc_feature (737)..(737): n is a, c, g, or t
  misc_feature (817)..(817): n is a, c, g, or t
  misc_feature (841)..(841): n is a, c, g, or t
gagccggggctgggtctgggggccgctcttgggagctggggcgcaggaacataacggaggcggactcncnggtaatagtggccccnggacgccngtcccaacgcccctttactcccnggttccnggacctgcccngggaagacgtgctgctcccncncgtcctgaaccnggtcccncngcnccnccgcnccngctgcngcncgttaccgggccttccngtcncnggtgcngcttcncctggccnggctgcntcncttcnatgccncccnggtgggtccncngatcccccnggccccnttggcccngctgctgcnggatgccgaggggctgcnggagctggcactggcnccgtgtcacnaatggctgtcagacnaggacctggtgccggtgctggcgcggaatccgcagctgcgcgagtgtggcgttgggcggctgcgggcnactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaacgccaacgtgggggacgccgcggttcaagagttggctcggaactgcccagaactccaccaccttngacctcaccggctgcctccgcgtcggaagcgacggtgtcaggacattggccgagtactgccccgtgctgcgttcgctgcngggtgcggcactgccaccatgtgngggagtccagcctgtagccgcttgcggaaacgcggcg

SEQ ID NO: 715320 - DNA, 617 bp, Homo sapiens
ggagagagagagagaactagtctcgagttttattttttattcttttttgggggtcccaaatttctttattggaaggaagggtccaattcaaaaaccttacagggacttgtttgggctcacaacttctatacaaagggtcaaggaacccccaaaattgaattgaccagtgaccctagggtgcaccgcgggaaaagttcaccccacagggcacaacggggggggaaaaaattaaggccgcgaagggaactacagactagtacactaataattgacgagcgagaactcccaaagggggagggatgcacgatgggcacccagagaggagaacaaatactctccgcgaaccacaaaggcccaaaaagtcgcgagggcggcatccaccacaagatatgaagagagcagaaccaacaagagtggagaagaaccaacgaggtgaggaggaatcacaacccgccaaaaaaaaaccattgatggatggaaaacagatggggggcaataataaatcaacaaacaaacgacacagcattggaaacgaccgaacacaaagaataaccgaaagaggagcaataaaaaaaaagggaagtagagataaaataaaccaaaaagagagaaacaaa

SEQ ID NO: 715321 - DNA, 578 bp, Homo sapiens
  misc_feature (29)..(29): n is a, c, g, or t
  misc_feature (88)..(88): n is a, c, g, or t
  misc_feature (97)..(97): n is a, c, g, or t
  misc_feature (123)..(123): n is a, c, g, or t
  misc_feature (148)..(148): n is a, c, g, or t
  misc_feature (180)..(180): n is a, c, g, or t
  misc_feature (226)..(226): n is a, c, g, or t
  misc_feature (243)..(243): n is a, c, g, or t
  misc_feature (247)..(247): n is a, c, g, or t
  misc_feature (301)..(301): n is a, c, g, or t
  misc_feature (450)..(450): n is a, c, g, or t
aagaaattgcggaaacaaggttgcccatnccaattatgatgaaagactgaaccacagaagcatggaagcccaagaccagacaatgaanacatatgtngtgccatgccccccctcaggacttgnaaagtcctcaaagagacccactatncccatattcactgacccagagggatgatgggnagaatgacagaccttgatcatgtgaacttccagacatgatcacctnactgccttctgagtagnaagnaacttcactgacagagcagttttacctcattttaccttagttgcatgtgatcgncaatgtttgagttattacttgcagagatagggagcaaaaattacaaaaacacacagggtagtgggtccttttgtgggctttcctagttacttcaaattgactttcccccacctttgcacaggtgctttcaatagttttaaaattatttntaaatatatattttaggctttttaataaacaaaataaataaatgacttctttgctattttgggtttgcaaaaagacccactatcaaggaatgctgcatgtgctataaaaattgttcaaatgtccaaaa

SEQ ID NO: 715322 - DNA, 328 bp, Homo sapiens
ttttttgagatggagtcttaaactgctgcccaggttggagtgcaatggcgcaatctcggctcactgcaacctccacctcctggattcaagctgttttcctgcctcagcctcctgagtagctgggactacaggtgcccgccaccacgcctggctaatttttgtatttttagtagagacgaggtttcaccatgttggccaggctggtgttgaattcctgacctcgagtgatccgcctgcctcagcctcccaaagtgctgggattacaggtgtgagccactgcgcccggccaaaatcaggaaatctttcccaaaacatcctgtatatagca

SEQ ID NO: 715323 - DNA, 176 bp, Homo sapiens
  misc_feature (98)..(98): n is a, c, g, or t
aaaaaagccacctgcaccagcaaatttagtgcccaactctctactgaacctcgcctctgggttaaacgatctctgcctcagcctcctgagtagctggnattacaggtgtcgccaccatcccggctaatttttttattttagtagagacaggttcaccatgttggtcaggctggtct

SEQ ID NO: 715324 - DNA, 384 bp, Homo sapiens
  misc_feature (9)..(9): n is a, c, g, or t
  misc_feature (140)..(140): n is a, c, g, or t
  misc_feature (218)..(218): n is a, c, g, or t
  misc_feature (234)..(234): n is a, c, g, or t
  misc_feature (244)..(244): n is a, c, g, or t
  misc_feature (260)..(260): n is a, c, g, or t
  misc_feature (271)..(271): n is a, c, g, or t
  misc_feature (357)..(357): n is a, c, g, or t
gactgcccnattcgagtcttgggaagattgggatgtattctgcacaagcaaaaatgactgaagttttatgtatagacacacctctaccaatccatcttcagctgactgaatgttgtatgatagcccttctccaaagcagnggtagaatgtttcaggtttcaccatggatcttctacttatttcgtttttggaatcagcttacagattccaggtccctnttgtatatacctttantcttttgctnttttaaaaaataattntgtctcatatntaaagcacttgtattagtcaatgtttcgtgttccgcattatctgaaccatttgcccttacagaaagagaaatacttgttttgtgtnttaaataaaactgatgtaggaaagtca

SEQ ID NO: 715325 - DNA, 199 bp, Homo sapiens
gtatgtactgtcctcaagcacagctgcttttattaaataatagcaggtagtgaaaattatccattatcagatacagttttatgtgctttataatttttgttgcaatcctcactaactccacaatgaagatattcatcctttcagatgaagtcaagacacagacaagttaaaaaatggtccaggtttgcagctgatgaag

SEQ ID NO: 715326 - DNA, 168 bp, Homo sapiens
catcgcatcatggccccatttgggcaaaagccggttagcggggtgcaggcctccctagggcagcaggcagggtggcatggcacattcaagggtgttcagtcatgttcagctatgtttccaggtgctgcagcatcagtagtcagggtctgtggttgcttggcagtttca

SEQ ID NO: 715327 - DNA, 290 bp, Homo sapiens
tcgtatggaaaaaaacccttaaaagtaaaattacatacatcagatatttatctagactttaaactagatgctagctagaggcagggaggatcacttgaagacaggtgtatgagaccagcatgggcaacatacactgagatcctacgttctaataaaattacaaacaaacaaaaaaaagcttatgccagtatacatgtcagtgatctaagctctggctacattattgaatttcttcaatttgacaagtctaaaaattgcgactgttgcacaggacacctcactgttacttc

SEQ ID NO: 715328 - DNA, 163 bp, Homo sapiens
tggtgcgcttgagctagtgcttaggataggcgcgtcaggtttcgagggtctcatgacttgggctctccttgactgatgtaatgacgagttcatccatgatgcagaaggtataggggtaaggccttgcaaaatgatgcgtggtcacataaccgatcgtggtaag

SEQ ID NO: 715329 - DNA, 261 bp, Homo sapiens
  misc_feature (55)..(55): n is a, c, g, or t
  misc_feature (63)..(64): n is a, c, g, or t
  misc_feature (167)..(167): n is a, c, g, or t
  misc_feature (239)..(239): n is a, c, g, or t
ccatgacttgtcattataaattagacaaccaggtaattgtgtgatatacatcttnatttaatnnttttttgtacagcaatcccctgagccagaatagattaaaagcgattcccttcaattttcaaatctagaactggatggtttttgtgtttatgcatcttttagantaccggaaagaacagagagccgtgttcagctcttgataatgagcctattcaatttgactacattcgttaaantgaagttggaattttgtttttc

SEQ ID NO: 715330 - DNA, 591 bp, Homo sapiens
agcggggaacaatcacttcagcaaggggttggggtattggggggtgctatggttagttaggaggtctggggacagggtcctgagattttccagataggtcggaagatgaaactgtctatccggggggtgttgatgacaaatctggcagccataaagatgattctatgatgctataattttggaagtatttacggtagaatttggtccaccctcccggtccacatacacactagcttaggttaattagaagagcaaacagaattaacaggggcatcatggtatctggtggggtcttagagtagcttctatacccaacaagcccacaggagatgtttcccaggaggaggtggcgggttaaagccatagaaaggaagtactacagtcaggaagaagagcaagatcaaggctcctattcccatctacagcattacattacctcttctggctgagggtggattattttaaataggtagcagaggtcttccaaagctttactgatatgggttgtggttgtagtggccttccttggtgcctgtgactcataagaaacaggtttagtcctggatctgtggtgccaagtgattgttcccc

SEQ ID NO: 715331 - DNA, 745 bp, Homo sapiens
  misc_feature (4)..(4): n is a, c, g, or t
  misc_feature (184)..(184): n is a, c, g, or t
  misc_feature (186)..(186): n is a, c, g, or t
  misc_feature (292)..(292): n is a, c, g, or t
  misc_feature (350)..(350): n is a, c, g, or t
  misc_feature (435)..(435): n is a, c, g, or t
  misc_feature (441)..(442): n is a, c, g, or t
  misc_feature (446)..(446): n is a, c, g, or t
  misc_feature (448)..(448): n is a, c, g, or t
  misc_feature (506)..(506): n is a, c, g, or t
  misc_feature (510)..(510): n is a, c, g, or t
  misc_feature (532)..(532): n is a, c, g, or t
  misc_feature (584)..(584): n is a, c, g, or t
  misc_feature (721)..(721): n is a, c, g, or t
tggntttccaagcctcattcccctccctaggtccctagaaataacctctgtcatgagtgttgagcgttttttccagttagtagaattagatctatttacacacagtgatatgtttactacatctcaaaaattacaatttagacagaaaaaaagttgtagaatgagtttttacagtataacggantncactgaaacacacacacactaagcagtgttatgtattgttcatcctttaaataaaaatttctttaagaatggagcacttggggaaactttcagaaatatcagtgcnatttaagaataactctccataaagaaaatctttatgaaagaagagggaatagcaatcnaatactgtttaagataatgtcaatttcattttacacatttccttgagtttctaaggatttttaaaaacttatggcgataaagtcnagaccnntacnancacagggggattggaatttatccattggataattgtacagttgaaagaagcccttganaggnattagatacatgactggctaangaggagggtcattcggtcgtcggggaggggactgggggagaaaacaggccanacgatgtttgcagaactctatttagcaaacctttggtcttggtgactgtataaattggcaattacatgcactttaaacagaggaatattgtgttgaattaaattgtacagtggtttgggttgaacccagttcaaccnagcaagtcttttgcctattaaaac

SEQ ID NO: 715332 - DNA, 311 bp, Homo sapiens
ggtgtatggatgcactccatttttggtcgcggcgtgtcctggcttcgcctcctctcctgatcctcctgaggcgtcctcctcctcctggagctgttggcacgctccgcgctggagtgctcctcttcctccaggaactgagtctttctccctctcgcgtcgctggcggcgccgttgttccttctcctcctcctcggggagaaaccgttgttcccgctgctggggctcctcggccctcagctgccttctcctgttgctccggaaatgggggccttggccgaaagcttcttgatggcccctcccgctcttttcct

SEQ ID NO: 715333 - DNA, 1081 bp, Homo sapiens
  misc_feature (1081)..(1081): n is a, c, g, or t
gaaatgagaagaaattcaggccagcttgtcgctcaggaactattgtgctggagttgaataacacctacgaagagagatgcagtcgcatagtgtccgagaagacccgtgtaggagccaagagtaagagtgcatgagagcccgttcttggaccccgagcagaacatgtggccgaagagaggattgaagtcgaaggcacgtccgtgctccgaagagtcgtcgccgaaagctcgtacccatcctcttaccccaagagccggaaagaggctggagcttggtagacttaggtaaccgctcgagatgtcccagcagacttcatgtgcctccttggattctccaggaagaataagaacggagaagtggccttctcggagatcacctcaccttctaagagatctcagcctgataaacttcaaaccgttgtctccagctctgaaagccccagagaaaaccagagagactggactctcttatactgaggatgacaagaaggcttcacctgaacatcgcataatcctgagaacccgaagttgcagcttcgaaaagcatagacattagagaggagagaacacttagccctatcagtgggggacagagatcttcaggtggtgccatccgtgattctgaaaccagaaaagcatcagcaagagggatgcaaagaaagcaaagcccagaatgagcgactctagtcccatcgtatccgcagaagagtccggctggactatgcatcggatccaggcagcagctcgggtctaggaacaagtacaggtaccagcagccgacagaagatcgcgccaaccaaagatcagacccagcggccgcaaaaagagtccaaaccgcctccagggcagaccagaagtggcggacgggacccgggagacaccctaaaccccggaagagctcgcagagactctagcctaaaccacgggcgacgccaaacgcacaaacgcttcagaccaggtagaagaccgagacggctgatgcacacaccgcgacaaacacatgggacacactaggggagcaccggaagacgatatcgcaccacggtacgcagaacgcatgatctattaactgcatatgagan

SEQ ID NO: 715334 - DNA, 1113 bp, Homo sapiens
  misc_feature (412)..(412): n is a, c, g, or t
  misc_feature (468)..(468): n is a, c, g, or t
gcaaggtgtgcctcaattcacagctgccgtccacggactctccggttattgttaggaggtccctgggcaagagatttatttctcttgacaaccaagggtgctccgtctggattctccaacggaatgaattatcctctgaaagcaccgtgaagcttgctatctaccgagcgatgcatgcccataccagatatccagtcatctgcatccccgtgagcacgcaacgaacggagctcgtactgacacatcgctcacctggatctgatggcacactgtggcgaggtgcagtcctcggcgtgcgagactgacgtccagctggtgagtcattcgctcagatgctggttctgcaatgatccacttggtcgatccagatgacacatccgcaaggatgaactcagtgcagctatctactcgncgaaggcatagtctgggtgacagtcatgcaccggacccgcgtggaaaccccctgancattgggtgtgtggtcactccttacttctcgatgagaacactctaaacagaaatggtccggagtgactcggtgctgtcccatttctccctcaaaagttagtcatacaatcctagagtggaccgtgggtctgttcggggcacttcacacggtacgaccaagggcgtaggtacccgcctgtgcgatgggacctaattgtgcgatgaataccaacccaagggtttggatggggctggtcctcgagtcgcttggtgccccatgtacaacggacaggaccgggagtcttagaactttcggccaaaggttggccgttgggtgttgctcgacaagcactctgggggcgaaacagaaacccccccttcaggtccccttcggcccattccattgcgcaacacacaattggccccaattggtttccttgagccccggttaaatggcccaaaggtgaattcctgggccaagacacgacattggtgcatttgtgtccccaataccggttgggacggccttggaataattacctccccctggattggggggaaccccattggactctgaaaggcgctctggccacgtaattgtggacccggaagaacatggtgcctcgggattggttggtactaacacagggttcctggaattgaacc

SEQ ID NO: 715335 - DNA, 184 bp, Homo sapiens
gacttagattgtcatccttggcctctgccatgatggtgaggcctactaccaaccacgtggaacggtaagtacataagatctcgtacattacgtaaattgcccagtctcaggtatgtctatcagtagcgtgaaaatggactaacacacccccatctctacataaaaatatagccaatgcgtatgg

SEQ ID NO: 715336 - DNA, 89 bp, Homo sapiens
gccttcctgccagggatcatcttacctccaaggacatcagagtctccctgtggaatctccccagacccccttgtctgcctgtgggtcag

SEQ ID NO: 715337 - DNA, 92 bp, Homo sapiens
aagacagcagcatatatctctgcagcgttgaagacggcactacgccagcccaagagacccagtacttcgggccaggcacgcggctcctggtg

SEQ ID NO: 715338 - DNA, 1067 bp, Homo sapiens
ggcgtccttttgtttgtttttagcgatacaggaatttccctgattgtccccaaggattgtgagtgtagtaggcgttgatcctcgtgcactgtggtttacttcgtgcactcatgtgggttccggaataaccgtgattcctagatcctacctgacgatatctatgagtgatacctgggacgagtgctgcacttatccccgagatgttaatgtctaggtgaattaataagtacaatataaatatagatccttcgcacgattgttggcaacccagaataatcgtttcatcagaacactctggggccttcgaagcaaaaccttgccttgatgtccaatcatcccacatacatggttgttgggatattgacatggcaatgtagcctagtcgcagccacgatccttaggcggtcctcgataatatcccatgatagtcctatcaaagacctttgtggccgaccacacataatgagctttttcctttgttcgcctcgactattcgcgaatgagttatactgtgtgtacatacgtgtgcgctttctgaattcgtatatatgcacaatataacggctagcattgcggcatcgtggagacctatgcacagcagtaaaaaccaagcctaagatgcagtgttttgtctggaaaaagtacccgcggggacatcgcaagaaccaaaatatctccatgggaaccgaccattggccggacacaatgatctccacaaatattcaatgttgtgtcggaaacattgacttaactctgcacgctaattatactagccccgcttcatgtaggtatagacacatcgaattaatacaacgacgcttcattgactctctacagatagggcgccaaacgcgagtggcgattggccccgagaagttactgcactcgacacataccgtggcgagtcagaaaataagtccacaccgcgcttaaagccctgacgggaacaccccggagagtaaccaagggttcgcttacacgaatcccttcgccatatggcaattctttgccccccattttttttacagccagcggtgctcaccctgtgtcacccaggcgttgggtcg

SEQ ID NO: 715339 - DNA, 254 bp, Homo sapiens
gtattaagcgtcaggcactctcctcaatagtgctaggtgggagctgcctgagagctaggatagccacaatggccacagacactgtctcgaggccttgtagacagtgggatctcctgggctgatactagttaggggtctgctcctaccccaacccgattaacattgtgaagtgactgaggctagggtgcctctcgcttggccccttccaactgccaaagttctgctatccctctgaaaccccaggaaaatacttt

SEQ ID NO: 715340 - DNA, 965 bp, Homo sapiens
  misc_feature (125)..(125): n is a, c, g, or t
  misc_feature (187)..(187): n is a, c, g, or t
  misc_feature (189)..(189): n is a, c, g, or t
  misc_feature (202)..(202): n is a, c, g, or t
  misc_feature (206)..(206): n is a, c, g, or t
  misc_feature (213)..(213): n is a, c, g, or t
  misc_feature (223)..(224): n is a, c, g, or t
  misc_feature (231)..(234): n is a, c, g, or t
  misc_feature (255)..(255): n is a, c, g, or t
  misc_feature (258)..(258): n is a, c, g, or t
  misc_feature (260)..(260): n is a, c, g, or t
  misc_feature (268)..(268): n is a, c, g, or t
  misc_feature (271)..(272): n is a, c, g, or t
  misc_feature (279)..(279): n is a, c, g, or t
  misc_feature (284)..(284): n is a, c, g, or t
  misc_feature (286)..(286): n is a, c, g, or t
  misc_feature (292)..(293): n is a, c, g, or t
  misc_feature (299)..(299): n is a, c, g, or t
  misc_feature (303)..(303): n is a, c, g, or t
  misc_feature (305)..(307): n is a, c, g, or t
  misc_feature (317)..(317): n is a, c, g, or t
  misc_feature (324)..(324): n is a, c, g, or t
  misc_feature (326)..(326): n is a, c, g, or t
  misc_feature (329)..(329): n is a, c, g, or t
  misc_feature (333)..(333): n is a, c, g, or t
  misc_feature (335)..(335): n is a, c, g, or t
  misc_feature (353)..(353): n is a, c, g, or t
  misc_feature (356)..(356): n is a, c, g, or t
  misc_feature (370)..(370): n is a, c, g, or t
  misc_feature (373)..(374): n is a, c, g, or t
  misc_feature (382)..(383): n is a, c, g, or t
  misc_feature (386)..(386): n is a, c, g, or t
  misc_feature (400)..(402): n is a, c, g, or t
  misc_feature (407)..(407): n is a, c, g, or t
  misc_feature (413)..(416): n is a, c, g, or t
  misc_feature (419)..(419): n is a, c, g, or t
  misc_feature (433)..(433): n is a, c, g, or t
  misc_feature (439)..(439): n is a, c, g, or t
  misc_feature (445)..(446): n is a, c, g, or t
  misc_feature (946)..(946): n is a, c, g, or t
gctgtgctgcgcggcgcggcgcggcgcggcacggcacggtgggagtgtctccggctggcctgcagggagaacaccgactgagacctcaaaccctggctccagtgtcatggaatccgtcacctttnaggatgtggccgtggagttcatccaggagtgggcattgctggacagcgcacggaggagcctntncaaatacaggatncttnaccagtncaggaccctnncctccannnnaactccaccatgcaaacccanttntntctcccanctnnggcaaanagcananccaaanncaacanaacnannnattctccgtnccacagntnttncctngnaatctcaacttaaacccnaanattttccttctatncannatcttttnnaanaatgcatcctccannnacatncaaatnnnnccngggctgttgcgctnaggatncagctnntgccctccatagaagagagggagacaccattgactcgagaggaccggccagctctccaggagccgccttggtctctgggatgcacgggactgaaggccgctatgcagattcagagggtggtgataccagtgcctacactgggccaccgcaacccatgggtggccagggattctgggaacaattcttagatctaagtcttgtgttgctcttcagtatatttttgcgggtaacaccactactgtcatccgatggtgagatggggacaggaaacagtcacaaagaaaacaccgacccctcctccgtggagctcacggtcagctgggtggtcagagttcgaaatgaataacagagtccagtggaagtgtgttatacaaggacttcatctcaggggacaggggagagttctgggaaaggatggatatttaagcttaggccagggtttctcaactgcagcactgctgataatgggctactgcagcactgctgataatgggcctgtncactctcagctgtgggccg

SEQ ID NO: 715341 - DNA, 218 bp, Homo sapiens
gggtgatacacccagtgatcgatctccgcagcggacaaatccgagaggtgttcgaagacgacgataaggtcaggattgccttacggcgtggtcggatcgtaatcacagcgcttcagatacaaaccaagatccgtgagcggctcaagcgaatcaaggacaagctcgatcgtggcgagaaactgccggtggcaagtctcttccatggcgggacgcgggtg

SEQ ID NO: 715342 - DNA, 433 bp, Homo sapiens
  misc_feature (50)..(50): n is a, c, g, or t
  misc_feature (59)..(59): n is a, c, g, or t
  misc_feature (85)..(85): n is a, c, g, or t
  misc_feature (89)..(89): n is a, c, g, or t
  misc_feature (126)..(126): n is a, c, g, or t
gacgggtgctgagtattcgacggcgtagattttgtccttggctttgatanctgcccaancatcttcaaacgtgggtggtttgcangcancaacaataatgacatgagtaatgtggctatccttatntgtctggtagcttctttggaattcagcgtacaactcgactgcccgaacatcttccatacctgttgtcccttttcctattcacttgggcttgccggtggttgatctgttcagaaccggctagcggctcactttgcccgagcgcacgtcgaggtatagtcgattggctatagtcatgccgccgcagtacatgaaatacataccttgacctcgggcaggggatgccatccatccgccgatttcttcgaagtcactggcggtgcaggtgccgttgtctatgagctcacgcgctgctttggtgaactgggcg

SEQ ID NO: 715343 - DNA, 220 bp, Homo sapiens
tcttaggccatttacaactatctcaacatccgttcattagataaaagggtggagttccctagggctggacattacaaagtcactcagaggtagcttagggccgggcaccaaagcagggctagacaaaggtagtggcaaaaagaacacaagtgactagctcccagggtgtagctccgtgaaggtggtgacagtgggttcagatagttggtaaagtgggcgg

SEQ ID NO: 715344 - DNA, 201 bp, Homo sapiens
tcttctcccctgagcaaataggcaggaccatgagactaggttatggccaactggattgtatatgaagataaagtatgtcatttcctagcgtggaactatttaatggccagaggtgataacccttcttaagcgttctctatctgcgtgtgactattgaaagatatgacatatcattctcaatgtgtgtagccgtccgatcag

SEQ ID NO: 715345 - DNA, 292 bp, Homo sapiens
tttccactcaaagattaacactgtcaatgcctactaaatgtgcactttggaaggctaaggtgggcggatcacttgaggtcaggagttcaagaccagcctggtcaacatggtgaaaccccatctttaccacaaatacaaaaattagctgggagtggcagcaggcacctgtaatcccagctactcgagaggctaaggtaggagaattgcttgaacccaggaggcggaggttgcagtgagccgggatcacactactgcattccagcctgtgagacagagcaagaccccatctggg

SEQ ID NO: 715346 - DNA, 591 bp, Homo sapiens
acagtgatgtgctgacagtcctggcgtgctcggtgccaggcttcgagcctggatgtgacgtaaatgcgctatatcatcacaaagaactgggtgtgactatatcaagaagagagcatccatagggttccatcgggtgtgtccacaattttgccacgagggatcagaagacccgtgtggcagattttactgtgatgtatgtcaagtctgtgtggtacagatgtgcgacacggaagtgtgagacgtgtacccactaagttgtcaacgtgccactgatgtcggtcatcttgataccatagcggggcatctgcatatggattcgctacaacacagtataggcttatggggttaccaggtagggtcaagggtaggagttaaccggagtctcaacacggaggcgggggctcccagaatggaacgcctctgtcatcagaaagtctcagaatgggttcaaagtgtgcagaaattagcgggtgggcatgtgacatagcctttgtaaggccgtggccctcgatttaccctgcgcgtcgtccggggctcttggtgataggcatgactacgaagcgtcccccttcggtggggaggaggcttggc

SEQ ID NO: 715347 - DNA, 193 bp, Homo sapiens
  misc_feature (170)..(170): n is a, c, g, or t
gtgtgacataagttaaagtgctggagcaggagagaccatcttgatggcacaagcagcgcatcattttggcattaaggaccacaagtctcctctcatgatcttgcagcttgctatctctcactgtacctttccttacgttgagtctttgtcctaattctttccattacccnccttgttacggaattgagtgctt

SEQ ID NO: 715348 - DNA, 365 bp, Homo sapiens
  misc_feature (63)..(63): n is a, c, g, or t
gacagtgtaaaaaaacttcctaatcctgtctctctctttcctactcagttccggttctcacangcagataacctcccaagcttattgactgtctatccttccagattttcttaattcttacagaaacagccgtgaatgtgtattcttttttttttacacaaaatatgctacctatttatacatttggtaacttgggcttttttttttttttgttaactgaaggtcatatacttcttctcagtgaatagagagagaccgtgatccttttcatagcgtgcaatattatcccagggggggagtgtaattaataggtttcccgggggagagaccctaccagggggagagaccctaccagggtggagaga

SEQ ID NO: 715349 - DNA, 260 bp, Homo sapiens
catgagtctatcatccttcttacagagcatctcttttaactgttggacaaaaccataactttgtcattttacaaggaagaacctcttaagaagtcctcagaaaccaccaacactgtgcactctcagcactggtcctggtgcgtttgctgaccatgactgggccaagccgttctttttgctggccatcttcctcatcatacagtgtggaacatgggcaatcgctttgagattcttgcgatagaagaggacaacattctgca

SEQ ID NO: 715350 - DNA, 324 bp, Homo sapiens
gtgaacaccacagaggtaagatgctagaaaagaggttaatgatccatggccgggcacagtggttcacgcctgtaatcccagcactttgggaggccatggcgggcggatcacgaggtcaagtgatcaagaccatcctggccaacatggtgaaaccccatctctactaaaaatgcaaaaattagctgggcctggtggtgccctgtagtcccagttgcttgggaggctgaggcaggagaatcacttcaacctgggaggcggaggttgcagtgagccgagatcgcaccactgcactccagcatggtgacaaagtgagactaagtttcc

SEQ ID NO: 715351 - DNA, 742 bp, Homo sapiens
tatgtctctggatgaagatgaacctcgattcctgtgaagaacttgtattacagtgcaggaagtaatgatgacgttagatattgagttggctgcaaatagtaggagattatgaaccttctgctcaagaagaagtgactttctgactctggattatcaagaacataccttgacctgtgagcccgctgccatgctgcttgttcactgcaaagaattaatgaaatatacttggttatttatttcccatggaagacttgagagaaatgagtttagtacagagcgtgactacccaagaagaccacaaacgtgaactctgggcccagttctggtgtttcaagaataataaatgtgcttatttaattaactgatacaaattgcgcgctctgtctttatctttccgatattcgaatcgcactttatcgtacgcatctgaatcgatcacaatatatggatttaccctttgaaacaacagaaaagcctggagtatacattcgcatgaatgtttatctccctatggttatatcctgcatcaagtggataattttgaagtgtgttcagaatataaaattggaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtccagggtatgccgtgaaaccata

SEQ ID NO: 715352 - DNA, 215 bp, Homo sapiens
aggcaccattcacatctttagatacaataggaatacatgcccactggtcaggagtactcctgggcagcaatattttaatcacaatcaatacttacaacagtaatagtgcaacatgacaaaattatagtgaaaaaaatcttcacatttcctttatagtaaggtaggtagttggtgttttacttcagtggtactttcatgttgcctttcggagaaga

SEQ ID NO: 715353 - DNA, 500 bp, Homo sapiens
accctcgcggtagactccggcgaacggagtgacacggaatgactgtaggtgcccatgaggggcgtgcacctgggggtacttgcagtttccagggcaacaagcatctctctaccaacctctcctggcccctgagaggaggctggcttgaatgtcgcatgtgatgcctggacttggtggccacttggtaaccataaggctccaagcttcatatagaagactatcatatgaaccagaaagggtagctgaaaacaaagaaaggactccagtatcaggctaaggacatggcttaacaggatgagggaggagcagaagtcttacacagcaaggcacgaaagaagccgtacgtgaacaggtggtcagtataagcaatacttaatataccctgttgtgattattcagcaacgtgacgcttgtgaagtgcgtagcccgagtagcgaatcttctgtgataatctcggcaaacgactgtgacagctctgcttttaggcccagaaggacgcg

SEQ ID NO: 715354 - DNA, 412 bp, Homo sapiens
  misc_feature (5)..(5): n is a, c, g, or t
caatngtccctacaaggacaggccctaactggataaccgtggctttttttttttgggtgaacatagtgggattggatcacgggtcaaaaacgctttatattttcgaaagactcggggcccctcttccctcttcggggttccctagcggttccctttcggccccagtcggacccagtgaggggtcgctttaaaacacccataatccaagatggacggacggcacggatgctggtacctcgggacaagaggcctacacccaggggctaggacattaactctttcctttactacaccaggtgtcggcatgtgtgtgtgggtgtgacatgtgtatccatgcccatcagcatatagtcacatgtctgaattcacggtgtccagacggagccccatcaaactagtgggacagggcccc

SEQ ID NO: 715355 - DNA, 999 bp, Homo sapiens
  misc_feature (979)..(979): n is a, c, g, or t
ttttcctgtgcatgtcgccttttgcgcagctgacaaaacgggccccatttatcctcattttgttgttgctctatcattattactttgattattgctctcgtcaaatggttcgcttgtgcgcggtcataccacttccaacggcgtgtttgatttcaatacggtgtcaaccttacaatgctgcgccttgtatattgtcctccttgtggttatattccatagatatcgatggttttgttcaccaagtgttcttacggaataacgccactggatatgggttctttcaagtcgatggtgtgtttcttttgggactttgaatgtgggcgtctttccttttgcgacggttttcgtgcgtcgtggggtgctctcgtggtatagggatggctgctatgtgtctgccctccttgtatgtaggcgcgtgttgccgccgccccgcgtcatgagaagaaagaagctcggccagctttggccgttggagcgtgagtggttgcgaaccatggccatgggaacagtgcgtgtgccacgataatgtgtggcttgcctttgcatcgtatccgggataagcgagggcttttagctcgactgcaagacgcaaccctaggttgcggaattcctagagacatgtgcatgctgagtgttcgagaacgtgtgtacaaggttacggagaatggggttagggccatgtaatccgagacggaagatagccttaggtagctcttctggaaggaaggcctgtgtagactacctctgataaaagctgttgaagggtccaagaagagtatggcatagggggatcaatgtctcaattgttacatcatgaccttgttacttaaggaaagctaacctgcatctatgagtctgcctagagtctgggaatccagagaaggaaaatctttgcattgttggtagggaggaagctctaagcgttcagaagaaaaagaattgcttcccgacacctagaagtaatgtcaaactgagattntacgcccggggtactgtaca

SEQ ID NO: 715356 - DNA, 179 bp, Homo sapiens
taataggaagtatcaaggaaaatggatttggtagtaaattagaagaaaacacttcaaactatcaattctttaaaagaaaaaaaaaactagtctatcttgtcctgtaaaaaataagaacgctttgtcatacaaacaaatgatgagagaattcttccacatgtacttctgtgcttagaaca

SEQ ID NO: 715357 - DNA, 1295 bp, Homo sapiens
  misc_feature (788)..(788): n is a, c, g, or t
  misc_feature (1151)..(1151): n is a, c, g, or t
ttgtggcttgtgtacgttttgctctcttgttgtcggtgtgttgtcagtttgttctgcctctccttcgtcgcttgttgtccgtgcttgccttctcttctacatttgtgtgggctggctcatcacgtgccctactttggggtctttccttgtgcccggggatttttccgagccgccgggattttgggcgcccccgcctctggtgtgtctgttacttggtgaagagccgctttcgccttttatacaccctccttgccgaacgggtttgtgggtggatgatatgccacgtcctgcgggattctcagtattgagaggtgataacacgaagagtatgaaagaaacatttttttgtaaacccccctttcaaagatatataatgcgcccctcttttcccccccctagagcgggttttcccccagattctgtttagaaagtttccttccccccttatccccgcaaatgtctcccagtttataaaaagaattgtctcggggccccccaccccaaaattttgcccaacaccaaaaggggttccacccccccttggctttctgacccccaaggaccttggacacttttttgggggtttttaaaacaccccttttttctctgtaaaaagcactttttccacaaatttttcccccccaagctcgcctctttctgggaaaagagagaacccccgcgtccacgaggccggcccctcttaactcttcccaatgtgttctacactgcctgaggaatatgaggcctacctctatagaggagaaaatggagaggtttcccagcgtgtngaaccacgcagattggagattataggaattacacgagagtttgtgaattggggcactctttccacagtgtcctcgtaattctaaagagagaaaaaaaaatagcacccgttatagggcgcctcctgaccactttgttctcgtggttttaacgtgggttctgtgtcactccaaaatttcccctctttcccgtgttttaagaaatgttcgttctaccacgagagagaaatgctgtaaaaattttggaacccaccactctttttttaacccaggcccacaaaaaggaaaaaaaggtttttgggaaccacaatgagaacttatttaaagtggttttatatgaaacactcacattgttcttgtatattnttggataagcacccacgtaccacgcttttactttgtaaccacgttctgtggcacttggagaaaaaaggaggttctgtgattgttgaagtgaattatgttataaaagccaagagaagattaaatatttacaaacatattttttta

SEQ ID NO: 715358 - DNA, 176 bp, Homo sapiens
cattattcagagggttcttccctgtgtgaattctctgcatgtcatcaaggtttgcacttccctcacagcaaagcattccccacattccagtcaccattccaacagggtccttccatcatagcagtcgttgttcatcgtagcatcgtcacctcctcacagcagcattcatctttcca

SEQ ID NO: 715359 - DNA, 962 bp, Homo sapiens
ccccatgattcaattatctccacctggtccctcccaggacacatggggattatgggaactacaagtcaagatgagatttgggtggagacaagccaaacgatatcagtacctttgacaggatgcgtgaccctgctgaggtgtgcgggagcttggcctgagggcttcgggctgcgagcacatgtcctccatggagcacacggaggagggcctccggggagcgacttgccagaagccatgagcgagtcacctagccgggacgtagtgggaatccggaacagagacagccttgaggtagcagtaaaaaccttcccccctgagaggacacgtggcaagtgaagtgtttggggaaaaaaaaaggcacaccacacacatcatggcccaaaaagccacaagcgtacggtagaggcaacccccaacaagataacaaacagcattggcagtaacggacatgagacgcaacagaaattcaggggagaggggaaagactcgagcagctctggcgtaacaagtgcaagggtcaccacacagggggaagcactaccgaagacaactttgacggctaacggaatctccgcgtgccacccaatgagagaggcagcccatcacgactcttcccgaaagggattcccgtagggcacaagcaacctcggttcacaatctgggaggccccttccttgttgatgaaggtgaaacagcggggttagggccaaccataaagtttggcttcgttaataaaccaactcccaggtttttcaagcgcgcgccactacctggttgggagagaccttctcaaaagacaaaggattggcttgcacactggtcatgacactgcgcaagaacagagaaatgcgacctgtatgtcaatagacgcgcatgggcacgtggataaccaccacgggggtgaggagcgaacaagcaatggcgtcgagatatcccggtctggagacgctgctgtggatccc

SEQ ID NO: 715360 - DNA, 805 bp, Homo sapiens
  misc_feature (11)..(11): n is a, c, g, or t
  misc_feature (15)..(15): n is a, c, g, or t
  misc_feature (292)..(292): n is a, c, g, or t
  misc_feature (308)..(308): n is a, c, g, or t
  misc_feature (315)..(316): n is a, c, g, or t
  misc_feature (338)..(338): n is a, c, g, or t
  misc_feature (344)..(344): n is a, c, g, or t
  misc_feature (681)..(681): n is a, c, g, or t
  misc_feature (687)..(688): n is a, c, g, or t
  misc_feature (692)..(692): n is a, c, g, or t
  misc_feature (703)..(705): n is a, c, g, or t
  misc_feature (714)..(714): n is a, c, g, or t
  misc_feature (729)..(729): n is a, c, g, or t
  misc_feature (736)..(737): n is a, c, g, or t
  misc_feature (740)..(740): n is a, c, g, or t
  misc_feature (747)..(747): n is a, c, g, or t
  misc_feature (749)..(749): n is a, c, g, or t
ctggagagaanaacntaggctaggtacgaggctgggtggtgatcattcacaggtgcctctctagcctgcacaaatgattgacaagagatcacccaaaggattatttctgaaggtgtttttttctttatttctttttcttttttttttttttctttttcttttttttggcacatgacagtgttggtatggaggaccttccaaggaagagggatgctgtagcagtggtgcctgggtgcctggcctccagtgtcccacctccttcaccaccccacttgggctccttggccatctngatgctgaggttcccngttgggnngagatcaggtggttggtggtanaagaanggaaagggcttctgatggcttggccacaagcttacctggtgggttcacagtccgtggagaggccaccaccagtttcccatcagcacgggtctccagtgcagcagttgcggggtcccagtgtccagctgcctcttgggctcaggggttataccggcttccggcccccacccccacatgtgcaatcctcaagattggtccggattctatttccgggcacctccctgcctgtcctgggggattctacttcttcctgtgtgggagcccatagctgtggtctaacaggtacgaaatgaaattgaacctatgtgactgggcccagaaatcataaaatggtgcngacagnngttnctgtgtcctgnnntacccccantccagtacataactnctatgtnntgngtagagncnttctatatgctgaatgatctgctgtagaaactatgccagatataagccagtgtccg

SEQ ID NO: 715361 - DNA, 403 bp, Homo sapiens
aaaccttctctcctgtcaacagcggccagcctcccaactacgagatgctcaaggaggagcaggaagtggctatgctgggggtgccccacaaccctgctcccccgatgtccaccgcgatcaatcgaggagactccgtctgacatgtgtctggtccctgtcaacacctcttcatgaacactgtgcctgggcttcatagcatcgcgtactccgtgatctagggacaggaagcatggtgggatgacggtgcccagcctatgcctccacgccaagtgctgaaatctgccctgttgggcatctctgaacattctgctcatcatcatcccagtgttggcgaccggccagtgaaataggaggatatgaggcaggacctgcggacgttcagtatctttcacccgctgccagg

SEQ ID NO: 715362 - DNA, 271 bp, Homo sapiens
atacacagtttgctagaaaatagagagtatatcggctgaacaagaggtggtgaggtagaatcggagttatcgattacagaacaggctcctctaaagggatatgaagcaccgccaggatcctttgagattttacagctgtggctcgtagtgttctggcgagcagtttagttgatttaactgttgaggtttaggactaagcatagtggaccgtctacttgcccaacttcatgcactggtacacccagtggctcctctttaacttcccccagca

SEQ ID NO: 715363 - DNA, 168 bp, Homo sapiens
gcagctctctctgttgggctggcggtggttcctataagggaggtgctgctgtgtgccttgcagtgtgcttgagcacagccttggcagctcctgtagtggactttctctggcccaggggcctgcgagagtgaaaagttgcttgtggtcatctcaagtgtccacgtgggt

SEQ ID NO: 715364 - DNA, 133 bp, Homo sapiens
ctgagcccgcgagtcattagctatagtgagtctatgatcatgccactgtactccagcctgggtgtcagagtgagaccctgtctcaaaaaacaaacaaacaaaggcacagagaagttaactaacttgcctgtgg

SEQ ID NO: 715365 - DNA, 789 bp, Homo sapiens
tagaacagagcctgatgttaatcaggacgaggcgttccctcctccccgcctcaggtccacggccaccatggcgtattagtgggcatgcagtgcctgcggcagcattggcctttgcatgcggcgtgcagctagcaccaggctctgcatgtggaacccccagcggcttaagccatggctgcttctcactggcattcagcagcagcgttgctgtaacctgacaaatgacaccttcgaattaagcacattcctctgattccagcaaatgcaaccgcaacattgacctgaaatgagcttcctgagacagcgaggatgtatggtgggggacttgattgtccccctttcgaccagatcgggatagggggctgaacgaacagcctagagtctcgttagactgattaccttgggagggttgcccacagcactttcaaacctcattgtgattctccagctgactgaggcataatggctggctcctccgaatggcctggctgtggatgggttggccagtccctccaacaacagccacggaaggattgccctatctcctgggaccatatttggcatgttgggagacaattggattttgaatggagtccgactttggatgcccctgttagagtatagaatagacctggaaacctatgcaagatgacttctgaccagcgttggatgacacctctgtgatctctatgccccctagtccaggaacactcataagcgccccccagacggtgacccaattggcctctccctcattttaacaaaaccgacaagttgcccttcacttta

SEQ ID NO: 715366 - DNA, 896 bp, Homo sapiens
  misc_feature (100)..(100): n is a, c, g, or t
ggacgcgtgggcgacattccatcccttcagagatggagtttgatcctaactccaacccaccatgttacaagacatgggcccaatttctgtgaactaggantcaagcgcagttgactgaagaccccgctgacaagaatgcgatgcgagagacccgtgctgcgatcatcagactgtgacagtaatcatgcatatgttcgcgcttgcccctgtatgcgagagagtataccgttgcgtgcgcgttgatacacgcatgatggccttgtgttgcgaccatcccgttaaccccccatcgagtatctcgatacctacttagaggaacatgcgtgagtgacatctatgtttccaccgaaccaatctacgtcgacgtgtatgcgtaatcacaaggcacgcgatcacatgacgttcttgcgaccatgacattgctttagacttgcgcacgagtgacaacgtgatacgcggcccaaacagttccagtgccactaagacatactcgcggacgacttccttgggggattgccattatccaccttcgacgtaacgcccatgtaaaaccttttaagccttgggacctcttgccccatccagacttctatatctccccaccgcctaagttgtatggcatatccccttacaccgccttacttaaacaacacacggatccccacatctgtcgtcataatcatatccacccctataaacacaaaacacaactaaactcacacaaaccacaaccaaaaaataacaacaccttcaccaccagaacatataaccacacacgacacaacacacacaactataatacaaaccataaactaccaacaaaccaacctcactaaacaacaacaccaccaaaccaacacactaaccagcatacacatccatacaatacacactat

SEQ ID NO: 715367 - DNA, 126 bp, Homo sapiens
gtgatagtatctccaagaccaatgataggtctagatgaaccatacagactcctctgcgccaattatgcttagtaccaccgggaacatttccattactagtgaatcacatgagacggtaaagaatga

SEQ ID NO: 715368 - DNA, 795 bp, Homo sapiens
  misc_feature (276)..(276): n is a, c, g, or t
  misc_feature (515)..(515): n is a, c, g, or t
gggggccaaacctttctcagaaagaatgggaggcgcaaaaatacgctttgtctggttccatataaactttgctctttcaaagcactgggagctctgaaaaatatttttaggctaactctcagacgtgttacgacaagacagcatggatctgttttttcaaccaaaagcattttcatatgtgtcaacaatcttaggggggagccactccaaacaaaagttctcttaactgggcgagaaaggcctcaaaaatccaagtagaaacctttcatgaaactntgagtctagaccctgataaccacgaacaacccctcatttttatgcacatgaatgcccttggccggccggccttaagcccataactactcatgtacttaagacccctttttctttggcggcacagatgcaggcttcacattgccacaattgaccctaaaaggggggcgtctttcacaaaaacatgtgcccggctgttttcaaacggagagtatctagaaaatcccagagggtcacccaanctaaaaccgctctgggggcaatatccccttttgcaccgctggcgtaaaagcaaaaagggcctgccggatctctttcccaaaaattgcccagacaactaaggcgaaaggaattccaaaccttaatatcttttaaattccggcggacatttttgaaaaccccctcatttttaaccttgggccgcactgggaaaaccccttttaaaaaattccccgattcgggtgggggttttcccctttaaaccaagttcccatttaagagcggcctccaaacccccagggc

SEQ ID NO: 715369 - DNA, 740 bp, Homo sapiens
  misc_feature (610)..(610): n is a, c, g, or t
acgcgcccgctgcactggcccgctgggcctcccctgagacccctggctcccggcccgcttccgggaacccctcgtgcctccccggcctcttcgccagagcgcttcggccttcccgacctctccccgtgagccccgggccttccccggctgcttccctgcagtccttcctcctctcgccagagcccgagcgcccctcggagaccctcgcgtttccccgtccgctctcccggaggcagcgcggggctataggacgaagttatacggaagcgtctcctcattgatggagatggtgctggagatgatcggagaattaatctgctagtgaagcagtttcattcaaatgtgtgcaacgtcttgggtcccagcgcaacgcagggcatataggccagtaccaacgtatgctgagtcacggctgtctcaatgtgaattttcacatgggcaaaactttactagtatattgatttgaatctcagagaagtggccccattttgacccatctttaccagggcatgcaatgtagcatagcttggagcccatgaaagacattgctgagtgcgaaaaagcaaattcttcaagcaaaacgaatacgaaaaaatccggccagaataantatcctttgggccaaggtgtttagcgcccatccgacaggctgaggacattaggactaagggcccgggacaaaattaggcggcctttcctttagaaagtttggaaaacgcgttgaccgaacattcgtgtcc

SEQ ID NO: 715370 - DNA, 318 bp, Homo sapiens
tgactgctgaaggctcaggttgggggttgcccccaggacagcgacctcatgctcctccttgagcatatcatggttggtgggagcggccggtgttggcaggagtgaagagggttgggacagtgtggttcatggtctccaggaagaaccagctgtggttgggtggctgggatggtttcagatatttccattgggtgcctgcttccggggtagaacctcaaacatgggaagacaaggggagtttctgagatgctggtaggtaattttcttaggagccatcgcttctgggctcagatcagatcagatctgcccttcttagcc

SEQ ID NO: 715371 - DNA, 547 bp, Homo sapiens
  misc_feature (39)..(39): n is a, c, g, or t
  misc_feature (55)..(55): n is a, c, g, or t
  misc_feature (61)..(62): n is a, c, g, or t
  misc_feature (64)..(67): n is a, c, g, or t
  misc_feature (105)..(105): n is a, c, g, or t
  misc_feature (439)..(439): n is a, c, g, or t
  misc_feature (444)..(444): n is a, c, g, or t
  misc_feature (470)..(470): n is a, c, g, or t
  misc_feature (479)..(479): n is a, c, g, or t
  misc_feature (525)..(525): n is a, c, g, or t
  misc_feature (547)..(547): n is a, c, g, or t
gacccgcactgcagtctccagcctgagccatggccgccnagccctcctgctcctnctttgnntnnnntggcgccctgggccaccatagccctccggccggccttnagggccttcgcagcctacacttgccaaccaaccccacatccctcccggctgtagcaagaactattcggttctctacttccaacagaagcctccgctggtgataccaggcaaacagggtctggaagggacctccagcaaactccagcagacctgcagctgaggatcccgactgttagaaggaaaactaacaaacagaaaggacatccacaccaaaaccccatctgtacgtcaccattcattcaaagaccaaaggtaggattaaaaccacaaagatgggggaggaaaccaggaggcaggaaaagctggaaaatttttaaaaaattcaggagttgcnttttnttccttccaaagggattgtcggttcnttcaccggnaacaggaacaagttgggttgggagattgtttttggtgggtttgagnggaggagggttttcagtggttn

SEQ ID NO: 715372 - DNA, 291 bp, Homo sapiens
  misc_feature (85)..(85): n is a, c, g, or t
  misc_feature (94)..(94): n is a, c, g, or t
ccatagaggccatggaaagtgatgactgacctaattgaactgtagaccaggatatttttataatatatattgactgtatatatgngtatgatgntgctagcaatgagaataacaaaagcaagaagactcatctctcctttcagggaatcacatctactggcagagtttacttgtaagtgtataattatcatactacatggaaacgtaagtagcaatcaaattcttagattaaaaaaaaaaaagtccctaggttatcctacccataagcatattaaacagctcgcttcacat

SEQ ID NO: 715373 - DNA, 307 bp, Homo sapiens
gtcgacgatagacacagggagagacagagagatggagggagaaatggagaaggttacagagacagacacagagaaagagatggggaggggggagacagagaccaggagagagagagagagagagaaagagagggagggagaataaaagagggagggagaatgagagagggagagacagagacacagagagagagatgggaacggggagagagagacagggagagagagatggagggagaaagggagaaagatagagacaatccagcaggtcgacgcggccgcgaatttagtagtagtaggcggccgc

SEQ ID NO: 715374 - DNA, 831 bp, Homo sapiens
ggcccaataacaagatgcacattaactgagtaggtggagtttttatttctgcaaccagttgcagggaaaaggcctggaaattatgccagaccaacttaaaattacaaagtttttcagagcttatatattttttaagctatatgtctatacatatgtgtacatttatgtaaagacataagttactgacttttaatctattaactaaggatgagtcttgaagaccttcctctggagcctcagtaaatgacttaatttaaatggctgtgagtgctggggtaattacccttgcttgccttctgctaaatcacagcagttggggagttttcttcccaataaaactggcttaatcctaaatgggtcctgacgtattcttcgttattttatgttttaaggcccaggaaaggcctaagctaaactttggtgggcttttcttatatcccagccttgtataagggccttggttttaatatttaactactcagacagtactaaaacacttgttacagaggcctgcgttagtgagaactggctggcacaatccccactgtcaattgtcatgctttttatcatgctgtatatgtcttattactcccgagaatcgtaggagatgaagcatgtattctttcggcggtccgctgaaaagggtgcgcctggggccaaaaccggccgggggggaagggatggtccggcggaccctggtggggccgaggagcccgctgagaagatgacggcacaaaaggggggggcccacaactcaggggggagacaaacgtgctcgacagacaaaaacacagggatatcagagggacgcacccggaaaaaaacacctag

SEQ ID NO: 715375 - DNA, 485 bp, Homo sapiens
ggggctttttaattaagctattgtaattaatagctgtttacttggatcatttcttatttttgtgatgcctgccttgagactgatttctagaagtgaggttgctggtcaaaggccgttgtatcattatcaacagcaatgtatgagagccgtgtttccacacagactggaaagcagactatgctggattttgtcaagcagagagattaagtaactcctccatgagcactcagctagtacaacttctccagaacactgagctatcgctaaagaggagctgtggacatctaatctaccaacattaagccattgccaccacccggagaaacacaacttacccttgaagaatcttttaccttagaattaacggttccggggaattgaaaaagggggaaattggggaatgggaattagtatcatttggggtggtccataatgctcaagtgcctattaaaaagcctgctaatttattggtaaagaaaaaaaaa

SEQ ID NO: 715376 - DNA, 896 bp, Homo sapiens
gaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaatttttttttttgagacggagtctcgctctgtcacccaggctggagtgcagtggcacgatctcggctcactgcaaactccgccttccaggttcacgccattctcctgcctcagcctcccaagtagctgggactataggcacctactaccacgcctggctaatttttggtatttttagtagagacggggtttcaccatgttagccaggatggtctccatctcctgaccttgtgatccacccacctcggcttcccccagctaattttttatattttagtagagacaaggtttcgccatgttggccaggctggtcttgaactcctgacctcaggtgatccgtctgcttgggcctcccaaagtgctgggattagaagcgtgagccaccacgcccagccttttttgtatttttagtagagatggggtttcgccatgttggccaggctggtctcaaactcctgacctcaggtgatctgcccacctcagcctcccaaagtgctaggattacaggataagccactgcacctggcagctctagtcttatttggtgaaaaagggaggcattgagggaaaggctgctggcctggacactggagacgtgggtttacccacacagcttgggaaatttatctaaactctctgggcccttgtactttcagttaaaattggggggtaaagtagaacaggtaatttcaaattcttccagagttccagg

SEQ ID NO: 715377 - DNA, 152 bp, Homo sapiens
tgcacagctaccgtcattatgacgcggccagttatcacattgttgatcaatcgcaaacgttgattggttatatggtgatacacatagcgaccctgatcgtttaccacggtctccagcgagtggtataaccagatcaactcgttggtaccact

SEQ ID NO: 715378 - DNA, 144 bp, Homo sapiens
catgcgataaagctgcggaaacacaagatctgatgaaggtcttacccaaccaggtactgaagcccttacctggaggattccaagtaccgaaatctgctgccctttttgtggggcacaatatgctgctggtcagtgaagagccca

SEQ ID NO: 715379 - DNA, 241 bp, Homo sapiens
tcagtctgaacggagcttacgggtctgagactatgggtttaggagatatagaattaagtcatctgcagactgagacgtagttgacttccctcttcctatttgaataccctttatttctctctcttacctgactgccctggccaggacttccagtactatgttgaataggagtggtgggagacagcattctcgtcttgtgtcagttttcaaagggaatgtttccagcttttggttatttcag

SEQ ID NO: 715380 - DNA, 144 bp, Homo sapiens
tctgcggtgcttggggggctgcccttcgtgctgtctgtcgactgagctcaagaaggtgatctaagggccgcggctcctccacacacacacacacaccagggaaccaagagaaccacgtagaatcctcaaccgacaggaccattg

SEQ ID NO: 715381 - DNA, 268 bp, Homo sapiens
taattaccagatttcggaatggctaatatccatatgccagacatgtgatgcattcatcagacgtgtgcggactttggggctgttgggaaacagcatttggcctttaacctcctcctcagacacaaagaggaaagggaaacaggacaggaacccacactagtaaatccaaactcaaatcacattctctgaagaactccgacatgttccctgctcaacgttccacctaaagtaagtaaggacccctaaccccatataccagatagggaaa

SEQ ID NO: 715382 - DNA, 404 bp, Homo sapiens
attaagaggaggtttccgatccaaaactgggtacccttttttgtccgagggtttgatgcggcccctccttcggctcccccgaattcctagactggggtaatagggtcctattgtgaatgtctccccaccaaatgacttgagtcccggggaatctccttaggggttaagaatatttccggggtccctaatggtttgatttttggtttctgaaaatgggttttattttattttatcctaaaaattccggtcctctaaattgggggttctggcactgggaaggttggccggacccctggctggtatggaaggtcagcggtggatgtctccctctcccccgtggggccccttacctgggggatttttatactaaaaatggagaataaaggccattttggagatttgga

SEQ ID NO: 715383 - DNA, 130 bp, Homo sapiens
ggtgtgccggtcggtgatcggcgactgaacacggaggactcaccagggagtggggactgagctgggtttccgtttggctgtggtagaagaggtgtccagtggtgaggtgcaggtggtggagtcgtggggg

SEQ ID NO: 715384 - DNA, 174 bp, Homo sapiens
  misc_feature (5)..(5): n is a, c, g, or t
  misc_feature (22)..(22): n is a, c, g, or t
  misc_feature (35)..(35): n is a, c, g, or t
  misc_feature (68)..(68): n is a, c, g, or t
  misc_feature (73)..(73): n is a, c, g, or t
  misc_feature (165)..(165): n is a, c, g, or t
caagnccctgcaattgaaggangattgacctcctngctaatggttgaactggcaattgtcccaaccanatttntgaactgccgaggtgaaaccgatgtcagctctgactccccgctccacacccccaggtacttcttcctctccatcctgtgctgggctgacatnggtttcacc

SEQ ID NO: 715385 - DNA, 364 bp, Homo sapiens
  misc_feature (294)..(294): n is a, c, g, or t
  misc_feature (296)..(296): n is a, c, g, or t
  misc_feature (359)..(359): n is a, c, g, or t
cgcacagtgctgccaggtgtaagagccacgtctggatgagactcgtgctggaatgtgtgtgcctgaggaggccaattaaccttctcaggtctccccactcgggctgtgtaatggaggtcactgcctgccttgcggcccgggagggcttccagtgacatgcgctgagagcgtgggctcttgttaggtgcttggtgaatggcacaggtgatctttacctcctgggcccacggacatccaggtccctgatacttattggcggatccagggcgctgaacaaggtgcccagggaacatnantgaaggtgacatgcagttcctacgtgctaggagcaactcggccaggatggaagaaggaccttnggttt

SEQ ID NO: 715386 - DNA, 1121 bp, Homo sapiens
  misc_feature (581)..(581): n is a, c, g, or t
  misc_feature (1121)..(1121): n is a, c, g, or t
agcgcaggggccggggtctgcacgtgactggtcgcactcccctggtaggtggggagctgacgtaatgtgcccgagcccgagaccgtggcgtcgcgcgaccggtccacgatgatcttgctaccgcggacttcttgcttgtgcagctgttgtctcgctggcgaggccgtgctgggcggtgagtcgcgtgcgcggagcactctggggtgcggtgaggctcgccgtccgacgcggcgccctgggctgggcgtgtgaaccggctgtgctggtctggcgagcgcctcttgtgtgtgatcgggggcgacgcacgcccggtagactgagtcgggccttgtggtgcaacgctcagtcaggcgggtccggctgtgctttttcctccgccgccgtcgccccggtggtcgggtggcggtgtgttgggtcctagaaagagccaaccgcacgggtcatcgcacgtttgtcggaggccaggtcagggcagggctgatccgcttgaacggacgggaaggcttcatccgaggagagcagagtaccctttgacacgacgatgactaggcttgggcgtaggaagaagcgtcattgtcagnttcaccagttggggaacgtctcgtatggaaagctgaccaatcaatcacttcgacatccgaacacagagtggttaggaaagccgagtcagtctgagtagcagtaggatttttaaccgggacattggacgtggggcacttgtgagcggcctcgcgctctgtagaagtaagggacgcaaaggaggagtaagatcctgtgactcgaaatcagaacctgtgtgcacgcccttggggcgcatcgaatagccttttgtcacctagagcaatggagagtgagaggctgcaatcgcgcgactagaatgccttgcttgtgccactgacagaaagttacattgtgctttctgggacactagcgatcttttgaacggagcacgagggctccatattatagagcggggggtaggaaaccgccgtgggattcgcagcgaaaactggggtcgattggcacaaggctccagtttataattgtgcgcttgggacttcgcgaatgcgagttatatacggggcagttttaccaattttttcccagacaagccatttaan

SEQ ID NO: 715387 - DNA, 106 bp, Homo sapiens
gtgccatatgtgatatccaggtatcccagtctccatcctccctctcggcatctctgggagacagagtcacaaccacttgcagggcaagtcaagacattaatagttg

SEQ ID NO: 715388 - DNA, 385 bp, Homo sapiens
ccatatggactgggaagggaaggatacgtgcatagttcacaggctgtcttgaaaaacgtgtggctcagcttggcccaggcctttggcccgggatcaatcaggagctgaaggaatgattgatagatgctgcttagcttggcccaagacttatcagaagttaaggtgaaagtttggccaaggagcttggcccggaagcactcaggggctgaagtaattattcatagaggtcagacttacagtccaaataaacgagagtgtcgaccggaatgcaccagatcccacagtgcccatgccaacaaaaagagaaggaacattttcctgggagcccactgactgtacaaagacaaaagtgcttcttttttctctttctcgtgtctctcttttt

SEQ ID NO: 715389 - DNA, 781 bp, Homo sapiens
gtgcctggagagcttgtcaaacatggtcaccaggaacagagtcatccagccaatggggatgactccccggtgatcatctatacgtccctgacaggtatgccgatgtgcgaggactactggatgcaagcaagtgtctgcctcgtgacccctagactctggaccgctgactgagagctggcagacatcttactgtctcccccgatctagcgactggtggctcgcttccacgacgatttccattgagggttgtcaatccttgagggaacggcactatgcccacttgggatcgcactactcgcggtccacgcacttctctcattctgtaagaagccaccgttcctctctgagctcctcgtatcttgtatcagtgaatttgccgtcttggtcacagtattcatcatactcttggacttgcacatcggtctatctatgtagctgatggatactacagagctcgagtcgctctggaattgccagcagactgaacgttacgtttctctttgtcatgcgtccagagaggagactgtgttccagaagcgttgctgcgctgcagggcaggagcctaccctgtggcacatcaggaacgagcgtactgggacgggcaggggggttgggagtgtgcggtgcacaccaaagcgaagcaccaatctgggagattggcacacatggcgagagtcacgtgtgtagagggtatgtagctgcatcttcccagcgtgagagaacctgtcagaactttccatacgaggtatatcaggaagacacccttccaaggtatgtaatg

SEQ ID NO: 715390 - DNA, 438 bp, Homo sapiens
  misc_feature (110)..(110): n is a, c, g, or t
  misc_feature (125)..(125): n is a, c, g, or t
  misc_feature (283)..(283): n is a, c, g, or t
tggatctctcaaaataccttcaagttcttggtccaatgcctatggtatcagaacctggctcccttttagtcatgcagatctctctagcaagtgatgatctgcagctgctngggttcttcccctgnaaacaggcttttcttttctgatacattgctaggatgcaaattttccaaacttttacattctactttccttttaaatataactcccaacttaaagtaattttttgttcctgcatctgcacataggctgttagaagcagccaggccacatcttgaaatcntttggttccctagaaattttatctttcatatatgctaagtcatcactcttaagttcacacttccacagatcccttggttatgaacacaatgcagccaaattcgttgctaaggcataataagcatgacctttgctccagttcccagtaagtttctc

SEQ ID NO: 715391 - DNA, 232 bp, Homo sapiens
ctcccgacatgtcgcggcttcaacatggaagtggggcagtatatctttgataattgcccctttatctctctactggaatggcatacttttactttgacctctgctccagatgaagactgcttctccattcatatccgagcagcaggggactggacagataatctcataagggctttctaacaacaatattaaccaattcccaggattgaagtggatggtccctttggcacag

SEQ ID NO: 715392 - DNA, 364 bp, Homo sapiens
ttaagacggaggtagatagcacaatggccacatgagcctgccatgtttggggcatattcgaggaatcagctgggagaccaatactgtttgacaaaatttagccaattatggtagataggagatgaagctggggtggtcgggtgggagaacagggattcagatcatttaggtccttgaatattctttcttaaggactttggattttactcaatgagagaggaagccatggaagatgtaggtatctatagtgctgtgactctaatattacgtcataatataggtaaattatgaagagtagaatatagagtagttcagcactatttcagtagcccaagtggtggtgacttggaaaagggtattagca

SEQ ID NO: 715393 - DNA, 974 bp, Homo sapiens
ttgccagaggccattgactcgggggtaaatggaaaactgtgtctttgaatctataatcgtataatctaggagttatctttgctactcacaagttgcaaatgcagatctccacgtgttctctataacctaaacgtagcgtcgtaggccattcaatcacgtctagagagaagatccggccgcagattttgttgcctgtagatgtatggcggacacggattttcagagcattgtcccctgagtcctaatgaaatagtcaaaaccaatgattcctcttgcgttgcatcccattctgactgtgtgccaaggatttttgactctatttgcctcttcctatgtacctgcttgcctccttgggcggggttgccgaacgctggaaaattctgagcgcgtgattaccaaggtgggacctgttgtcgtgtgcgctctcttgacttgtctaactattctagaagacaagccaaacaaaaaaactttatgaggaggaggacgaaacttctctacccctgtggtaacttatggtcaggtagtggcgtgatccttcagtccatggtacctgatgttcactattttacctctacttcttgccaaaaaaaagaaactggtcttcaaagccagagccaatgctaaaaaggcctggaacgaagggagccagagggtacccaacagggaaacaacgggcacaaccgatgccggcaaggacggtgacacaaccctgcacgaaatgggatgcacacaaacccggcccgaagcgacgtgctgcactgcccactactgggcgccttgctacacggacacccgggccgccggacgaaaccaccgcgcgccgtatacaccggacacgggccctctacaaccgctgtggcaccacaccatgtgttggacgcatcccacaaagcccaggtgtgcacccccctatgaacccgcacgaagaaaacagcgcaccgaaaaagtcaccccacccagcaacgtagagg

SEQ ID NO: 715394 - DNA, 611 bp, Homo sapiens
  misc_feature (93)..(94): n is a, c, g, or t
  misc_feature (530)..(530): n is a, c, g, or t
  misc_feature (539)..(539): n is a, c, g, or t
  misc_feature (552)..(552): n is a, c, g, or t
  misc_feature (581)..(581): n is a, c, g, or t
acctccccctgcaaggacagcatgggattcatggttagggaggctgcacctgaaaaaaggtgtccatttacagggctcttaatgatggtgacnntggtggtggggcaacagcagggtcacttcactggttcttgtagatggctgctcttaaaaggccaatggatgggggaaggccatccttgaattccaaaccaattagccctcacgcctgcccttccttgatattggccctttggacatcgggggggctgaccaggaattttttgtgggcattgggcccgtttgtttcaaataaatggactccattttaattaaaaaagaaaggaatttggaaaaactttttttttgccctttttttttttttttttttaactgaaaggtggatccctcccttttttttggccctttccctggtttaattgtgggccaaaaagaaaaaaaaagggttggtccgggccttgggccataccgtttcctttactccttcccccggtccccccaaaatttggatttttttttccacccttttncccctggtntgggaaatggccncctttggaagaaaacccaaattaaaattngaaaattaaaacccttaacctttggcccca

SEQ ID NO: 715395 - DNA, 397 bp, Homo sapiens
  misc_feature (326)..(326): n is a, c, g, or t
caactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgcctctgggctccttagatcaggtatccagagatttttactcctccagtgccaggcagggccttacgtccataaacttcaggcagggaagtagttacgggaaaacagatcttccgcccttctggcagccccctttaaggttaagggagggagtatctaaattctctggaagggggggantgagggtagggaggtggggacttcaactctggggaagttggggggctcaaggcacttcaggacccaaactt

SEQ ID NO: 715396 - DNA, 233 bp, Homo sapiens
tgactacgccggtcgatctgactacgcggctcgatctactaccggctatgggccctgcccacaagcacaccctcaggccgagggtgcatactgatgctctggcctgatggagaccctgagatcttcctcacccccaatcatgatgtcttcagtgtgggactggcgtccttttggttctgcctgcagcctgcctggctccgcccctagtgcccccgccagccgcgtagtcagat

SEQ ID NO: 715397 - DNA, 340 bp, Homo sapiens
atgcctgctgcgctatttaaaagagtgttttccactccatttccctgcaaccttgccatctacttacccttcaacccattctaacttggctttagctccctccacactactcacatagctcctgcaaagtgtagactcagttttgctaaatccaatgaaccttttgttggccttatctttccttctcggagcattcagcataaattacttcatctgtttttcttgaaacgttatctttggtatctttgccataatagctataccatcttcctagtaacttcatggtctatggatttttttttttttaagagaccgagtctggctctgtcatccaggctag

SEQ ID NO: 715398 - DNA, 697 bp, Homo sapiens
tggggcttcacctcgaccttttttattggcatttttaaaaaacaattaatttagaatacaaatattagaaaacaggggccttcagctgcccgtgcgggcgggaggggccgagctgcgcagcgggctgcgggctctgcagtggagactggaactggccctcggccaagaggcacgtccctattctttagacctgaaaggatatcggcttccggactaggagtcctggtttatcacaagggaaaattctggggcgggggaggacaaaagcaaaacagaccgcaggcagcggtgtgggagaaccaggtgaggccggtgccccgcctgcgccccggtctccgggggggcaaggggggtgcccagctgtggggctcctgaaggcagagcccgggtagctcccccagttgtgggacccttgaggccaagggcattgggtggggcctgcgaggggccgggaacgccgggggacaggaaggaggcccgggtctggtcctgctggaagagtgaggctcccgggggacagggttgcccgggccagcctcgtacccgtcggaaaaccaaagagcaaaacaggagaggaatcacccaaaaccgagaagccgggggtggccggggtccctggtgcccctggggaagcgaccgaacaatggcccaaggacggggtactggtgcggggcgggcggcagctgtggacatctgg

SEQ ID NO: 715399 - DNA, 626 bp, Homo sapiens
gatttggcgaggcagtctcatttggcggcttattgtctcttttgatctttgtggttcaaagtctgtttaatcagagactaggatagtaaccgctgcttttgtgctttccatttgtcaggtagatcttcctccatcccttaattttgagcctatgtgcgtctttgcacatgaaatgggtctcctgaatacagcacacccatgggtcttgactctttatccaatttgccagtgcgtgagttttaattggggcatattagcccattttcaggttaaggttaatattgttatgtgtgaatttgatcctgtcattttgatgttagctcattattttgcctgttaattgatgcagtttcttcatagcatcaatggtctttacaattgggcatgtcttagcagtggctagtaccagttattcctttccatgcttagtgcttccttcaggagctcttcttataaggcaagcctggtagtgacaaaatctctcagcatttgcttgtctataaaggatttatttctccttcacttatgaagcttagtttggctggatatgagattctgggttgaaaattcttttctttaagaatgttgaatattgggccccactctcttctggctgtagggtttct

SEQ ID NO: 715400 - DNA, 569 bp, Homo sapiens
  misc_feature (205)..(205): n is a, c, g, or t
  misc_feature (535)..(535): n is a, c, g, or t
acaccacggccttaggaatggaagacaggccccacttacctcttcgactccagatgcagctcatcctcacgaggggctggatgaagaggacttcctctctttcccccctaagcatgtgcctcatgagcctctgtgcaaatatggtggtgcaaacctttggtctgccttcatcattttgttgttgttgttgttgttgagacggagnttgcaggctggagtgcaagtggcacaatctcgctcactgcagcctcagcctctgggttcaagcgattctcctgcctcagcctcagcctcccgagtagctgggactacaggtgtgcaccaccaggcctggctgatttttgtatttttagtagagatggagtttaaccatgttggccaggcagctcttgaactcctggcctcaagtgatccaccctaataaacttgctttcactttactctgttggctggctcttgaattccttcctgggtgaagccaagaaccgacgtagcctcccaagctgaacctcagtttggggctttaccccatganaccgcaaagggctgggcttcccttcttctttggg

SEQ ID NO: 715401 - DNA, 837 bp, Homo sapiens
atcagtacgagcctctgctgtcggaacctggccgtgggagaaagccgtgagcgagctgccgttcagagtgtggcttctgcctgcgccaggtttccccgctccctcctgtgagaggcaccataaagaggaatgccaggacagggctaacctcatgtgcaagtacaaacgcatcggctgcccatggcacggccccttccatgagctgcacggtgcacgaggctgcgtgcgcccacccgacttcaagacaggcagtgagcgtgatggagatcctggatgggatgtgaccagtagcctaccgcataggatgcatgcacgctgtacaacagcatcttcaccctgctcagtttccgataagattggctacacaggtgatcgcgccccgccgcctgcttgtatgccacacgaggtttgggttggggggctggtcaagtccaggagttctgggggacagcaggcatctgggcacatgagcactgactagcgccaggacatggccgggctctggacgaagtctccctggtggacatggtggacacctcggtctgatgaagacaggccggagactgagtggaatggaggggccgaggtagacccacaggtgcacacgttgtgtggcatctcacaaggagccccgttcagcttgtactcgccacctggttccaccacctgcaagtggcatcttcacttgtgtggctccagagtctcggacagtcccggtaaccgcaaagtgggcagtctcaaggggctgggaactagaggctgcctcggacctggggcagaaaggcccgcgaggagcctctcttggcgatcatggccgaaggctataggtggaagctc

SEQ ID NO: 715402 - DNA, 257 bp, Homo sapiens
  misc_feature (69)..(69): n is a, c, g, or t
  misc_feature (73)..(73): n is a, c, g, or t
  misc_feature (156)..(156): n is a, c, g, or t
  misc_feature (171)..(171): n is a, c, g, or t
  misc_feature (232)..(232): n is a, c, g, or t
  misc_feature (249)..(249): n is a, c, g, or t
tctcgattagtccacggatctggatcttcagactacccgccttcgtctccgagtttgcgaactcgcggnaccngcgttccccggcgcgaagagggctggactcggattcgttggcctgagcaatggctgccatccggaagaaactggtgattgttngtgatggagcctgtngaaagacatgcttgctcatagtcttcagcaaggaccagtttccagaggtgtatttgcccanagttttgagaactttgnggaaattt

SEQ ID NO: 715403 - DNA, 1256 bp, Homo sapiens
ttagccaaaccatttacccaaataaacgtatacggcgactagcaaacttgaaacctgtgcgcaatagactatagctacccgcaacggcgaacacgactgaacaagattactacgccaagccactacacctactacgccaaccggcacatacacccacccctactaccccctctcactgccacctacacctgcacacctccacacccctacgccacacacctacaaccctctctgcccaaaggcgcaacgaaacgcacccaacaaccacggcccttacacgcaaccgcccacctcggcaacccacaaagcccccaccccaacccgcaacgcgccactaacacccgcataacaacgcaacaacccaagggcgccttaccacaccaagcaaaggccccaaccacaccaccccggccactcccccctcaacctcgcccttaacgcccgccccaccacaccaacccacactgtgacacggcccttgggcgccgtccacccaacggtaaacctccctccctacgcgcctcacaagcgcgcggccacctcaaccgcccaaaccggccggccccacgcccaaacccccacaccaacccacacccccccccacttacaaaccccccccgggcaaaacgacaccccccccccctgagacgaccacacgcgccacaccctcaacccggccgcctcctatgcgccggccccctcactcgggccatttccccccccccaactccaccatagcctacaccccttcacaaccgacctaacccacgctttccccccgcttactctcacccagaccaccactataccaccccccacaaccacccccctcctcctcccacccactatcacctcacctaccaccgcccatccatctccgcccggtggcccccacacccccccccgacacacccaccacaacaggcggccccaacaaccagagcagacgacccaccccccagtcaccagcacataccacccccccgtttacacacgcctcaagcccagcacgatctagccccccgccccacccgcacccaccccacatccccatggggacgccctcattcaccacacaacccgcacagcagcctccccacctcgccaccaaacccacccacccccccgcacttagggggccacacacacacccaaacaacgcggccaccctacccccgccacacccactacacgcatcacccacacaccggccccaacacaccccacccggacacaacaaccacaccagccacaga

SEQ ID NO: 715404 - DNA, 846 bp, Homo sapiens
tttccggcataaaacacacacattctatacacatggactatactttgttaatattcccccgcaagatattccgggttaaacaatatgttcttccacaagcgacagacttttcctctcacaccttctttcctcttttcgcgttctttccgggcgcttctggattaaaaatctggccccttttaaccttcagatactcggggctaaacccaccggaacttgtatctttcctctcggccccgttttatacagaatatttattgaccccatccctttttagaataatttcccccacgtaccaaaacccgggcctaagaataccgggaccacaaaacggttctaaacaaagggccttgaaggtcccccccgggacacattgcgatagcctacacctcctgcggtacacggatcggggaggcaaaaaaccacacgtcggtggggcgccacctatgctcatcagaggagtgcagtggacaccgcgtccctctcatcaggagcagccccccgtatgtgcacggagtgtcccaacaaagccccctggggtcggaggtaccctccccccacgggaggtccccccgtgtcacgacacgagcatccggtgctaaatttcttggcggggcgctcaacatatctacgcggccctcacaaggcctgcgaggcgtactggctagaatatagacgtaaatgtatgggaaccgacatcagtatatacgtgtacaaagcgtgccccgggtacaatacttagccatcttgatacaccgtgccccacagcaagaatgcttagaatttcgattcctgccactaacgcgagatcagctaatttggcttacaaatgcttttttttagtca

SEQ ID NO: 715405 - DNA, 131 bp, Homo sapiens
tccgggatgccccggcgttactctgtcaagcacatcatgtctatctgaatggagctctcaagaacaagcattgtttaggtaagtcagcgcgagccttcaaggtcttggaccctgagggaaagggcaccatc

SEQ ID NO: 715406 - DNA, 352 bp, Homo sapiens
  misc_feature (258)..(258): n is a, c, g, or t
  misc_feature (335)..(335): n is a, c, g, or t
cgacatgaacccgagcaacctacacttattcatcagcgcctacaacagccggagagacctggagattgagcggccaatgcctggaacccacactgtcactttgcagtgccctgctctgctggtagttggagacaactctcctgccgtggatgctgtggtggaatgcaattctaaattggacccaacgaagaccaccctgctcaagatggcagactgtggaaggccttcctcagatctctcagccccgccaaagcttgntgaggccttcaagtactttgtgcagggcatggggatacatggcttcttgcagcatgactccgcctgatgcggtcccngaacagcctctgggttc

SEQ ID NO: 715407 - DNA, 220 bp, Homo sapiens
agaatctgatgagccttttaggcctgttcaggccaaatttgagtttcatcatggtgactatgaaaaacagtttcttgcatgtacttgagccgcaaggacaagacttggatctgttgtcaacaatcctaaccaggtcagtgtttctcttcaatgacagagcaggcacttgcagacttcccaaaaacacagagtatcacatctctacagtgtatatgcacgg

SEQ ID NO: 715408 - DNA, 918 bp, Homo sapiens
gcaaaattagccccctaataaaattaattaacgcactcattctatcgacctccccaccccatccgaacatctccgctagtgatgaaacttcggctcactccgttggcgcctgcctgatcctccaaactcaccacaggactattcctagccatgcagctagctcaccagatcgcctcaaccgccttttcatcgaatcgcccactatcactcgatgacgtataattattggctgaattcatccgctaccttcatcgccaatggcgcctcaattattctttatctgcctcttcctacacatcgggcgaggcctatattacggatcatttctctactcagaaacctgaaatcatcggacgagttatcctcctgcttgcaaccgatagtcaagcgagccgttcataggtctatgtcctcccgtgtaggccaccatatcattctgtagtgggccactagttaattacaaatcttactatccgtcatcccatacattgggacagacctagttcaatgaagtctgaggaggctactcagtagacagtcccatcctcacacgattctttacctttcacttcatcttgccctgcagtgtattgcagccctagcaggactccacctcctattcttgcacgaaacgggatcatacaaacccctaggaatcatctcgcattccgataaatcacttcaccttactacacgatcaaagacgccctcggtacttctcttcctttctgccttatggccttaaactattctcaccagaccccttaggggcccagaccagtatacccaagttagcccctttaggcctttccacattatgccgaaggatttcctattagctaccaatttcgaacgtcctaaaataggggggcgtgcccaaaatattccacccacttagaaaacccacctcattttaac

SEQ ID NO: 715409 - DNA, 416 bp, Homo sapiens
  misc_feature (172)..(172): n is a, c, g, or t
  misc_feature (198)..(198): n is a, c, g, or t
  misc_feature (249)..(249): n is a, c, g, or t
  misc_feature (305)..(305): n is a, c, g, or t
cttcctcagcaaaatgccctccaaggcacagacacacaacacgggcttgtatccccaccaaactcagccaccctgaacctaagaccatcatcagcccctgaaagggccaaggggttgaaaagcagcagttgccagagcagccttttgagaagctgcccttccagaaccagantgatacccccagggggctcagcctcncactgtgtctcccatccgttccagccgccccccaccagcaaaaagaagaantctcagtccaggggcaacagcccagctgctgctatcttagatggttgaaaactaancggggggctcactgccattgtcaccagggtggaactcttgcctctgtaagaatgccttctctactgtggcatacccatgaaatttaatccccattttaaaacctctgaaaa

SEQ ID NO: 715410 - DNA, 444 bp, Homo sapiens
taaaagtttcagcaagaaaacctaggaccttgatggttttcctgattatggcaaacatataaggaagaactatagcaatcctactcaaactattctgacaaatagagtatcagggaatatatccagaactcattgtatggaggacagtattaccctgataccaaaaccagacaaagggctattaaaaaaaaaaaaaaaaaaaaggaaacctcacggccaatatccctaaaaaaaattgatccaaaattcctcaccaaagtactagccaactaattccacaagcatataaaaaagttcattcctcatgaccaaatggaatctatcccggggatgccaggatagttcaccatttcaccatttgtattcgccacatttgcctctcgatggatatcgcaaagcattcattgtgaacctttttttcaccagaaatgagatgtcggaagg

SEQ ID NO: 715411 - DNA, 313 bp, Homo sapiens
cactagcctgctgatgctcccagctgattaaagccactcccttcactatcttggtgtctgaggggttttgtccgcagctggtcctgctacagtgagatgggaaattttttaaattacatttttaggctgggtgcagtggcttactcctgtaatccgagtactttgggaggccaaggaaggaggcttacttgaagccaggggttcaagaccaacctggcaacatagtgagaccccatctctgcaaaaaaaaattttttttaagtaactgccttttaatagcaaaataacaccatcctaatctaaccacagagtt

SEQ ID NO: 715412 - DNA, 110 bp, Homo sapiens
atcttagctaatgaccggcatctttactactgaacggaccgtaactaatgtccggcatctttactaatgagcggatctttactaatgcccggcatctttactactgggcg

SEQ ID NO: 715413 - DNA, 1171 bp, Homo sapiens
accatctttcttgttgttgctcttctgctccagcatcattgttgtctttcactcctcgctgctctgtcttcgtcttctgtctcatttcggttgtgttttctaggtgtcccttgttttgctacttagtcggtccctcctactttgtctgtaggggtttgtttgtctccatcgaggcccacctacactgtggctccctcacccaccgggttgctcgttttattcactattgtcgtctcttggtgtcacaagcctccccattgtgggttccgtaccaccacccccgcgcaaagttgtgggtgtttttttttaaaccctggatcttgtgcccttccccacccccaccctggggtaaaaaggggtcgaaagtgtgattctcactcgtgtggactcctgggttttcacagttgatgcccctggcaactgttggttaccctggatgggaccttgcccatctatgacctggcgtacccagacttctttagacatacaagtgtcaagcaccatgcggggcatcgtgccaactgctctgggagcaaggcactgccctggtaaatacctgccagcctggatggcatcgtgcccctctgggacccccggaccggccgcctgcttactgactaccggggccaccacggctgagatcctggactttgccctcagccaagatgcctccctggtggtgaccacgtcaggagacccccaagcgaaagtatttttgtgtcccaaggcctgacccttatatggctgcacgcccctcgcctcgtgtgtctcggttttgaaggggacgaagggagcccccgcccctgttctgccacacacagaggcacgtagggcaccacagagggaagaggagggtggggccctggatgactttccacgcctcttcaactgacttgctcccctctccttttcttctctttagagatccccgccccgggccctcccaccccttgcccacgaacctggtgggcccttcacgagggaggggtggacctgtttctctttcacctttcactttgctggtgtgagccctggggtgtgtatttgtatgtggggagtaggtgtttgaggttccccttctttcccttccccagtctctgggggtggaaaggaggaagagatactagttaaagattttataaaatgtataatccaaatatacttccccaga

SEQ ID NO: 715414 - DNA, 241 bp, Homo sapiens
ggcgctgcgatggcctggcctgggctcagaggcctgcacattcctgccttcttatattaataagacaaataaaacaaaatagtgttgaagtgttggggcagcgaaaatatttggggggtggtatggagagatcatgggcgatgtttcttcagggctgcttcacagcgtgcatcagcggcggcgctgggcagcctagagtgggagccatcaagctgcaagggaggtctagtagcgcaagggg

SEQ ID NO: 715415 - DNA, 100 bp, Homo sapiens
agcggccgcctactactactactgctcgaattcaagcttctaacgatgtacggggacatgcatatgataaaaaatataaaaaaaaaagttgtactgcacc

SEQ ID NO: 715416 - DNA, 954 bp, Homo sapiens
ggagcttgaagaaatccgcaaatgtgggatgcacaacacttccgtaacatccaggttgcatgacagctaatttattgacttggccaagggcttattgtccctgacaaccctccatatgataacgggagccttcagaatcgaacatcaactttccagcagagtacccattcaacaccaccgaagatcacatttctaacaacacaagatctatcacccaaacatcgcacgaccccgcgggcaccgctctgctctgccagctaacttagctgccgaaaacctggaagccagcaacccaaaaccgaccaagtaatccacgtccctcatagcactggctgacatgacccccagcctgacgcacccgccttcggcgctgcaccgtagccttgcccgcaccctacctcatcaaggacccgctcacaatacactctctgtaccgcaactgctcgcccgcacgctatacacagccaccttcatcgcggccacaccttcggcgcaccctgctgcccctcccactcttggccccacgactcgcgctgtccagcaccacgctgttcacgcccgagaccccccgtgcccgcggcactccaagacacccccggcccaccagttccccctgctcggccacttcgcctccttgccacccgccctccccttcgcctcctccccccaccacacccccacacccccctccaccccccccgccctcctaccctccccaccccctcccccccccccctctctaccccccccccacccccaccacccccccccccccaacaccccccctccacccctcccaccccttctctccacacacacacatcacaatcaccaccgccccgcccccgcccccgtcgatcccccaccccgtacccccccgcccccacgccgccccgcgccccgcccccctcaccgcccctcccctctctcccccccgcttcccctcccacctac

SEQ ID NO: 715417 - DNA, 614 bp, Homo sapiens
gatttttccccccgccccccacctccggaggggggggggaaatcttgttccgtcccccccccccccccaatccgcggaggggttttccggttcttttcccccccccccccccctggagaaaaaggcctgggggccttttttttttaaattcgcgcgccgggtgcccccccccacaaatgtgtggggaccctggaaataatatccccgcttctccccgcccccccaaaagttttttgttggcccgggccccccttcccccccccgccaaggggttttggggaatcccccttaaagaacccgggtttggccaaaaaccccgggggggggccccccccctttttttaggggtttttttttggggccccggggggggaaatttaaccccccccccccttttttccccccccccccttgggtagggccccccccccgggggggttttttggggccccccaaaaaaatttaggggggtttggggggccctttttttcccccccccccggggggggggggccccccccacccccccccccccgcccctaaataggggggggccccccccaaccctgggggggggccccccccgggggttttaaaagggggtttttttttga

SEQ ID NO: 715418 - DNA, 887 bp, Homo sapiens
gatctatctcattggtccatgtcctcctcagatgaggttacttgatgttcttactagaaagaaaggacctacgagcagcgtcggagctagttatgacctgcatatagtggctctaaagcaggaaattgtgtagatatgtggagacggagtccctgtaattgagcataccttctgaacgtacatgtggaagcaattgtgctaggagtaggcaaagtctatcatatctagaggagtcatgagccaaacagtctggccaggcccatgcatgtaaggagtatgcattatgtatttgacatgtgaagctgggactcagtatgtagagaatagcaaaggcaggatcgtctcgcggttcgccttggcatgtccagttcattatggttcaaatacagtcatgtcaaggcagagttgagggaccggtgattagccagaatggtcttctcaattcatatgcggtggcgacaggatgcatcattcaacattgggttgcaggatgagggtcagaagacggcggatgctagagaaggggtgaggtcgagagtccaggtaggctagaggaatttaggtaccaagaaattgcaaagccggaattgtacggggtgccaccgaatggtcgctagaagattgccaggttgggcttcagcccatggtcctgagtccaggtttgctcccaagggtaaatgaacacggattcggactggcaacccggtggttcagcataccaagtgctacgggatatatggggggaagggcgtggtaaaaagattcggaaccccaaacgaattacaaaacgttcccttcaaaggcctcaagggcaactagttccctcaggtaacctatattacacgccatatgcatgaccaagccgcctttgctcaaagtctcccaag

SEQ ID NO: 715419 - DNA, 493 bp, Homo sapiens
  misc_feature (22)..(22): n is a, c, g, or t
ggagagagactagtctcgagtntagtttttcattaaaattattgtaatggggtccgcccaaaaggaaggggtggagggtggggtacatgcggggacacggaaccatgacttggccaggccaaattcttctgtcgtggggaaaagggatgaaaagacaaaccaggctgactggggtggaagaggggagggggacattggctgcattcccccgcccccaaggaagcacctctaggccctggacccctcgctcaccctggcccctaagactccatctctatctctgcctcgtggccctccgggctcttcctccgtgttccccttgactttttcccctgacagattctcaagtaggacgatgttcagggcctgaccccaagccccataccaccttatgagggtacaacctttgccggccctgttttgcccctcctcaaacctcaccgttttccctcttggggacagtctgatccccctccttcctctcatcctcccg

SEQ ID NO: 715420 - DNA, 877 bp, Homo sapiens
tcaaggccactagagtatcaagagtactataaggttaacatcaggggcatgataaaggctcaaatttaaaacaaatcttctggggaggaggaaaagatatcccttttttcttttcttcttttctttttttggagacagggctctggctctggtcaccaggctgggatgtgcaggggcatggatctcagctcactggcgaacctccgcctcccaggttcacaccattctcctggcctcaagcctcctggagtagctggggaggacaggcgccgggtccgggctaatttattttattatttttagtaaaagacaatatcagctggggctatgggtgggtggcactatctggtggggtccccagctggtcctggggaaggctggacatatggggaggactggtcttgaagcccagcgaggaggtcaagggctatagtggagctggtagtggagtcgtggattggtggccatgtgcaaactcatagcccttgagggtgaccaacgaaggtgaagactcactgtggtgtcccaaaaaaaacaaaaacaaagaatttttcctggggcaacaaatgcggagatgcggctaacactggggttggggacgcacaaaatctgctccacattactcactgtggctatttgtgtacacccgctgtcgtctttctcagcggattggtccacccaaacttctttgttaacttttgcccccagctgttttattccggggatgtaacacatttcacacaactggacacccggtgtgcgggggccacacccctcgtgtaattccccgccacctggtgggggggccaggcaggagtggatccccaggagtcccagagtgtttgaaaaccccccacacagtggtggacccctctta

SEQ ID NO: 715421 - DNA, 692 bp, Homo sapiens
  misc_feature (400)..(400): n is a, c, g, or t
  misc_feature (449)..(449): n is a, c, g, or t
  misc_feature (483)..(484): n is a, c, g, or t
  misc_feature (490)..(490): n is a, c, g, or t
tggctgagcaggctgcggggtcgggagaggggaggcgcctcggccggctccaatgtcttcgcgtgcatggggcccgaggaacgggctgctcccctgccgtgcaggcttcctagaatctctggcacctctgcggggatgcggtggtgtgggtgggcccggccccaaagcggtccaagcctcccctgcgcctcgcggttgggtgcgggcttcccagggtaggctgcgggagcggctcccagcctcacgggaacctcaactccctgcggggctcaccccagcctgcggtacaaggcgtagcaaagaacctcgagagtagctgttgcttcgttcgtttgatacgttgcagaattttaggagcattaacgcccatcatgtttttttttttttcccctttttaaantttccgccccagggagaggaagcaggtgtagacagcagcaagagggagntgtgatgagggaattatctctgtagcgtagatgnntgtgcntcaacgttctctgaggagtttgaaatcagtattggtttttcgcggtttggccctgaatggttacaaggagagaacactggacttggagtcacgaaaactttcatccaagtcattccctgctctaagtcccatttctgttccatgagattgtttccacctcagatgagattagacttaaggtggcatcggtatcggtgtggta

SEQ ID NO: 715422 - DNA, 704 bp, Homo sapiens
catttagactcatgacagcgttaggtgccatttgatagaccaaagcactagtcatacatgcgaacatgcttgcgagtacgccctgtctagcccgcttaatactcagactttgcaacaaaactatgattaagacttgattctcgcacgaaactgggataacaacgtgtctacagatagagtctggagcatcatttgcctcaggcagtgaaccctttctgagactctccatgaaggctgagcactcgtatgcatgcggcatatagagattgatttagagataggtgccttttaatgctgtagaccaggggtgactcaaggcatacctataaatccaggcggcatgttgtcacatgacaaacactaggccccatctgaaggatataccaaatatctacctcactaaacgcaagccattgtatcactctctcacacttattcatcatagcaggcagctgaggagcattaaaccagacccagctacgccggttacgatactcctcaattactcacattggatgaatattagcaggtctaccgtcaaccctaacatacgcattcttatttaactattgatatatcctaactactacggattcctactgttaacttcttcaagcacacggtcttactacaatctcgtacctggaacatgcttacatgacttacaccccttacttcatcacccctcctttccctgggctgcc

SEQ ID NO: 715423 - DNA, 366 bp, Homo sapiens
gtggtctagtcgcattatattcttcgagcgaatgcctatgatcattgcgcctcgctctataatgtcgatggccatgtgctacggtttactatgattgttgggtgtctggtgtatctgagtgaggccggagtccgaggccgcgttagttgtggctataaaaatgattaaggatactagtattacgagatcaggttcgctcctttactgttgtgtctggttatcattctgtcaagaggttagtttgattagtcattgttgggtggtgattagtcggtcgttgctgacatattcggcggtggggatcactagagggggatatcgaatgatcagtactgcggtgggtgtcgacgcgatgtgatttctgcc

SEQ ID NO: 715424 - DNA, 531 bp, Homo sapiens
ggagcccgttgacgatcgttggcgaagttaccgccagaggccttgccgcccttttggccagcgcgcgaagcccgttcccggtcattggcgaagttgcctgggttggtttccttggtgccgccgcgctggcggtttcgctcttggtcttgcgccatgtcgtttctccttgcgatggggtcgctggtcgcatgaatctttgccatgcctagcttccgagcctctgaatgatgagtctgctcaatggctttgccggcagctgaccaatggcacgaaactcaggcatgcacactccactgaacggcctccaccccgatcggcatttcgtcaatggcatcaatcagcccgttctccattgcctcgcgtggccctagaatccgcggataggccatcaggtagcgtggcacatccagcacctcggctgccccctcggtccgctcggtgacgatctgcgcatagagccgcaaatcgaaatccaggctcatcgcatactcgggcatccgtgaatggtccaccgaaccatgcgaaggccag

SEQ ID NO: 715425 - DNA, 354 bp, Homo sapiens
gaggaaagttcttagagttatttatattcttgttttcctcttagttagaatctacagtttaactttatctttaaattatttgaacatatttgatatgtagcttaaatacaaatgtttcagataacctctttaccataactaatcctggcaagcatggtctcttttttttgttggtgtttaaagcctgtaaacagtttttctgaatgatcatgaacttttcttggtttagcactaggatttagctatgaagagagctcataggctttcaggtgctaattgagatctgccctgttagagtcttggggtgctagattggtcacattgacaccagtggcagggaaggcatctatgagt

SEQ ID NO: 715426 - DNA, 330 bp, Homo sapiens
cagggtccggggcggaggatgctttgtttttttttggttttggttcctctttcccggggggtgggggaggtccacagggacttagtggggcaaaggcccaaaagtgccagcctggggagccgtttgggggcagccccttttgccccccccctcctttttcctttccaaaaatgccaggggggggggtatgctttcccccttccctcaaacagggggtgggtgggggggcttttttggctcaggagaagcctttttaaaaaaccccccccctcccgcccccctttttaaccccggggaattatccatagaattaaagtggccgcctgtcca

SEQ ID NO: 715427 - DNA, 167 bp, Homo sapiens
aaacaggctagccagagaattaccttcagctgtatcacgagacaagttaattcaggacagcagaagagaaactaaaatgttgcatctgccggtaccaatcgctatagtagtcgtatacatcactgccgtgttacacgtgtgactggaacctgctacactagctgcag

SEQ ID NO: 715428 - DNA, 767 bp, Homo sapiens
ggcctggtccacgtgcgtcccttcccgggatccccgacagcttggcgcccagccggctacgtgagccaaggcacccggatgtccgcgcccctctccgagtgacaagtcccggcctccgtgtcccgcagtgcccgcagactcgagcggacgtaccagcgcattgccatggtgactgtgtgtgacaactacgtgcgagtgctggaagggtcccgatggtggtccgggcctggatgcaggatggcctgagtccctgcttcttcttcacgctcgtgccctcgacgcggatggctctagggagctctggcacttggtgctggctcttccctgcagacgtccgggagcggccgctggtgctgattcgctgtcttggggggccggccctcgcatctctccctacgtgctgcagctgcttctggcgcacacttcaggcggcgctgccctggcccggcctggctggcccgggttgggcactgccctggggggccccactgccaaggctatctacttctggcctccgtgctggactgagtctggccggcgcctgtggcctgtggctgcttgtcgtggagcggagccaggcacggcagcgtctggcaatggggcatctggatccaagttcaggcacaagccctggtctcctgcttcctctggaactggggctgtttgccgctgagaacttggcccctggtgtcttggaaccagcccacagtggtggtgggcagggcagattgggccagcacggtcaggaaactggggtgctgcggatg

SEQ ID NO: 715429 - DNA, 262 bp, Homo sapiens
acacacagacacacagacagacacacacacacagacagacacacacacagacagacacacacacacagacacacacacagacacacacacacacagattggaatgataagtcatgatataatgcttttaatgtacaaccgtgagtcattataaaacaacagtccaagtcacatagcaacacaccgatcacatagcaacacaccgatcacatagcaacacaccgatcacatagcaacacaccgatcacatagcaacagtcgac

SEQ ID NO: 715430 - DNA, 421 bp, Homo sapiens
ggtgtgagcatagcgggggccgtttttaatagacgtaagtggttagaatgaggataactgtcagaatgtaggtgatgagaatgagtaggaaatttttttaattacgcagaagccaaaagacatccccaaatcatagggtgtgttctttgggaaggtacagctttatcttcggctgataaagtcttagacttgagggctttgggtcaaagatcactatcagatttacaaactctacattcaatagtgtaaaaaaaaacaggtacatggtagaaaaaaatggctgggaagaaaatatggctcaactattcacaggggatagttattggctgaggggtatggaatatggctgatttttccttccttggtatactttactggggttcaacacactggtggcagcactggtgctcgtgcgggggga

SEQ ID NO: 715431 - DNA, 103 bp, Homo sapiens
tcgagcggccgcccgggcaggtactggatgtcaggtctgcgaaacttcttagattttgacctcagtccataaaccacactatcacctcggccgcgaccacgct

SEQ ID NO: 715432 - DNA, 142 bp, Homo sapiens
tcgagctcggacccagaaagcctgggcatatgtactctgcatctatagcacataaatcacgtaactcaaattatccctttctgttcagggcacatgatctccttcaacgcagctacatctattgaaccattgagtatctata

SEQ ID NO: 715433 - DNA, 103 bp, Homo sapiens
  misc_feature (41)..(41): n is a, c, g, or t
gggtcgacacggccgtgtattactgtgcgagagcactaacngggtaccagtactttgactactggggccagggaaccctggtcaccgtctcctcagggagtgc

SEQ ID NO: 715434 - DNA, 203 bp, Homo sapiens
atgcattgggagaagctcagctctgttgaaatagctcccgttttttttcttgatgaccctacttagttcctgtgggctcccatagggagctgattaatttctgccaatcagaacccatccctaacacatccagattgatagtggctttgacctagggaagaagaggttcagcgaagaaaccccaccagttatggtttgagagt

SEQ ID NO: 715435 - DNA, 121 bp, Homo sapiens
gggtcgacacggccgtgtattactgtgcgagaaagaacaaatattgtactaatggtgtatgctatagacactttgactactggggccagggaaccctggtcaccgtctcctcagggagtgc

SEQ ID NO: 715436 - DNA, 1240 bp, Homo sapiens
aatttggatgcggagaggggggggggggttggatgaaagaggggcaggtcgtagtgcgcatctttggattggttgttatggagataagtcgtttgaaggttacgatttgttttgtagatgggagtgtctttttttagatttgtggtatattggtggagtctgggttcggatatcgtttgtagtagtttgagggcgcagagggggcttttaatgcgcttttggtggctatgtgctctatttgtcttgatttgttgttagccttgtccgtacttgtgtagtctcgagttcgttgtccctcttgtcaactgttgtctgacgtgtaccgttcgtgtatgcgcgttctgtgtgttgttctaatgctccgttctagtatgccacggtgtaccataattgcgggtgaagtgggttccttccttattatggtagtagggtataatgtttaatggatgattgaggtaagtaaaggttgatagtcattgttggtgttatatcatggagtaggaagtcggtttgtgctagaggagtgtagttttatagtttttaggtggtgagtattgctatgttagttgctcaggatgtccctgagagtatagaatttacatatcagtgctagagggtatagtgtatctattttgtaagtagtgcgtacttccctgttcagaaatatagaatacacgtttcgtgttatttaagtagtttgattagctaattcgaatcatgatggcaattatgaattctgtctgagaatgctatcatttgtaactgtatcgccctgtgattaatatgctgcattaagccacaggcagctgttacagataagctgctattgtttcactattgagctgttacattagttcaggctaaatgttgggagctccttaccacatccaagaataaatctggaaacacactgctgggatactgctgttagagcccttcttggccttgtattcccagaaatgagctccctttccttagcttagaagaatgtgaattatataccaggacatcatgattcagaaaacgttagtattactttcagcatagaatgcaattaactgattggaataattggacactctagactcattaaatgtatatgataacattattaaataatactatacattataataaaatagaaagcaaactaactataattagaagtaaaaatagtttcagacctaataaatataagaaatatacataatacaagctaactaccgataggatgtataaa

SEQ ID NO: 715437 - DNA, 98 bp, Homo sapiens
gatagtattactatggttcggggaattattatattaggtggtgggcactttgactactggggccagggaaccctggtcaccgtctcctcagggagtgc

SEQ ID NO: 715438 - DNA, 301 bp, Homo sapiens
agagagaatatcctacaggacagttctccttgtatactggcataaaggactagaatgtggattcatttctgcttgctttcgatccttatagtcctttatgctggcctcaaactggtcaagcacatgtgggcagacattcatgagctcattcaggcctctcggaaatggctcaacagctggaagggtaccctcgagtctgaatgcgtaaattactttggctctcgggaggactgggtcgtagtgtaaccacaaaattccccttccgggttcttcatgatcatgtaacgactcgagaacatag

SEQ ID NO: 715439 - DNA, 297 bp, Homo sapiens
agcgctcttccagtccaaaagcttcttgatacagaaaaaagagcctggatttacagaaacatatagatctggtttgaattccagatcgagttggcacctgtgaagtcttgaaggtattaattatcttcactacagattgtctagaagaccgttctaggagttatctgattgtagaagggtctaggcttgtcctcgtgtttaagctattggccaactgtccctgttgtagaaaactgataataataccaacgattgttgtccatggaaaggcaaataaattttcaacaaaaaaaatgc

SEQ ID NO: 715440 - DNA, 400 bp, Homo sapiens
acagaataaagctcacgctcatagccttcacaatagaatttttctaagcagttaaggaagaattaacaccaatccttaacaaactgtttccaagaatacatcaggtgggaactcttcccattcatacagaaacgggaggccgcaccccttaggaatgcacacgtggggtcctcaagaggttacatgcagactaaccccagcagcacacacagaaggcccataagccgccaccaggaggggttggttccccataccgtggcaggaaccagaggccacatgtggctgttcagatttaagttaatcaaaacggaacgttggccgggcgtgttggctcacacctgtaatcccagaactttgggaaagctaaagctgacaatatcacttggagtcaagacttcca

SEQ ID NO: 715441 - DNA, 361 bp, Homo sapiens
tctagagtatactagtaaatcggaaatcgcagtagtcagcgtatctctagacatccagaggcatgcgctttgaactcccaggcacaggtccatttagactccactgtcaaggaattgatagcagagctcagtatccaaatgcatgtatcaaaacaggttaatacattatgatttcccatttctcatatttaggtaaaacattgtcctataaactcggggttgccaacttgatagctcttgttatgttggccaggtgcctccataaaattagatgcttgagatatcagatataccagctgtcctggagagcagaaaagtttcctatcttattgcgccatttttcccataaaggagtttttcc

SEQ ID NO: 715442 - DNA, 159 bp, Homo sapiens
ctcattactattcgtcagcaaactcaaactacgaacgcactcacagtcgcatcataatcctctctcaaggacctcaggagtcctcatgctgttagagcctcatggtgtgaggtacagcgctccacttgtgtatgatgctcatgtgtggggcctgggtga

SEQ ID NO: 715443 - DNA, 154 bp, Homo sapiens
  misc_feature (50)..(50): n is a, c, g, or t
  misc_feature (71)..(71): n is a, c, g, or t
catgaggccgctctgagacacttgtgggccttagtgggtgtcccagcggnagtgcccgtaacggccagagnagagggagtgtcttcatggatttggctgtgctgcgggacccagaagacaagtgccatttccaaaggccccagtgcagggttag

SEQ ID NO: 715444 - DNA, 689 bp, Homo sapiens
  misc_feature (582)..(582): n is a, c, g, or t
ccccattcctataccttcaatcttctgaggcaattctccaacctaacctggggttgaggagggttgctccagtttgcatacctgcttcttagacaaagctgaagtgtctgaataccaggatttctacagttatacttcatgaaggcaaaaagctatgaaagaagttaagcgtgttcacagtcaggatgtggttagaggtgagacgggtcaaaatggggagcttaatatgggccagttatcatcagaccataagaaagtatgatagtgtacatttcccataagcaattccatccagatttttcactggattatttagatttgcttgggagaaatggtatgggtttctctcttatcagcctcctgtgcttttttcagtgatctttgggggacactgtgcagtcattaagatttaaaattttgaagactattcaacaacaaggaaaattattatgagacattaaatgaaaaacaaacataaaattgtatctacactgtgataactattaaaacgtatccatgcatatgcatagatgttggtaagaaacctcagagttgtatttggttgggtgtcaagagagtgtnagggcctttctcataatggtggtttcattaaactttggttgaaccaagaatattgatacaataccctattttgtggattttcatagggcatctcctgatcagataaa

SEQ ID NO: 715445 - DNA, 84 bp, Homo sapiens
ctgttggttaaaaaaaaaaagccagaccatagtttgactggtggcatggaatttgtgtatccaataaatgcatttgcttatttg

SEQ ID NO: 715446 - DNA, 341 bp, Homo sapiens
catcgttgtgctgctttctgaattcgtacatactcatgtggttttctccataactagtctacccagttactaccaaggagctaaggaaagttcaggaatactttgaaaagtgtcgccataacatctccaaacatgcattaagtttaaccaaaagctgcaatattccagattcttaaattctcaatggcaaccaatttatgctcaagttgaaaatctggcaagcaccgtacgccttcagcacacgcgtgagtccggattttcccatcacacacacgctctcccccgtccaaggtgcctgtttacttctggtctacgcgtgcctattaggcacgcgtgcctaa

SEQ ID NO: 715447 - DNA, 154 bp, Homo sapiens
ctgttttgaggtcctgctggtgcaggcagtgatctccttctgcatctgtcggcaatgccagggtacatggtggtgccgccagtacatgcactgtgttggcgtcaggtctttgcggatgtccacgtcacacttcatgggaactcggtcagaggtg

SEQ ID NO: 715448 - DNA, 1255 bp, Homo sapiens
caatcgcatccatagtccttctaatagctatcctcttcaataatatgctcttccggacaatgaagccataatccaatgctaccaattcagatactcactcatggtaataagtcatagatggactatagacaataagaagctaggaatagtcccccgtttcacttctgaggtcccagaaggttacctaaggcacccgctctgagcatccggcgcctgctctccttctcatcatgacaataatacatagcccccgatctccaattcatattacgcagaatcgtctctcctcagctatgacggtaagccttcgtcgcttcgacttctcgacaactcgttagtccaatcagtagcaggcacgttgacggtggacttaaaaccgcaagaccccaagtcttacgccaaaagattcgtttagctactatcctccgtacaaactttacccccacgataagggagtgagcatcatagtatggcagctatcttacccgtaacaatgcactaacatttaacctgtctctctaagtctataaactatttgtataattaatccctaaactatcctaacccgcaaatttcgcttaactaacattcaaagctttagaatcgttccaatggctaccaactagaatcctttaataacattatcttccagcaccattgaataaaccaaggcttaaccatttgatcttataatagcaccccttttgactatcgcaatcacactcccttcccattctttcccattgagcgcaggccattagcccccctcggtgtaataaaccgcgcggcaatattgttggcctcaaaaagtggggcccaattttaactgcgcaaatgacaagttccacaggacatgacatggaatttaggcctcgaatctagtccccgccaacgcatacaataaggcccgactcgaattcatccctttcgctgtagaacgcgtctaaccgttcttagccatatacgcccataaaatcttaacttcccaaatccttaccaattcaaacaatctttaacttccccccatttattcctaagacaaagcagtttaatacattcacacaatctggaccctggtctttggaaccatgtctccctagaaaaacacagaaaccactatatctcccattaccaccaagaattcatagatcaagacagcgtttagcccaacaggctaactttcaattacatatattttccccccatattttataacaacaacacatactagcaacatattacaaaaataccatac

SEQ ID NO: 715449 - DNA, 480 bp, Homo sapiens
aatcactcacgtcagagataggaatggaagcacatactgtaagcattgagtctcatctaaaacatgaagtgatcttatctcaccagaaatgccaatctcttatgtagaatagtccagtcttcaagatagatggtgcagggtgtgcagcaactttgaccagaaagctccaattttctagcaagtggtcttttacagtactcttccagacttcaaagtttgactccctagagatgagtggatgactgcactaataatagcttatataccccatctcagcctcgtccctcttagcttgaacaggtagtgactagaggctgtgtgccatgtccagaaacactagtctttacctttgagcagtagaatcttcaggcagaattagtattacatacgtagggtaagtataagagacatagtctccctctgtcgcccaagctatagtgatgtggaacgatctcggtacattgaaacctatgcttcctg

SEQ ID NO: 715450 - DNA, 392 bp, Homo sapiens
gaaagttaaagtggactaagaaaggccaattctcacgtaatttgaatatatgttgctaggttaatggatttgactaaaattttgtggagccttagaaataatttctttacgtttgaagaagagtcaattattaaaaatggatatctagatactgagaggttttgggagaaaacaatcaacagatcacttatatcggatctactgtttatgctctgttgccactcaatttatcttggccaaaatgtttatatctatctaatacttgcaatgaattgtcattccgtgggggattgtttattaagtaattattcctttaagacatagcaagtgggttgataaaaaataatccatcctttcctaaggccttatgaaatttgccagtatccggtgat

SEQ ID NO: 715451 - DNA, 572 bp, Homo sapiens
  misc_feature (12)..(12): n is a, c, g, or t
  misc_feature (41)..(41): n is a, c, g, or t
  misc_feature (97)..(97): n is a, c, g, or t
  misc_feature (149)..(149): n is a, c, g, or t
ccaggaagatcnagcaaggccaaaaatgtctgttcgtatgntgacaggcactggcgaccttcagcgtgacgctgatgacttctgagatgtgacaggntcctcaacagctggcaccaacatgaccctggatgcctggcagtctggggctntccgaattcggcacgaggagagagagaagagaactagttctttaagtacaatttaaaaatcattgaaaatgtgatccacatcatagccattcttttcctcagacttagtcagacaagcttctcagagtggtgggatggggattagaataccacagacactctgcagtcctgcaggcagtcggccccaggacaaccactgctgtaggagtttggggccagggtggcatggttttcacaaggtacacgtgtcacgtgtttgtttgcctgttgacattctgaaaacagcaagtttaccaattgcagaaaatactttctgttttctctttcacatgctcagaaagcttctcaaaggtatctggtcacagcagcttccttcctgttatagaggtaaaaggtgttcttatatttaactggtaacaaaag

SEQ ID NO: 715452 - DNA, 203 bp, Homo sapiens
ggcccttaaagcatcagcaggcagacacttgcttaggtgtcaaggcagaagcatggttcaggtctcactggcaggctccagtgttggtgcagtcagttcccttgcgtcaggggcagggtcagcactgtctcaacctgtgttcctgtgctcctggccttcccacgtgtcagccagcatgctgcagctagtgcagtcagtgcagc

SEQ ID NO: 715453 - DNA, 137 bp, Homo sapiens
actgatagagccaataaagcctcttcctcatccctctttaccgcttatcactagagacataatagaaaaactatataaaaatcgaaggaatgtcttaaactccattttcccatttacatcaatgcgttggcagcagc

SEQ ID NO: 715454 - DNA, 144 bp, Homo sapiens
gcggccgcctactactactactactgctcgaattcaagcttctaacgatgtacggggacatgtttcttaaaggcattttggttttttaaaatctgtacagcaagagcaactttttctgtcaaataaaaatgagaaatacaaaaa

SEQ ID NO: 715455 - DNA, 1209 bp, Homo sapiens
  misc_feature (993)..(993): n is a, c, g, or t
tgaagtggactctgagtgtgctacctgtctacctgacactgctgcgtgcagtggtgctgtggagtgtgcatgatgtgtgcctgctgtgagtgcctgcagttgcaaacatgtgctcatgagcatgagactggctggaaaccctgttctgcctgatgcccatgctgatgcttgacaacccctttcatgccaccaccatgccatatgatgcctccatgcccctgccccattgcctccaccctcatgctccctccttgcagccctctgatgaaatgctcagccccacatgaacctaatgaactatgtgctcatacatgcatctcatgtgccatcatgcttgcatgcatgccacatgctgatgctgctgaagaaacaggaggagctcaacctggaatggcacgatgtgagtttggacctgaatgtgtgatgctgagagcttgcagcatgctgccctgggtgtgtgcacagatacatcgacagaacaattggacccctctaccttcttttttgtcccagttcagccctgctttttccaggacatctccatggagatcccccaagaatttcagaagactgtatccaccatgtactaggctctggatgtgcagcacgctggctcttctcctgaacttcctcgcctgcctggccagctacttgtgttgaaaccaacaaatggcgcaggcttagagagcttcatatacatctgggtctccttataactccttgctcctatgtatgctggatacgagccatgtataaggcatacaggagatagagtcattcaataatccgtatactactaaagattacttaccacacgatttgctccatgttccctccaatggcaaatgtggatattcccagtgttgggcatctaaagctgcatgcaatatctgacgtgcgagatgcacaagtgaaccacgaaaggacacgagacaacgcacgatagatccaactcaactatcaactggagtagcgtgcactctacgttcgccnctcggacagaagcaacctacccaggcagatggcaccattagaaaatgcaacaaaaacggcgtggtactaaaacatcatgagaaatagatcacaagcagacggtcgactaacgtgcctccacaactagacacagaagttaggcacacactagcgtgagatgcatcacaactcctatatcttgtcgatcttctcgtctctgttgacgctcacgcgacg

SEQ ID NO: 715456 - DNA, 1836 bp, Homo sapiens
catttgactcaatgagtgcgcctacgcggggcctcatcgtgcgagtgtctgtggctgttatttcagataggggatgcgacttattgaaagacgcccctgaaggcgtatggttggccgcaaggatatgtgtctaactgtagaggagactagagtgtggtggccagacagtgaatagcctgcaggctgctagggaccatgataggcggactctgaaggtgcctcgaagagacggcactcagtcgctctggcatcctgaacctagccaacatagatggaagcttcggtactttgatcaaccagtcacagagacgcaaacatctaagcgatgtgtgccacgggcgtgctgctgattggcgctgtgcgcacaaaccgaagtgatgtctggtagggccgctgatgagacatgcgagtggagcgaatccctttgcgccatgagtcgcaaatcctcgcacacgcgaaactagggcgtagatcaagcaacctcgagccgttgcggttgacctacattggtccacattttgctagcgaacgatcgtactccgagtcgttggccacattgcgacccaaggggttgccccactttacacgccctaggggccagaatcgggggcatcttggcggcaattgattgggggaagtggagggcaagattgttgtgagaatggccagagaatttcataagggtcccaagtggagtttgattgttggacccttgtgattgtagggcactggtgcaaacgcgttggggagggagaatggctttgggaagagcattgcttatcagggggaggaatggagggcatggggaagggaaggacgtaattaccaagctgtgggtagtcggcgcagtgaactcttgtgtgcggtggggcacttcgaattacggtaggcggacactccgacatctgggtgcactaaggaccctcccttcgaggaccatgtgtgcagctggctcaagcaaggggatcgtgtgcccgaaaggggtcccgataagaggcgcaagaaacttattggaagggtatgtggtttccacgtcgacgcatggggcacttatcccttagggacactccatttacaagatagatatgtgagtataacccacacgcgttgggccaggggttgattcctgggcacacttctcgcgtccccaatgtcgagaccacaatcgaggagccgattggggttgggaagatgcggaccacaacacaacccttctttgacaaccgaggatggccatatcgcacaggaggagatgtgagcctgggaggatgggccgcaaagacggagcgacaactgcaccattggaaagagtagtgacacaccctctttaggaacacacggacgtcaggttcgcacccatccgagaccccgggtctagagaaattaggacgagacaacgacaccccgtctagggactgtggagcaaacagcacacagcgacgagacacgagagtagagacccttccacagggcagcagaagcgaccagatgggtgagagaaaattgccacaaaacgccaaacgcacgttgggaaggcacataccagcagaaagagcaagcagcaggcgcgacacggagccacaccgaggagaaacacccaagcatgcgcaggaagagagaaaacagagtagagagcagcaagagcatcagacgcgaaggaaaaaggagagagaaaaaccgaacaggcgaagaaaacagagaaacgaagaagaccaaacggcgagagacacagaagaggacgacgaaagagaaagacactgaacaagaacaacaagacgaaggagcgaacagcaagcagaacagcagcaacaccctacgcacagtcgacacgccaaa

SEQ ID NO: 715457 - DNA, 907 bp, Homo sapiens
  misc_feature (709)..(709): n is a, c, g, or t
tgttgtggcaacgatgccgttcagcagtatcacttcgaccatgcacaccgaggccgcaagagacctctgctatagttctggtgaacgccagtcatcaagaagctgctcgccgagtcattgcaactcgagacgacattgggtcggcgtccgttaatcatgctgaatatcgtaacgagcgtatgtgtgtgaatgctgctcccactcctgcggccgatgctgagatcagtggcccactcgtggtgcctgcgtggtgactgcagcgtcgctgccgtgagggcctgcgcgtttcgcgtggagacgattacaggagccacttagctggaatgccttggaccacaatggaatcgtcattacaatggcttgggcataggggtctctcgtcgtacacctgccgtattgccaattcagaaagaacgcaatggaatcccgcacgcattgggtagccggtcgattgggcccagaagtactccacagcccggcattcgattttttatgcccccaaagtcgtggccattgccacccgagaattacataccacgtggatacatggtcgcgcatctcagtgggagaccaaggcgcacgccaaggccaaaaatacataccccggaaaacacacataaggcgtgatgtgcttgagatactctataagacgaggtatatgtcactccacttggaggcgcgagagggcaaccacaattggctgctaagnacgaacgtagtaaattacgcaccctcggtgtggattgtctttatggtcgtttgccacacaggcaaagtcgtgttcccctcccgataaggaagaaaagtcgataggagtcccgcaatgttttatgcacatatagggcaatcacgagggtacttttgtaagccgccagcagcaggatcatttggcgaagaaccaggcact

SEQ ID NO: 715458 - DNA, 457 bp, Homo sapiens
  misc_feature (27)..(27): n is a, c, g, or t
  misc_feature (48)..(48): n is a, c, g, or t
  misc_feature (59)..(59): n is a, c, g, or t
  misc_feature (414)..(414): n is a, c, g, or t
  misc_feature (436)..(436): n is a, c, g, or t
aaatacggccacaacactcttatactngaaaatagccctttgcccacntgagtcacccnagaaagaggtaagcgtgtgttactaggtgatcctccaacttcaaataacttcattaggtcaaagaattgtccatgaatatcaccacatactgtgattggagcatctacttctatcatagtcttctcttgcctcaggatggcagccccatcattgattatctttaaggctacttcctcttccagtcgtccttcctttaccaaatggttttttaaaacatcaactttaggtttcccattctcaaatacttccttgaaagtaagccgttgggttggaggaaaggggacagctttgatgacgcggtcggtggtggagaggtggaagcgcctcccggacatggtcccctcggcctcctcngagctccaggagcccgccggancgttgcctacgccgcggtcgc

SEQ ID NO: 715459 - DNA, 913 bp, Homo sapiens
gtgtggggccccggccccgtaagggccgcctggttctttaatggaattttttgcccccgccaagcggtttatacctattgccgcccttgaccgagcagcacattgttctcgccacggtctcctgctcctctaccacacgactgcccagggggcgcggtattattcctcgccccaagcccgtgtggttcgctcccacaacgagttacctcgtggcccgcccatctatggggccgctccttgctctcttcacgtcccccccggtgatgtcaatgctgtcgctggcctcgcgctcgacctacttgcgtcacacagagagacgctcttccaggacgggggtgcgacaagaccgctgcgcaaagcacaggcctctctgaagagcttcacaaacacacctcgctgtacacacggaacgcgcaagacaaccctctcttgcacgggcgttctgcggcgggaacccccacactacacccacacacagtgggtcccccgcgcgggaagtcgaccaccacacacgcacattcgtggtgggacgcacgcggaggtcgttgagacagcagcacgcacgcggctcgtgctgaacagtgctccgcccccgcccggccgctcgagggtcaacccagcgcgcacattatgtgcttgctcggtgcacacacgcgccgactgttgagtgagggggcacgctctccgcggagcactctgatgagcccacatgcaggcgggccggcgacgagaggcgtgactccatgacctcccaaggggtcctccgaacgccgaagcccctgaacgagcaggacggagcagtggggacgcgcggcaggccacagacccaccctcctgagcagttcgcccctagggcgcgccacacaaccctcggtcagcccttggggcacccgtccccccacaataggacaag

SEQ ID NO: 715460 - DNA, 148 bp, Homo sapiens
ggaggcctcgctccggggccgacccgaggccacagtgcctgccgcggtagaccgggacttggggtgacgggcttccgggctcccgagggatggaaggggtctaagacgtccaacaacagtcaccatgcaggtgagcgtcggtgttcca

SEQ ID NO: 715461 - DNA, 1096 bp, Homo sapiens
ggaacagagctagtgaaacggtagtcggccaggtatggctctgaggccccaaggcccccggatacctcaccagagatgacggtcttcaaggcagccagcccaggacacggccccacctgtggttcgttccagaattgtctagatggcggccgtgcgaccaattttcccccggtgagtatgaggtccccaaagcttcttgctgcgtccacgcgacggatttctgctgcgtgaaaagggatacgaggcccacgggacttatgtgtctaggcccattcctgttgaaacgggtactcatcgaaaccagtttggatcatgccgcatgtggtcttgaagcctgtgttgagccatcgtacgcttctctggacaactcgtggggggtaaccgcagaagagagttttaagagttagcacggcggatggacgagctgagggcaaccgcataaaaatctgggggccgtggctcgttcgagaactaggggctcagttgacaccttgaagatcgcatcacgctatgtcgcggtcagcccggttgtgccctttgggggatgggttgccacccagtcttgttgggggtggaccacgatcgcctggcggtgccgcagaatctttggggcgggccgaggaccatgatgttggcctcacgtagttacccccatcgggggacgccgtgaggtttgcgagctaggatgtctcggtggggccctcgacattttcggtcggaatgtgggtacgtcaagggtatggtttgcgaatttaaccccagatttctgaagccaccgtaggactttggctgtggcccttcgtccgcagcagggttttttttaaactcggggccacacgggccagcttaagccccaaagataccctgcgtaccagtatgtgaagtctggcattgctgggcgcacagaaaaaccaagttcttacgggggacccgcggatcgtgtggtatcagtggaggcatacaaaacacgggcctgtttcacataggtaaatttgggcgcctactcaataagagctggcagccctccgggctccaacatgtccctaacgaaaggctacacgagcacccaacacgtttactggtgtaaaactggacg

SEQ ID NO: 715462 - DNA, 212 bp, Homo sapiens
  misc_feature (194)..(195): n is a, c, g, or t
ttgcaggacccttaccaggacagatcgacagacgagggctttagactaaagtcagagacactactgttaaaagtacgacagagtaaaagaagccagttaaggaagactataaagtaggaggaaacatgggaatgtggtgtcttggaaacaacaatgttcaaggacaggaacaattgacgtgtcaagctgctacnntggggaggaagacacgc

SEQ ID NO: 715463 - DNA, 262 bp, Homo sapiens
gtgacgactagagagactgggtgagtaactcagtgaaactgctgagttatggtggtgatacatgggtgcctggaacgtgactcccgttgtcctctggggcatggttggatgagtagctgtggacgcacagtgagagtccctgatgtggctggggagtgacgacatagagagagaccgtgggagtaagctgagtgaaactatatgagtagtgtggtgactccgggtgttgcctgggacactgattccatgctgaaactgtggg

SEQ ID NO: 715464 - DNA, 142 bp, Homo sapiens
ggattctggctgtgtctgtatcgactgcgaacagacgacatacatggtgttgcagcctgccttctgggttgcccataacctggtcatctctgccaaaatggacatacagtaacaaagggacctttagtggcccactacaaaa

SEQ ID NO: 715465 - DNA, 132 bp, Homo sapiens
ggactcaagcgatccgccagcctctgcctcccaaagtgctgggattacaagggttgaaccgccccactgatcaaggggaacatattaatactttgtgtgtttctttgttttgagatggagtctcactttctt

SEQ ID NO: 715466 - DNA, 175 bp, Homo sapiens
  misc_feature (4)..(4): n is a, c, g, or t
  misc_feature (111)..(111): n is a, c, g, or t
  misc_feature (115)..(115): n is a, c, g, or t
cganagagagaagaaacagaaaaagaaagaaaaaagagaagacatgagcatggtgggcatggggacagatggcaatgttaaatagaatggtcaggggtgtcctcctaagtnaaanttgagcaaagacttgacggaggggaaggcgttggccaaggtgctgagggacgaaggattt

SEQ ID NO: 715467 - DNA, 90 bp, Homo sapiens
ctcctatttttgctacttatgttcttgcttatctaaaagtagttcccaactcagtagttaaaacgatctttaaaaatggacatcagacca

SEQ ID NO: 715468 - DNA, 392 bp, Homo sapiens
ctatccagacaaacaagcatcttcctatacagtaagtgtctcaactcaaaatggcacctacaatcacagaatgagttacctataaagtgtctgtctaaagctatcataaaatcctcatgtattctacaactaggttgcaagtataacagaaaaacctataaatagtacataaaagcaggtttcttaaaatttatgacacctacagtgtgtcactatagacagagtattcggggggctctgtgacaatcaaacatggctgccatgagtaagggagcgtgtcccctgatgcgcagaaccgaagcagtgattatgcctcagcctcgagctcaccgcacagcatcctaccattccaaatacttgggactttgagttgagttgagaattactacaag

SEQ ID NO: 715469 - DNA, 110 bp, Homo sapiens
  misc_feature (53)..(53): n is a, c, g, or t
gtggtcactctagatgatcccgacagcacagaggaggagaggaggcatccatngaatgagaccattcacccccaaccagcactgcctcctctcctcctctgtgctgtcca

SEQ ID NO: 715470 - DNA, 109 bp, Homo sapiens
  misc_feature (38)..(38): n is a, c, g, or t
  misc_feature (50)..(50): n is a, c, g, or t
gcacctacacacgccccagcaaggcgaagttccccccnaatgggtggaantgagcctgcctcttggaatagaatcagactcacagactgagttcccactgctgccagat

SEQ ID NO: 715471 - DNA, 1811 bp, Homo sapiens
  misc_feature (125)..(125): n is a, c, g, or t
  misc_feature (1532)..(1532): n is a, c, g, or t
  misc_feature (1684)..(1684): n is a, c, g, or t
caggggcggtccttattgtcgggctggttggttggtctgacgctttggtcgtgtgtatggtgattgtttttttagcgtccgtgttgtgaagggggcgctcctatgtgtttggatgttgtttgggnccctccatcggtgggagagcgtgttttgcgtgggttgaaagacgcgacctggtggtgtgttttagcctgcgtgggtgtttttgtgaggctcgtcttgtccccgcgaatgtgtgggtgccgcggggtgtgccgccgctgtggttggtcgcccgggggtctcccccgcgggggtgttgaatgtggtgcctcgtgtctggggggtcgtcgattttttgaagggggacgttgttggttgttgtgtagacatctgcctcgggttttgagttttgttgggacgtacaatttgttgcccgcctcggtgtttgaggaacccatcttgtcccttgggatttgagaccccacaatagttcttgtggcggatagggcacctacgggttatgttgtgtgttggagaggaagcagtgttgtcccttgggggtggttggaaagaagtgaaccggcgttttgtgagaaaaatatgtggttgtgaattgcgttactccccaaaggggcgcccacatgggggggacaaaaaaagtatgttgccaacggaggggatcagctttttatagtgaaaaatggcgtagtaatctaacacccccccttgtatttagggccgcttgtgttggtagaacaaccccctctggtgtgtggtgcgccccccccactattgttttataaatgcaagagttttaaccacttttgagaatgtagtgtcttttggggggttgaacaccacgttttgtggtgaagtacgccgccgcgttctcgccaccacgtggtgttgcgatcccaggagaagtgtgccgctaacgacccccttttgaggagattttatactaaaatggtgccaccctcctcgtgggcgcccccacatgtattttgtcgtggtgcgttcttggagaagaagagtcgccgcctccttgggaatattgttttacgccgccacctctgaatttgtggcacacattatcaccccagggccgcacatgtataactctttgttgccaccgcagcagagttgttattatttgttgtcctcggaatattatgggggggcaaccctccctgttgtgggcgagttgttggaaaattattgttatatgatggtgtatgatgttaagatttgtttgtataatcgtgtgtttgtgtgtagagatgagtgtcttcggggggcgccgtcttgtgtcttatattcaccacccttctcttttgtcgtataatgtcttctgtgtataaaatgagtatatttgtgggtgtgtgcgcacagcatttttcttgggcggtaataaaacgacgtctctgtgtgtttatatacgagagtatccttttgtgtgttttgtcgagaaagtgttgtatacgccggttgcacacattttcgcgccttgtgtttataatgggacacacatggtgagaagtgtatatatnctcggtgggcgtatatcgccaccacagcgtttctacacctataccgcgagagttttttatacttctgagagttatgtggccactaaccacgagccacctcgtaatgtgttaactgttctgcacccactttggggagtgtggcccacttcttngtgtgtgcaccacactaagtgcaccactttcttgtgtttaaagtggcctcttaagtgtttaaccacgttcacctcttttaccgtgctatttactgaagttatttattaaatatgccctaaatactta

SEQ ID NO: 715472 - DNA, 1645 bp, Homo sapiens
  misc_feature (1026)..(1026): n is a, c, g, or t
  misc_feature (1517)..(1517): n is a, c, g, or t
  misc_feature (1585)..(1585): n is a, c, g, or t
  misc_feature (1604)..(1604): n is a, c, g, or t
  misc_feature (1623)..(1623): n is a, c, g, or t
tcatcacaacacaaaaacaaacaggaccccgccctgttttaatgcccttgcgtggggacccgaaatggcgggggcttgcttggcgggggagacgccagaaaggcgggggcttgcttggcggtgggagaaacgcgttgttccgggccgcttgcactctcttgccgcaggggctctcttgtgagattggcgcgctctccaccatgttctcacggtgtcttctcgtgtgtgctttctcgggccaagccaccgtggtcgccacgtggtggccgtgtctcacaccatctcacagcgcgtgggcctcacgccctgtgtgtgggcgagacactctctctttctgtgggccccattgtgtgtggccacggtgtgtccccagcgtgtgcccgcggtgacaccctctctctcacacagagacagctggcatgtgtgcgtgctctcacaacccctgttgggtgtgcgctccctgttctcgcggtggatctcagcgtgtgtgcccgtgggcggccagtgtgtggacagtgagagacccctattgtgcgaagcggcggagattctcccgagtgtggtgtcgcccctctcccttagtcccctccgtgtttgagaatcgccagcctccgtgggtatcaagagaacaccgtggggcccccgtggtgtagccccccacaaaacaatagtggttcctcagtagggcgacgatgacaaccaagaaggggggggcgtgttatcccaccacggtggtcacacacccagaagggaggcgctccgctgacgaggggaggactccccccaagcacaacgcaggtctgtatgcacccacatcacccacttcctacagacagcgggggagggagaggacctctccccgggaggggggcccccgccgacacaacccctcgtgggtggggcaccacccgcgtgtgatctccccatctggtgtgtgcacacatcaaggtgctgcgtggaggtgcaccaacggatgatgagcaagaacgggtgcggcggacaccccctactctctgggagtatggnaatccttcccacagaggggggaaaaaccttactaaagggacacatccccgggaaggagggagcagtgtcgttcgcccagatagaggagcgagccctattctcacatccccagcgcaataggagtcatctctagcagaccaccacctactctagtgttgtgatctactatccggcccccccgcatgggtacactcccacctggttggtgtgctccactatataaaccaggacagggagtgaggtagacaacacttcactccccccacaggtgcatggctagtagtaacacaacgctcgacccataccatgttggatagacttatcgtgggaccaccctctctctcgtcacccacaatgttggaccaccgatgaagtgatggtagagaaacccacccttttcaaacaagatacccagaatagagtggttgttgtcggcctcccccgcagtagtgagatcatcacacccctgcttttgtgtgtatgagagactnccccttctattttgtcgtgatgacgaccaacatcacacatgtgtttcttgtggttgcgaaacctgacntcgaaacgtaggcagtganaggactgctgtcagatcgntcagatgatcagacaccgcacc

SEQ ID NO: 715473 - DNA, 207 bp, Homo sapiens
gccatcgtcaaaagaaatgaataaataaataaaaataaataaaacaaaaagggagacccagaccacccacattcttctaggccaaaggagcttggcaccatgcactgtcttaccaggcgataggctgagtttctcagtcctggagacgggtacaagtgagctcacccatcctccatgtttgatgccaggtgagaggtccatgtgtaa

SEQ ID NO: 715474 - DNA, 904 bp, Homo sapiens
  misc_feature (904)..(904): n is a, c, g, or t
ggtctttcccttcgggtgtggtgagtaaacgcagttgtcgtctcttgcgggtgccgttgctggttctcacaccttttaggtctgtgctcgtcttccgtgccgagtctctctttttcgttgcggccactgaagatcctgtggtggccatgtgggccgcccgcgccgcgccgtggtgtaccgggtgatgtaagaacaagaccgtgaccaaagtgctcgcattctgtccgaggtgtgcctgatgtccaagattttcgcattttttgagactggggcgggaaaaaaggcgcaaagtgtggatgagtttccgcgttttgtgggcacattgggggttcagatgaactatgaggcagtgtcctcttgaagccctggagggttggccgaaatatgtggcacataagtaccactggtgaacacacagtttggtgggcaaagatagtgtttccataatcccgggtgcgggtccacccccttcccacagtcatcccggatcaacaagatggtttgtgcctgtgcttggggctgacaggctccaaaacagggcatgcgagtggcttttggaaagccccatggcccctgtggggcccgggttcacattggggcaagtatcatgttccttcgcaccaaggtgcgacccagggcatgtattgggggctgggcaggcagttaaggtactgggcgcgaagatcacatttaagagtggggtagcagtcaagccgttaattgagactgttgttgaaggggcatccaatgtgggggtagtaatccaggttggcttgaatgggcctgacagagggcaagtgtcctttaataaaatttttgggaaaaaaaaaaatagtggggggaataattgggcgaagaataatatgttcaaggggtctgtgcacatgcgttggaaggaagaaan

SEQ ID NO: 715475 - DNA, 476 bp, Homo sapiens
tgaatctagaggatcccttttgggctcattcaggcacaattggatgaggcagtcagtctgtcagctcggcccaccagcaggtcgccggtgggggggtagcagcttcccttggaaacagccaggcacatccggggcaggggcctgtgccagtgtggcagccagcacgcttagcagtcggcccagtcgaagttcccaggggcagaggctgtcccttccctctttcccgtgaggtcagctccatccgtgagagggagggcggccagtttctcctccccgaggctgagggggggaggggtcgtcccaggatcctcgggaactgcatctccagatcctgaggcttgagcagaggggcgccctcatagagccacagtttgaagaacgctgtcccttgtggtagacagccacgtgccggttgactgagaggtgctgagcaaatccggttaggcccggcctctggctggaccttcctgccccct

SEQ ID NO: 715476 - DNA, 527 bp, Homo sapiens
attttacatatacaaaagtatgagagagccagtagtgttcaagaaattataagcagctttctatcatttggtatataaaatgttatcagatactggtggtcaatgggattggacagtgatagacagtgggctaggtcacagcaggctttgtgtgctataccatggagattagattttatcctctttgcaaataggagccattgaaaactttagctcagaagaatgatgtaagatttgcttatcagaatgagtattgtgagaactgtataagtggtagggtagccatatgaggatggtgaaactttaagaacaaagactccattaatgattaggtactgttacaattgttgtagatgaaatatggatctattatagctggttctgttatgctttcctttgcttcctttacttcagccttggcagcctccttgatcttcctcatacacactaagcactctccctcctcaggtctttggatttactgttgcataggtctgtagtagtactgtttgcttacttgccttgct

SEQ ID NO: 715477 - DNA, 256 bp, Homo sapiens
gtgtcttggtcatagctgttcctgagtatccccctcttgcagctgctgacaggcacacgctccctcttccagcctcctgtgttgtgttccagcgccttccctggttctgccttgccgcttcacattgccttttctctctctctattttgtctcttccaataacacctgtcattgcatttagggcccatcttaagttcaggatgatcccacctcaagacccttaattacatctgaaaaaacgctttttccaaataaa

SEQ ID NO: 715478 - DNA, 376 bp, Homo sapiens
  misc_feature (27)..(27): n is a, c, g, or t
  misc_feature (220)..(220): n is a, c, g, or t
tgcgggcctgttttccaggcactttgngaggctgatttgagggcatcacttgaatccaggagtttgagaccagcctgggcaacatagcaagactccagctctacaaaagtttttaaattagccaagtgtggtagtgtggtcctgtcatcccagttactcaggaggctgaggtgggaggatcacttgatcctaggaggtcgaggttgccctgagctgtggntgtgccactgcacttcagcctgggggacagagtgagaccctgccttaaaaaaaaaaaagaagaagaagaagaagctgaagatgtaggaagcatctacatgggggggggcaagaataggataaaagtggcctgttcagattctcttctgtgcaccat

SEQ ID NO: 715479 - DNA, 421 bp, Homo sapiens
gagatcgcatcattgcactgcagtctgagtgacagagtgagactccatcccaaaaaaaaaaaaaaaaaaaaaaaaaaaaaaatgggggggggccgcgggcccccggaaaaagcttttaaaaacacacatcgcggtgggggcgcgcgggggccccaggagggtaagggaaaccgtggggcaaaagcgggtgttcccagggagaaaccgggggccaggaacaaggggcgggggatttctccccacaatataaaaaaccgcgccgggggggggaaaccgcggagcgggtttggagaaaaatctcccaaagaggggaggggttccggaggggccccatacggggggcctctatataaaaagggagaggccacaaggaggaggcccgagaattctcaaaatataagcgcccccgcgcttcgtgggg

SEQ ID NO: 715480 - DNA, 894 bp, Homo sapiens
  misc_feature (17)..(17): n is a, c, g, or t
  misc_feature (109)..(109): n is a, c, g, or t
  misc_feature (141)..(141): n is a, c, g, or t
  misc_feature (191)..(191): n is a, c, g, or t
  misc_feature (194)..(194): n is a, c, g, or t
  misc_feature (209)..(209): n is a, c, g, or t
  misc_feature (217)..(217): n is a, c, g, or t
  misc_feature (219)..(219): n is a, c, g, or t
  misc_feature (252)..(252): n is a, c, g, or t
  misc_feature (255)..(255): n is a, c, g, or t
  misc_feature (286)..(286): n is a, c, g, or t
  misc_feature (289)..(289): n is a, c, g, or t
  misc_feature (292)..(292): n is a, c, g, or t
  misc_feature (328)..(328): n is a, c, g, or t
  misc_feature (437)..(438): n is a, c, g, or t
  misc_feature (487)..(487): n is a, c, g, or t
  misc_feature (498)..(498): n is a, c, g, or t
  misc_feature (535)..(535): n is a, c, g, or t
  misc_feature (556)..(556): n is a, c, g, or t
  misc_feature (561)..(561): n is a, c, g, or t
  misc_feature (586)..(586): n is a, c, g, or t
  misc_feature (588)..(589): n is a, c, g, or t
  misc_feature (617)..(617): n is a, c, g, or t
  misc_feature (625)..(625): n is a, c, g, or t
  misc_feature (629)..(630): n is a, c, g, or t
  misc_feature (637)..(638): n is a, c, g, or t
  misc_feature (649)..(649): n is a, c, g, or t
  misc_feature (671)..(671): n is a, c, g, or t
  misc_feature (673)..(674): n is a, c, g, or t
  misc_feature (688)..(689): n is a, c, g, or t
  misc_feature (693)..(694): n is a, c, g, or t
  misc_feature (706)..(706): n is a, c, g, or t
  misc_feature (712)..(712): n is a, c, g, or t
  misc_feature (733)..(734): n is a, c, g, or t
  misc_feature (740)..(740): n is a, c, g, or t
  misc_feature (747)..(747): n is a, c, g, or t
  misc_feature (756)..(756): n is a, c, g, or t
  misc_feature (760)..(760): n is a, c, g, or t
  misc_feature (777)..(777): n is a, c, g, or t
  misc_feature (788)..(788): n is a, c, g, or t
  misc_feature (793)..(793): n is a, c, g, or t
  misc_feature (817)..(817): n is a, c, g, or t
  misc_feature (828)..(828): n is a, c, g, or t
  misc_feature (864)..(864): n is a, c, g, or t
ggagtgagccgtgaganaggtaaaatgatcaaaacgagaaacccctcttcactttctctatatgactcaggcccctctcagtagagacgtggggaagtcaatgactccnctcaggaggtaacctgtccagcacagcttgtnctgaaactggcagccccctaaccctgacatcacgaggcaagaagagatcnccncgcctgacccggccncttgactncnggcactccctcggaactgccccgggccactgcntcnctggctgccggggagggggtggggctggtcngtnccngggtagagcctgggcagtcacctagcacggtgaggnaggccttggccaggtcttggtctagctcggtgctggcgacacacgtctcactcccctggtcccgccctgccaccccaaagatggtcagggacgtcgtcttccttctccnncctgtctccaatatagagcggctcgtcatccttcagccaggagacggtnagtatcagggnggggtacgtgactctgacccgacactcccgccagcanccgtgggtgccccctctctgngccanctgtgtacctcgaggcatccggctngnntcctgtgtgaggagtctttttacctccncggcaggncttnngttattnngcttttgcccnaggatgttgagtggcgacacananngtacaatgacctanntccnntattgcggatcntcttantttccacgactgtccgttctnntaaacntgggtantagccaccntccnggttgcttccttgcccntacttaaaccntcgcngtatgggggatgggagaaccaaanaaagggcagtncagccgcgtccggttgttaagaatcactcgaatganccggttccggggcgacacctccgaggcggc

SEQ ID NO: 715481 - DNA, 730 bp, Homo sapiens
aagagaacttattttaacaaggtcccgggttctcgtgcgacacagtgagctaaacttgcctgcgtgttaaaaggcagcgtttgtagggatcaagcttggtagacagtatttaggcggagaaaccgccttgatcttgggtttggcaagcccttcctccgcagacagtcctagattaggccactgttcagccatgcaggggtagttgggtttatagcgtgctgcagacagtgggcattaatgcaatgatcatttaccccgtggcaccaaaggtgtgtacccagtgaatttaaataaattggtgtggattggcccagtagcttaagaagctgggcttttcaaagagtgattggaagatgtgaaaggggtttttctttgctttctttagtaagagagggagaacacaagctgatgtgaattgtagataatgcaagagctagggtttgccctcttgcatgtgctactgctgccttccaagatagttatatcccaagactcgtgttttccctctcccctaccttgtcccccctaattaaaatagaaaccacagggattgattaatgtcccgctcctgaatacatgctaaaatttgtaccaaaatatcttctatgaaaatgatttgtaatctgtagacttattacctgggagatgtcttgatgtagaatcccatcctttgggttgtgggtttctttgattttctccgaataaatctgatcgttaaagttcacttgta

SEQ ID NO: 715482 - DNA, 103 bp, Homo sapiens
ctgtgccaagctgctatcgcgtggactggcagtggtgggctctgtgctgggtgcttcctcaccttcccaggcctgcggtagccccagacccacgggaggcatt

SEQ ID NO: 715483 - DNA, 153 bp, Homo sapiens
ctcacacacgtaaatctgaataccacagtgattttaacctgtgacacacgagaggcttgccatgtgtctctgctagttcgcacggatataggtagtaggttccctccatactctctgggccgggatgtaaacttctcccttgacaacctgctt

SEQ ID NO: 715484 - DNA, 303 bp, Homo sapiens
gatgggtcacgcgggacacgacggggagcctgactccccacgcgggtgctactccagccgcgggctgactgccttctgcacccttctcatggctgtcctggcgccgtgttcccaacccgaggtcccactccatcgaataagcacaggatggactggcggaaggcaggtgagaaggccaggtacggacctattacaacaagcagaagtaaaaggtgacagtggtcatgggtactggagaggtaatgacacacaagtcacatttcagaggctgaagccatatgatataatgatcaaggacaggcg

SEQ ID NO: 715485 - DNA, 799 bp, Homo sapiens
  misc_feature (13)..(13): n is a, c, g, or t
  misc_feature (111)..(111): n is a, c, g, or t
  misc_feature (175)..(175): n is a, c, g, or t
  misc_feature (194)..(194): n is a, c, g, or t
  misc_feature (310)..(310): n is a, c, g, or t
  misc_feature (346)..(346): n is a, c, g, or t
  misc_feature (396)..(396): n is a, c, g, or t
  misc_feature (429)..(429): n is a, c, g, or t
  misc_feature (501)..(501): n is a, c, g, or t
  misc_feature (542)..(542): n is a, c, g, or t
  misc_feature (613)..(613): n is a, c, g, or t
  misc_feature (659)..(659): n is a, c, g, or t
  misc_feature (673)..(673): n is a, c, g, or t
  misc_feature (712)..(712): n is a, c, g, or t
  misc_feature (718)..(718): n is a, c, g, or t
  misc_feature (720)..(720): n is a, c, g, or t
  misc_feature (727)..(727): n is a, c, g, or t
  misc_feature (780)..(780): n is a, c, g, or t
tctagattaagangtggccccgggtgtgggatttacattttgagtggccactggtggtgcgaccccgatgatccggggtttgtctatgattctggctgtccggttgccctnctctacaatcccaataatccatgcctggtggccttcaccatatttgggggactttatctctgcncagaaccgagccgcttgcncacgtggtaaacagatcagaaggccgcctgaagtctccgggcaggtcccgtgcataaggccgaacatgtatccgcagccttgctcaccgcagcaatcttggccagccccgggaggntgtcaatcacaaacgacaccccgttcctctcccgcntggccaggttctgcgcatggcccaaaatcccgaagcccgtaaagtcagtngcggcgtgggccttgaacgtgtccctcagtccngtcctgtcgagcctcgccatgtccatcaccgcctcccggcaggccagccctacatctccttgggtgaccacnagtctaatctcatcccattcctcagggatatccagccactngtgcacacgccactcccacccgtttccccaggggtcttgtcagccccagcccgtcccccggcactgcattntctggcatgacaaattcattgggttggcagacagtggtagccactnctcccaggacaatncaggggtttagtactgtttggccgcctgttacagaagtncctgcntnctcagcngcgtttttaaaaccttggataatcagagggatcaatttatcccttttcctgtnggtcattttattactgaat

SEQ ID NO: 715486 - DNA, 1061 bp, Homo sapiens
gaatctcttgaacctgggaggtggaggttggagcgagccgagatcgtgccactgcactccagcctgggcgacagagcgagactctgtctcagaaaaaaaaaaaaaaaaaaaaaaaaattgggggggaccggggccggggcgctggtggcctcaatgccttgttaaactcccagccactttggggagcctcccagggccgggggggctcaatgagactcagggcagttttggcacgacttaggctgggccaaacacgggttgaacaccccggctcttcttacttagaattcacagaggaaatttacgctgggggtggggccactcggggtggcctggtaaatcccaagttacacgtgggggaaccttgaggcaaggaagaatttggtttgaaccctggggaagcgcagacattttgcgcagttgacgccaagaaatctagtgccattaacacactccaagtctggggtgaccagaatgtgagaaatcgtggtcttccataaaaaccaacacagaacaaaaaaacaacagggggggcggcgccgggccactaagagagttttcccccttcgggggggggcgccccaagggttatgagcgcggtgttacccccacggcgtttttctttgtggtcacccaaggggggggcgccccaataatgagtgagagcgccggatatatataatagccgcaaggcgccagcgttgccgcgcgcggattttatacaagacggtgttggtgaagctgtgggcaaaccagcctgttctacacggtggggcaacacttggtgtgcgacgaggggcccccatttttaacttcgggggggggggggcagcaaccatatagttggggagaagacaatatttccgcttaggagagggagtttttaaagaagggcctgaaaaggggggaaaaattttataacaacttttaagaagggtggtcaaaaagtggtgtggtagaaaccacattagcgggggaaaatatgcggtagggagagggttgagaagagtttgcgggatagaaggggaggtagtcgtgtttggggaacagttttttttacg

SEQ ID NO: 715487 - DNA, 174 bp, Homo sapiens
caagagcgagcgaggagctgatattacaggcgcgtgccaccgtgcctggataatgcctcccgggttcaagtgattctcctgcctcagcctgacgtgaagctgagattacaggcgcgtgccaccgagcatggtatatgcctcacgacttcaagtgatgctgctggctcaaccttg

SEQ ID NO: 715488 - DNA, 480 bp, Homo sapiens
tgagatttcttcatttcctatagtggcatgtagacatatctgaatttcttgatatttattccaaagaggaagaagaataaggaagaagaagaaaaagaaagaagaagaaaagaaggaagaagaggaagaaagaagaaggaagaagaaaggaagacctaagaagaagatagaagaggaaagaagaagagaaagaagatagaagatggaagaagaaagaaaagaaagcagcataagaaggaaagagaaaagaagagcagaaggaaagaagaagaagaaaagaaggaagaagaggaaagaaaagaggacgaagagaaaagaaaaggaaagaagaaagaagaagaggaagaagaaagaagaagaaagaataagaaggatgaagcagaggaagaaagaagaaaagaggaaagaaagaaggaagaagaaaggaaagaagaagacaaaccaaagaaggaagcagaggaagaaggtgactcgaaaagg

SEQ ID NO: 715489 - DNA, 300 bp, Homo sapiens
ctgggtgatctagaggatcccttcagaagtgcattttttggaggccctttcctcgtgtaattcttatgcattacacagtgaaactggtagtataatgtggaacgggtcacttggatttagtaacataaggtatagatgcatgaaaacataaacagtaaggccaggcacagtggctcacgccggtaatcccaacacttggggaggccgaggccgggggatcacgaggtcaggagatggagaccatccgggctaacacggtgaaaccccatctctactaaaagtacaaaaaattagccgggc

SEQ ID NO: 715490 - DNA, 679 bp, Homo sapiens
aatggttcgctagtcacttgacccggagaaccccacgaacactcatgcaaatcaccgaggttccacactcttcgtgttcactttaaagaacactcgtgaaactgctcaggccatcaagggtatgcactatacgaagagagccacgaagttatctgcaagagtatgtcactcttacacgaaacacgtgtgtaccattccgacggttacaatggtggagttggcagtgtgtgcgcaggccaagcaatggggctggacaccaggtcggtggcccaaaaacgacgtgctgaagttgtattgctggcacatgtcttaagacaacctgcaggagcacggtagatgactgaacctctaacgcggtttacgcattgtacgtacttcttctgcgctcattagacgtcatagtccaaggatgaacataatgctacctagagatagcgctcgaccgtgtatcctacagcacgctctatggttccggcattaaacccagtatcatgtaggcgctctcctgccatcattgagtatgtagtcgcttacgggaagaagggaacagagttgtctcctaaacctatgaacgaggcaggttgccctacgtagagaaccaccgcatagtcccaggagagataacgtgagagagaaccaaaaacgttatgggcacggggagctgaatgtcagtcattga

SEQ ID NO: 715491 - DNA, 176 bp, Homo sapiens
  misc_feature (89)..(89): n is a, c, g, or t
tgatcctcccacctcagcctcccaaagtgctgggattacagttctgagcccccacgtccagccaaaagatatctttcttgggcggcatncgtcttagttggttaactgcctgtctagtaaaaagttacctttcttattagatgctgtagtagtttgtgttgtggcccatacacaca

SEQ ID NO: 715492 - DNA, 103 bp, Homo sapiens
gagctggtatcatatgatactcagacgcttggaaaaataaagatttgtcagccctatctcaaacttgaatcaaatatttctggggttgtgagcactacatagg

SEQ ID NO: 715493 - DNA, 171 bp, Homo sapiens
atctcatgaggtcttgcgatgcaggattgcattgtccagtgtacacaacatctattacctgtatagttacagcaggcagatacgctactgaggactgacatgaggttctcagtaatgagatttctgtaggagtcaatattgagtgtgtagttcccttcacttcccaaagag

SEQ ID NO: 715494 - DNA, 456 bp, Homo sapiens
agtggagcagcgctagttcataatataaaaaaataaaaaaacgcagcagacaacttttcgttaataccatataactttaaaaacacagtggcaggtacatcagtggaagagaagaatattactgtctctatcctaagtagactgttcttattccactggtttctttaacaggactgttctactcagcctctgtggaagaaaacttcccacaggactgcactagacacagacagactttgcttttacagcctgctcttgcctattaccataccagtgtatgtattcttccacctttggacttggatgggtattaaactcttcaggcatccttgatgcaactagagtcaatatgctgtatatattaatgatagctcttgggcatcgatctctgaaagctcaaatggatggaatttagtttgcgggaaagaggctttgctttgcgcatatcaggcttag

SEQ ID NO: 715495 - DNA, 185 bp, Homo sapiens
gaggatcctgttcctggaggcggaggctgcagcgagccgagatcataccacatgcactccagcctgggcaagtagagccagactttgtctcacaaaaaaaaagaaagaaagaaagcaaaagaaaactaaagggaggcaaagagttaatcataactgtttatacctctctctctctctttttctca

SEQ ID NO: 715496 - DNA, 156 bp, Homo sapiens
cggccggtacgatcactcatagttggggaactctgtatgtccggcagaggaacgctggcatccaatctgatgtatcccagatgataccctcttggttgctgaggtcaggagcagccaaggtgatcttctgcacgataggtgatcttctacacgata

SEQ ID NO: 715497 - DNA, 308 bp, Homo sapiens
cacgaggggtgccgtacttcggcgcgggcaggccggccgcggtcagcacgtcgccgaaggagccgcggtcctcggccaggtcgatggcctccggcgcggtgcccacgatcggcacgcccgcgtcggcgaggcgttgcgccagccccagcggggtctgcccgccgagctgcacgatgacgcccaccacgcccgggccgccggcaccggactgctgctcggcccggaacacctcgaggacgtcctcgaaggtcagcggctcgaaatacagccggtcggcggtgtcgtattcgggggacaccgtctcgggg

SEQ ID NO: 715498 - DNA, 365 bp, Homo sapiens
ccagaaaaacgtttcctaagacaaggcaggtcttacattatatttaaattttttttaatgatgtcttttttggcagtgcacagccagagaacaacacatcacacacaagaaacagttgtgctcatgtgatgggggcctcagcactaggaaggagtggactgttcgtgcacgcagcagcttgaataaatctgaaagtcactatgccgcctaagagaagccaaatcaagcgcatgctgtgtacagaggctctccagaatccctcctacctcaccgaaagcacatccgtggctccctgccgactcgcaggagccgcttccacaggcccaggaagacagcttcccggtagcaatgtgttcatctacctc

SEQ ID NO: 715499 - DNA, 354 bp, Homo sapiens
gcccctttgtaaaactttttttttaaaattttcccggttcattctcactttttttttcccattttcaccacatgggtttttttgctaaagagtcacacccccccagggttggcctttgggttgtccaaaggtcaaggttcctggagcggtttctccttttttggaaaaaaatgctgagaccaacgcatttctttacattcagtccaacgtttacggaaagtgcttgggcccccccacaaaaacaatgcactttttacacgggcagggggcaagtttttatcatagggttacgttccattaaaatttcagtcccgccagacccacccccaatagggcgtaattgttttttgttga

SEQ ID NO: 715500 - DNA, 732 bp, Homo sapiens
gtgcgcggggcccggcgcagagccaggcgggagcttccgggcagatggggccgccacctacgaagagaaccgtgcctgaggcccagccgctgggccactgccctcacctgtctgctccgaggactgccacttgccctggggattgggggagatcaccccatgatgctgctacctccggcgcgctcccggtttagctatctatatggtcaaatcccgttgtgggggtcgagtggcctggtcttggcacgtggttgtaagaaccacgtgctatcccattgatctctgaagctgtggcttgtccttcaaacctcatccaggacatgaacgatcagaaccacgcccgaggagcatggtccaggggcgtgagcctgacgtgacgtgggatgtgaatcgtcacgtgtctcggtgagactggtgctgcttccattgatgggtgctgaatcggtgctcctaggatcgccgctgacctggtgaggaagctgtgaagatgcctgtggggcagtcctcccctgctggctcggggcaaacggctgctgtgccggagcagttgaaccatcacggtgggatttgagccaagccctgggcctctgacctgttgctcaactgctcactgttgctgtgccggggtggtggcacccagtggagctgctctccgtgaacgctggcctcgggctccccgctgtttctccttcctgtctgtggcctgtggctacgtgtcagatgtggatatcc

SEQ ID NO: 715501 - DNA, 216 bp, Homo sapiens
tcctacgagcgcactcctacgagcgcactttgatccctcacatgtgcagttcacaagtagggtttacgcttctatgagaagctaatgccactgcttatgtgacaggaggcagagctcaggtggtgatgtgagctgtgggcagcggctgtaaacacagatgaagcttcacttgcttgcctgacgctgacctcctgctgtgcagcctggcgctcgtag

SEQ ID NO: 715502 - DNA, 1219 bp, Homo sapiens
tttttttttttcttctttttaccaaatctcccgtgtcctgtgtcccttgtggggtggactatattcttccagataactttttccaccctttcttccgaatgtgttatgtgcaacacgtgagagccagggggtgtgggagtggggaataatttttatattaaaagaagttttctccacttggaaaaaaaaaaaaaaaaaaaaaaaaaaaaaaaaaaaaaaaaaaaaaaaaaaaaaaaaaaaaaaaaaagaagagagggggcgggcgcgcgcgccacgaaacactcctccccgcgggggcgcgcccccgcggcgcgcgcgcgccccccccatctgttgttggagaaaaagagggggcgcccacaaaagagagaagggcgtctatatatatatagcaccgcgcgaggagcggcgggggcgggtctatataacaaaaagaggcggagggcgggaacaacacggcggacgaaggcgggagaacctggaggaaagagagaccacccctcacccggggggggggggggagaaaacaagagggggcgaccacacccccacacaaaaggagaatatataacaagccccccagcggggaaaaaattaacaccacttaccaggcgctccaaccggcgggcaaccaacaaccgccgggtgaatcatgctgcgctgcggcggagagaagaaatggtctcgcgctacccgagggaggtaattacttcctcgacacaacacttttttatcaccgggggggttcttctcttaccctaacacccgaaaagcgcgagacaaacgagaaaaacaaccagagaaaacgacgagaggcgcaggacagaaggaaaggcagaaagcagggggaaacaaaagcgcgaaggcagccgggcgcgggagatgcgcgcgacgcagagaaaaacaaaaaaacatacgacacggaaaacaagcaacacaaccaagaaaacgacggaaaaacagagaagaaagggacaacgcggaaaaacgagcgcagagaggagcaagcaaaaacagaacaaacaaagcaagagaagcaggcagagaagggggacaggcagcgagggcgagccacagggccccgacgacgcaggccgagggcagcccgggcaatgggacgcgcgcccacagcgacggaggcaggacgagaggggagcggaggagccgagcaggcgccgggcggagcgagagcgaccgcacgagagcaccagaacagaaa

SEQ ID NO: 715503 - DNA, 1007 bp, Homo sapiens
aactgtcgtagaaccattcgtatgaatcgcgcgttccatgtctgtgcagtgaacgtggtcatagcggtacctatgaaaaatctgtggtcagtgactcagtgttcggtatactcagcacattaaaaaaaggcccaggtgagatgagcaggagacgtttgtgaacacagtccgagagtcgaatgcgctactgagggccctcactgtgcatctatgaaccgcgaatccatagcgttatcatctgcctattcttcggtcatggtccgccctggccttggaataaggcctatagaggttcggttaataggtgtgggatgatgggccgaaaccactcatgagactctcctaaacgtcaagcagaatgccagatcggcacagttgtcacacggaatcgcctgactcaatatctccatcgaaatgaggagaagcccctggagtgactactgtaggatgtatgacctgtgagcagtgtgcactcttgagagaaggtggactgggtttctgcttaacaatacactggaatgttgatgctgattgcaacttcgctgatgacatgactggcctgggacgggttatgattctctaagatgaaaatgtgaattagaactaaagagagaaatctgagatcattaaggtcttaagagagaaactggttagcagatcatggtccaaagaattaacgtcagaaacccatcgtggggatcacaggcacgcctgaaaacactgggtaggggacgatctggggactgaggccgaatgaagacttgatgatccatgcagccctgttgagcgagaagcaacgcggccaggtgccagggtcatacactgctaaccagagcgaaccattcggaggtgtaaaacacggagagcgccgaaacaaatcgcacggtgagtaataaacgcacctgggaggaacacccatgaagaacgaaggagcaacaaaaacgcgtggcgacaaacaaaagaaccacagcgaagagacaccccactctctcgtcatttccacccgg

SEQ ID NO: 715504 - DNA, 970 bp, Homo sapiens
ggtaagtgacatgactaacaagaagcgggagaatctgggctgtcgctctaggagatcgatgggctagagtgagaagctgtcccagtgtcggagagacctgggggccgtgacactccgagattccaatatgccggggagctgatgcccaagagtgccaaagagattccgctgacacgaagggagaaaaaaatatatcttagtttgaaacaagaaggcctccaagatagggaggaaggagcgtgaaggttggcttcgggtaaggagaaccggattgaccttttgcgtgcgtctctgtggccgatctttaatccatccctgactggttcgtatatggcctatgaccaatgtgaaggccttggcaatatttcccaagaagcagcaagaagggctttccaacattttgcggcccttttgattcagggactcacacggctaagttgcacgttcgaaagccggtcaagtagggtaccaaaggtggtgctggggcgtgggtaccccctctcctaacactagtgtttcgaacgcaatgggtttaccatgggggaggcccaaaaggccttggccgatcaccctttgggcctgcatggcaggacggggtccagggggtctcccaggacgaggccattgttagcttggtcacttcaccgtttagggccctaaggtaatggaggggacaactgcatgcggaacccgccaaaggtgcgggttggaacacagattcctccgggaacagatagcatacaatagaagattttgccggggcgtttgtattcgcgccccataggaaaaagagttattatacacaccatttcgtgtggtgaggacggaggcggcccctagttaggtattagagaagtgtggggagatctgcgggtgtcacacagggagagaccgtgggtggagacaacgtggggggagctggccagacaaaaagcgcggggggaacagggggttctgggaccactccagg

SEQ ID NO: 715505 - DNA, 193 bp, Homo sapiens
cgtgcttgcaggttgagtacagtgacactgatctcggtcactgcaagccctgctcccgggttcatgccattcttctgcagcgccaccaccagtctggctaatcgggtgtattccaagtagagatagggttcaccatgttagccaggatggtctcgatctcctgacctcatgatgcgcttgcctcggcctccca

SEQ ID NO: 715506 - DNA, 250 bp, Homo sapiens
tgggtggctgaggcatgaggcaggagaattgcttgtacccaggaggtagaggttgcggtgagccaagatcgtgccatccagcctgggtgacaagagcgaaactccgtcaaaaaaaaaaaaaaaaaaagggaaattttgggcccggttttttttttgattttgaaaacaaaatttttggttaaaatcttgccaaaagaatttcgcccttttcccaaagggggggttggaaagggattccggggaccgggcc

SEQ ID NO: 715507 - DNA, 1752 bp, Homo sapiens
cggacgcgtgggggaaggatgtggccgcctagtggggcagtgcgtaacttggctctagtcttggcgaggtcgcagagagctcggacctgcagtggggtcgagcgtgtctcctacacacagggtcaaagcccggagcccagaacccgcgagtatttctactatgtggatcaccaaggccagcttttcctagatgactccaaaatgaagaactttatcacctgcttcaaagacctgcagttcctggtcactttcttctcccgtctgagacccaaccacagcgggcgctacgaggcttccttccccttcctctcgctttgcggcagagagcgtaacttcctgcgctgtgaagaccggccagtggtcttcacgcacctcctggcttccgacagcgagtcacctcgtctctcctactgtggcggtggcgaggcgctggcgatacccttcgagccggctcgcttgctacccctggcggccaatgggcgcctgtaccacccggccccggagcgcgcaggcggtgtgggtctagtgcgctcggccctggccttcgagctcagcgcttgcttcgagtatgggcctagctcccctacggtcccctctcacgtacactggcaaggtcgccgcatcgccctaactatggatctggccccgctgctgcccgctgccccgccgccctgagactccagctggggctgtgtggggagggttagagcaaactctgggttttgtagtactcgcaggttacccctctgctccaacactctagattaacttagatgtccgctgtcacctgcacgctggtgactgagagcgcgtgcgcgcagaggtgagcccagggtggttggcgctgtccaaggttctggtgctgccctgctatcctctgtccctacagaggtcctctctcggccacctctaacccttacaccggctttgcgtcccacggattggcctgcgctggtcacgtcaggcagggcggcaggcgcaaggcgcgcgtgggccggtgcgcgtgcgcgcccaccccaaccccccccctccgcttctccagtcttgcagccgcaagcaccgcggggagtcgctcgccactggagcaggtgagggggtggggggagatcctggcccaaggtcaccgggcttgggggcgggatcgggaccctctaggttctgactgcctcaccgagaaaaggtcataggatctggcagtgggaaggggatggaaaccacaccctcaatgagcaggctcggacccactggaacgggagggggcggttaggggaggtagtgctgcttaaaagcgccggatcgcaggggctgccagagacctccgctgggcccgacagaggacacaggactcctccccaccctcttcccgcctagataggcatccaagagaccgacaccccactcctgctcaggattagaggttcatgtcctgataaaaggatctctgctgggctcatctaataaggggcccttattcctgacatggctgtcttgctctggtgcacatctgggcctctgcataagcagcagctctgatccctaatgcacagatcaaggctttgctactgaaggctgaacagctagctgtgcaaggcctggtgccagggaccaaccagtcattcgtgttccaggaaataaaacccagaaacctagcaagcgtccccacttcttggggctccacatgtcctgagatctaggaactgcctttgcctgcgccaaagctattccattaaaactttactgctgtgctgcctc

SEQ ID NO: 715508 - DNA, 1312 bp, Homo sapiens
ggcgtagcacgctgagagtcctgaacattggttatatattctatgagggtaaaacatgatagaagttcgtacgaactgtgagacaggccatggacaagtctctcctgcacatccacagggacgccagattcaacagcaggaaatgcattgtataaaaaactcagccttggccagtgaacatatgcattgctatcactactgaaatcatccagtagttactcctaatcatgtatattacaggaagcgaagtattaaaactgccttcacacatgaaaatgtgcgtggagacgagactttgcatatgcaccgtcaagtgatgaccatgcattgccagatttgaaagtggggttttgcctgcacagcaatatccaaccttgggttgtcatatgtactctcttatcccagtaaatgcacttggggatggtcaaaaggtaaccggagtattaaagcttttaaagccctcaacacttaagaagatggggaagataaggtgtccaatcaaatggagtggatgccaaaataaagtgaacgcccaaacaaagttgggttcctaggatgcgtacaactaggacctcgaatttcgacttgggctaaaagaggatttctgggttgttagccttaggggatccatttactgtgaatcatgcggccccaagcaccatgtagagggttggggatgaatacgaggtgaagctgcaacttgccgttaaccaccaaggggcctttagttagtttttgggacacaaattagcaacggggagaaaacacttccccctgggaggtgtgggcccccataggaaaagtagggataacaaggtggcgttttgccattgattgacaccgcattctgagaatgtcttccggatcggcttggcacttcgttaaacagcccgaacccgaatccaggcaaaacaattttagttgtacttatgaggcacgggcattgggatgcccacttggaatccacaacgtagtaattgttcgccatggcggaggaaaccttcggagggaccccactcagaggggaacgacaatcggaagagaacacagaccaaggaaaaaagcgaaggaaaagcaactggtcccgtttggacttcccgggggagagacacgtccagaaacacgcaggcagatcaacgcgttccccctttgagacagagtgtggagcgtgctccaagagagagtgtggtcgacacaggggacaaaggaaacacctgcatcctgaagggaggcggagcatttgagcacagcgcatagcaagcagcgctaacgagaagcgtcgtgggttaacctgggcaaagatgcgaaggac

SEQ ID NO: 715509 - DNA, 352 bp, Homo sapiens
tctttaaagcagcatgatttataatcctttggatatatacccagtaatggaatggctgggtcaaatagtacttctagttctaggtccttgaggaatcaccacactgtcttccacaatggctgaactagtttacagtcccaccaacagtgtaaaagtgttcctatttctccacatcctctccagcacctgttgtttactgactttttaatgatcgccattctaactggtgtgagatgatatctcattgtggttttgatttgcatttctctgatggtaatggcacataaagtttaatctgcaatacggaatctgatataccacccctttcctctcaccatcatctactctattt

SEQ ID NO: 715510 - DNA, 247 bp, Homo sapiens
aaaaataataataataaaataaaattggaagtcagagtcaaggtagagctaaactgtattaggctgttacagtgcacaactccaggtgccgtcactggcattaaagccaggaagcaattgtggaaaaggggaatgtctaatggtacctatctctatgaggtaatataagatctctatttttctggcatacgctttcagtaattttatcatgtttgataattcttttgtgacactggattgattttgg

SEQ ID NO: 715511 - DNA, 263 bp, Homo sapiens
agacccagagcatgggaagaaaaacgtggcagaggaaagccaagttaagcaacaatgatccgaagacgaatcccacagctggtaccataggaagagactccagctaatgaaaagtagagattcaaaacatgccacaggaagaagtctccagcaaagagtcctaatcccagcacacctcgtgggaagaaaagaaaggctttccagcatcttagacccaaaggctgcagagtcttagacccagggaaagccagagaggagccaaa

SEQ ID NO: 715512 - DNA, 154 bp, Homo sapiens
ttcctctcagtcattgccgaatgccttccgcctgctcaatcaaattaccgtaacaagtactgcatgtcgatgattacatcaaggaacaaccttgccacattttcagctgcccatggcatttatgggcacaagtcatgttccagcgatatccctg

SEQ ID NO: 715513 - DNA, 102 bp, Homo sapiens
gaataaatatatatacatatatacatatatacataatattcataaatatatatacacataatatatcaatatatatttacatttaatatgtatatataatat

SEQ ID NO: 715514 - DNA, 390 bp, Homo sapiens
gtgctcagaggatcccctcataatgtgtgccagtatccagtagttatcttttctgctcctctccctcctcccaccctctcctttcaagtagatcccagtgtctgttgtttcccatctttgtgcttgtaagttcttaccatttagctcccacttataagtgagaacacgcggtatttggttttctgttcctgcgttagtttgctaaggttgtgccttttaattgaggcatttagcccatttacattcaaggttggtattgatatgtatggatttgatcctgtcatcgtgtcagctggttattttgcagacttgtttatgtggttgctttacagtgtcactggtctgtgtacttcagtgtatttttgtagtgggtgcgccgtcgcctacgca

SEQ ID NO: 715515 - DNA, 625 bp, Homo sapiens
tgtgttatgttggtagctactgtgaattaagttgtggtttcatcatgagtcttaatgttctttgttgataagacaagtttagaattggtttacttaatacaaaaaaaaaaaaagaatttcaaaaaaaaaagtggtttgcttaaaaaaaatttcatgtgagggaaaaaaaaaaacctattccagcaataagtttcggtgtgggcttgtgacgcattgatgtcattttttctacattgtggactattatagatgtgttggtgtccacgcacaactgtgatctgtattactttcttttaaagaaacaaacaggtgaaacatatattagtgccaaattccaaaggtacttccttcctagagcctcgcacgtgtgtcctcttgctgagaagtaacttggcataacatgggtatatcacatcatgctgttgtgtattaaactccctacattattttaagaaacaaaaaaaccacaccaacaaaacagtgttaccaaacgtttggtaaccatgtgttatccctgtgcatctgcgtttgacctgaaattatgttacctcgttggtcaataccctcccggaagatatattgcaaaaccatagtataattgccatgtcccattttttaaccacat

SEQ ID NO: 715516 - DNA, 668 bp, Homo sapiens
  misc_feature (4)..(4): n is a, c, g, or t
  misc_feature (12)..(12): n is a, c, g, or t
  misc_feature (19)..(19): n is a, c, g, or t
  misc_feature (24)..(24): n is a, c, g, or t
  misc_feature (28)..(28): n is a, c, g, or t
  misc_feature (44)..(44): n is a, c, g, or t
  misc_feature (81)..(81): n is a, c, g, or t
  misc_feature (130)..(130): n is a, c, g, or t
  misc_feature (180)..(180): n is a, c, g, or t
  misc_feature (196)..(196): n is a, c, g, or t
  misc_feature (641)..(641): n is a, c, g, or t
  misc_feature (657)..(657): n is a, c, g, or t
ttgnaatattgnccatctncttgnctgnccaaactatcttgtgnaaatttgccttaacaaatatatggtcttgccaatcgnaagaaccatattcttcatttttccgggatttcaccagtgtgactttagntaggtttagtcaggtctggtctggtaagcatctgtaccgtcctgttctgnaccgtggggtacaagncttcctctctctacttgcacttctatccctcggtccaaatcttctcactccttctgttaaccacaccactccggcccacttcttggatcatgtatttccctcatcataactatcttcttcattatcagatactggttcaggatcaggacgacttactggtatttgaactttcttcttccttctaattgtaatttttgcatttttccccacttttccttagttgctgaacagcaaaagcatgttcaacattatccattgaaactccgttaaccattgcaactcggtcattttcctgtagctgtccttcagctggtcctcctttcagcacatctgaaatcactattgacgtttccccactctgaaaatgaggattatctcgtccaccagatattgcaattccaaatccaaatccaggagccctgtgaagcgtcactgtatgttagtngcaattatagctgttncctaccattgc

SEQ ID NO: 715517 - DNA, 107 bp, Homo sapiens
tacctgcaccttacgttcgcgattctcttggctttaatttttctggtttatgcctgtctcctgtcactacctacttgggagtttcctatcttctcatccatggcaat

SEQ ID NO: 715518 - DNA, 120 bp, Homo sapiens
cactgttaccaagaaggccaagaaggagccagcagaggaaaacagaggagaaagaggggcacagggagaaagtggagcaaaacagtaacactgctgttaggaatgtaaaatgccatagct

SEQ ID NO: 715519 - DNA, 161 bp, Homo sapiens
gcaggaacggtatgagggcagagtccatacacacaaacatcacagtatagctccccgtcaaacatacagacacaagacacagaaaaagcacccacaggaacttccacagtgaattcctaatttacaaaaaataaaagaacccacggaagaaatctccaggc

SEQ ID NO: 715520 - DNA, 212 bp, Homo sapiens
tgatctagaggatcccataaaaaatttatatagctgtatatagttataagcttgttttgtggaaaaaaattaataaaaactaaggtaattctagatttaggccagttcaggtgtattttgtatcttagtaatggatcatatcgtaaaaataggaaataaggtgggaagaatatattggttattgtggtctggtggggatggtccggaaaagg

SEQ ID NO: 715521 - DNA, 162 bp, Homo sapiens
agagagagagagagagagagagaaggtagtgtagttcttcgctcatatctccagcccccacttttcaccggttctgctggtgtctatttctattaatctgtgtacattatcctccctgcaaaatgggtgtggagctgtccctctatgctgagattgttgtgg

SEQ ID NO: 715522 - DNA, 122 bp, Homo sapiens
ccattctactgtcccggtgcgcagtatcgccggataatgactgcgtggcgtggggctgcgctcgggtctgcgatcagcgccatgctatccttgcgtggaaactttcggcgcggaaccagtct

SEQ ID NO: 715523 - DNA, 448 bp, Homo sapiens
caatagtcctcagaaagcaagcgttcctctcagaaatctcaccaactttgtttgtcttatgttcttaaattaagtgcttatagtaatgcttagatttgatggccctatatagttatatttatttgattttgttaatcaaacgtctgcatggctttaagttgctgattaaaagaaatatgcacatatacccagggatgtttcatgcgactttgcatttaataattcaaggtttgcttttgagaatgtgattttttgtttgttggtttttgttttcatttggtacccgaatgtattttgacatgcatattttgtgcttcttgaccctgtcaatgttcatttcgacattttgtttgtaagacacgctccacaggtactttgcatttagggagtatttggttcttgtcaaatggtgagattctgcaaaaaacagttttgttaatgaatccca

SEQ ID NO: 715524 - DNA, 391 bp, Homo sapiens
gagttcagaggcaagggacgacaaacgctccaataggagcgtagaatagcctagtgtagcgaaccgtttacttttcacgtataccgagaaatgtcgaccaaaaaccgaaaatccgcttcgcgaggaatattcgaaagcctgaaggatccaccggtcggtgaagaaaagacggaggaacgcgccaaccccaagggtcggcacgcggaagaagagtacccacccgcgccttgacgaacaatcgttccaaaacagctttctcagtagagaccatccgccatcaacagaagacgacaacccattctccagtttcagacgaccgtacaccacacaggacgacacacgcgaagaacctcttacaagccacccccgctacggcacccaccaccgtttg

SEQ ID NO: 715525 - DNA, 304 bp, Homo sapiens
cggatcagttttgcaggtggttaagccatttaccaatgattgttgtaggctaagaagggcagattattagagaaattgtgaaaatatgttgcagtgggcagctcagcagagaaggggctacctgcaaagaggcaagggctggaggaaagtttatagggtcctgctgaagggtgctacgtgctgaaatgaggtcattgtgcccgcaggttgtttgtgattagctgtctctaacaattgttcatacgataattgttcattattgttctcaacttggggctctccccaacctggggacccttcctta

SEQ ID NO: 715526 - DNA, 127 bp, Homo sapiens
agacaacatgagggatggaaggttgttcagatactggcgttgtgtaaaaacaccattgtgttggactgcgtgtaatgtgctatcaataaaattggctgcttgggcggtaatagttccccccttcaca

SEQ ID NO: 715527 - DNA, 115 bp, Homo sapiens
ccttccaacatctcataccctgtttccttcccactttcatcccagcaggccctttcttcctgctgacaaaacactcttccaacatctcatgcctgatttggcgggtaccgagctc

SEQ ID NO: 715528 - DNA, 726 bp, Homo sapiens
gctcagcactcagggcgcaagggccagcttccgtcaaaatgtctacttgttcacgaaatcctgtgcaagctcagctgtgcgggtgatcacctgctgacaacaccccgagagttgcatatgggtctgtcacagcctatactaatctgtgatgctgagcgggatgcttgaacatcgaacgagccatcatggaccagattggttgtggatgaggtcacgatttgttcaacattttgatcaacacgtgatgctaaatgtgaaaagatggaccgtgtgtgattgccattagtcctaactagaagcaaagggatctaaaaaaggaacttgttatctggataaatgatagtctagtcgtatatctgggatcacatgggagacgttggattctgggtgccctatttgatagactaccctggtctggaataatggatattgatcctttccttgttctgtttagattgggtgagaaaatggcggggaggatgtcatcgtcattgggatttttgcatccttgcgtaccatgagatcaaacacaagagaagttgcaagaaaaatgactgggatgttctaactatggaaatgtgtactataaatgagtctgttataaacgagaatatttgtggataacatgtgagtgaagtttacgtaacgattgaattggtatgctattgtctacagtttacgtatgatgggactagtgtggtctggggttgtatatgaactggggga

SEQ ID NO: 715529 - DNA, 1031 bp, Homo sapiens
ctctgaagacgcgcaccgacatcacatacacctcggatatgacacaagcacaacacccccctcacacacatcgagcatccaccaatgacaagagacaagtgatgatgccgaacaagacacacatgcacacaacagcagaccaaaatagacaacctaaacatccgacgcacatactacgcagctgcactaaaagtaagatatgttgtagctcagacaacacgctcacaagatagacgtgctgcacaagaaaacatgtgcatggagaggtcccacaccaccaccgagcagagaatcaggcgtagcgaacgggcacacatgggatttaagcatcctgataaggataaagagagaaacacaagaagagagagacacaacatagatccagggtgcagcaaacacactaagacgtgacggcggattcacgccgcgcacacaagtactccagatgaacacaggacggcgcgaacaaaaacaagtatggggcaatagcgacactgatcgacggtgcgtcgtcacgcgtcaatgatgacacacaatccacgagtgagcgggggcggaaagtcagagctccacgaagagcgctcagacacgctcacacaatcagccagatatgagtgtagcgtgaacgaagccatgcagccatgtccagaaccactaaagagctgaagatctactaggcgtaccacatcacagacaatacacagtacatcagaaataggcaacaacacgacactagtctagagcagcatagccgctagacacgagagcgatcgagtctgactactacgcaaaaaggggagagagagagagcggaagtctaaacagacacaaggtcgcagtctaagcacgtacagactcaaacgacgataataaagccgtgctcagcgagactagcatatagaatataatacacagaacgcgacgacgctacaatgtatcggacctagcaaagcaccaagcactgagcccacaaagaactcgcggtcacgacgtgcgtaagtcaagagaccacctgaccaaacattggagtc

SEQ ID NO: 715530 - DNA, 197 bp, Homo sapiens
tgctgcaaagtcgatcttagaggataccccattagtgaagagcagtgactatagagtaccgttactatcgtgaaaacattcaccgttgaccccagaccaagtgttctacaggcccatggtatgattacatgcaaccagaacaactttgtgcacgactgcgatcaatatcacaatcaagcagcacacggtcaccacaa

SEQ ID NO: 715531 - DNA, 195 bp, Homo sapiens
  misc_feature (1)..(1): n is a, c, g, or t
ngaacacatacaatctactaagattgaaccaataagaaataaaaaattatccaagcattgtagcacatgcctgtaattccagctgctcaggagactaaggtaggaggatcgcttgagcccaggaggaagaggttgcagtgagcggagattgtgccactgcaatccagcctgagcaatagagcaaggtccggtctc

SEQ ID NO: 715532 - DNA, 233 bp, Homo sapiens
  misc_feature (193)..(193): n is a, c, g, or t
  misc_feature (227)..(227): n is a, c, g, or t
ggtaaaatgcttaaggattatgtgtggtacataatacgcattcagtaatattaattgccattgttcacattattctgattccctacagcttgcaagtgtgaactagtttaacacaaaggagcttagctcatgtctggttctttcatcacctctctacaacttcctccttcacctgagctccattgaacaactngctccacaaacacactgagcccaattatgccctntgtgct

SEQ ID NO: 715533 - DNA, 1569 bp, Homo sapiens
gctattagtccttcccggtgtgggcttgctcgcgtattgtgtttgtgtgttgcttcgggcgtacaggacttcgctgcgcgctgttggagctagcccgccccttgtagttgaccaactcctgtgcgtgtgttgggtagcctctcgcctcctgatatgtttagtggctctctctcgcgcggcgggcggcgcgctgaggagtgttcgccgcatggtcgtgatcattctgaggggtgcgatctgcttagtttgccgtctgattggtcgaggctaccgcgcgtcgctggttggattcgctcgtgtggtgtattgatgatgcttggtggttgttgttgtttatacgtgctccaccgctgggtgtgttggctgtcaggcaaggttgtcgtatgttagtgtgcccacgccatgtttgagtagtggcgcgccgaatgttggcttatccatagcgagcgcagggactaccttacgtctttttggggatggtgtgtgcatcctacgcagcagctggttggtggttgatcgctcctgctccattcgtgtggctagccgcgcccccctcccgtgggagaaggggggtcttacatagataatatttgtcgcccccggtggggctttctcctgcttttataagggggtatgacccccgctctctgtcgtgatgttgtcggccccccttggtggtggatgaagtggcccccacaaggctcccgaccgctgcgtctggtgttgtgttggtggtgaccccctcccctcctgcgttatttgtgcagggtagcacaagctcgctggcggggggtactctcgtgtgtggctcaccacgcctttctccgcgagatcttgtttatcgccccctctttgggggctcgccccgcgggtgtctcctcgagattatatcccccacattttgtttacaccgcaccacagtgggatgacacacgcgcgtatatgtgcccccccctttgtggggcccctcttatatatatagggtggtacacacacttcatatatgggacacacacaagtgtgtgtctcaccacacacaaaagacacacgcgcgtcgtcgtcggtataccgcggtatctcgcgagaattctcccccccgcgagatatattttcgtgtcgaaaccacacacgcgcgctctcccctcgtgtgtattatgtctctgtgtgttgtctgacacaggggtagcaacacatggagagttatccacaagtgcacatatacgcgtcccaccacgagagagtgcgtatacactccgctaagaagtttcctattgagttcttctgagaccctctatgtgttataacaccctccgctataaaatgtagaaaatatcatctctttggttttgttctattaatatgttaaacttctataaggcgcggccttctgagctaagtgttgcttgtggacttgaatggctacgcacgctattaggcaccaacggctaataagctcccctatccacccacaattaagcccttgcttcttcggccttccatcattttgaacccttaacctcatagatttaggacgaaacactgtatataacaccaacagataaagggtta

SEQ ID NO: 715534 - DNA, 191 bp, Homo sapiens
acccacacctcctgctgaccaagttccagaaagccggagactcacaggatgtaataacaattacaggccacgcgcggtggctcatgcctgtaatcccagcactttgggaggccgaggcaggcgcatcacccaaggtcgggagttcgagaccagcctgaccaacatggagaaaccccgtctctactaaaaat

SEQ ID NO: 715535 - DNA, 328 bp, Homo sapiens
gcctggcctagtttttttaaagacagggtttcacagttttgcccaggctggagtgcagtagtgtgaagctagctcattgcagacttgaactactggactcaagtgatcctcctgcttcagggtattgaatagctaggattgtacttgtgtggccccacatttgactaattttaaaaatttgtatagagacaggatcttgctccattgcccaggctggtcatgaactttttgcctcaagcagtccttttgcctcagccttccaaagtgctggtattatagttgtgagcccctgtgccctgccaagtttcttttaatattgaggttttga

SEQ ID NO: 715536 - DNA, 207 bp, Homo sapiens
aaaatatcaatacaaatggaagtgaaaacaacatatcaaaacttatgaaatataggaaaagcagttctaagaggggtgtttatagcaataaatgcctacattaagaaagaagaaagatctcaaacaacctaaccttacacctcaaggaactagtaaaagaagaagaaactaatcctgaagtcagcagaaggaagaaaatataaagat

SEQ ID NO: 715537 - DNA, 152 bp, Homo sapiens
ctccacgcatactcgatgctctgtctcctagtagctgggattacaggcacctgccaccatgcctgggtactgtttgtattttggtagagaatgggtttcaccatgttggccaggctggtctcaaactcaggagttagtaccaccataaggca

SEQ ID NO: 715538 - DNA, 352 bp, Homo sapiens
ctccctaggatgatggaatgtcaaagacgatattccgccaagcctagatcgggcgctccctatcttgcgccagtgggtcacgtggtcacccaagttctttgagtggctttcacctgctcattcaggtaatgtgtctcaattaagtcacacaatgggggtcatttttgtcagtggccagttagtgcagaaccagtagtgactgatacacatcaaatttaccaaatgtcatgcacactccattgcattcagaccgctctcccagtcatcacagtctggtttcttgatatcctgaaggaagattcggccacctcgatggttctgcagcttcatcagttcctcatcctatggaaga

SEQ ID NO: 715539 - DNA, 926 bp, Homo sapiens
ggaactcggtggtggacagtgctggcagcagcaagacttcgctcgtactctgtgcgcctcgcttatgcttttcctccgcaatccatgtctgataaaaacctgcatatggcctgagtatcgtatgtaaagtatcgagtaaggatcgacagactgaagatagacatgcagatgcgtcacatggcagaaaaaagtccagctgtcgcttccaacatgaatagcgactgtgaaaccagtgacgcaaggcagaagtcagggcgacattcgtgtacttgcaggggcgttgcgccccgtctgaactttgtcaccctggtactgatttccaacatagaccactgtggccttgctataatttcagcgttccttgtcatgctggtttacacttgttgtcaagactggcaaagaaggtgtggcactgcactgtgttttacacattgaacctgtgggctgacgcccctttttgcacgatgcaaaagcaaactgactggacaaaacgaaagcggaccgcggtcctgaacactttttcctccccgaatccatgtctgcttaattcataattcctgaggacttggtgtcaaaggggcctacacagtgcatgaacgtaaacctttggaccaattgattgtggagctgtaaatgcggacacgcaaagcattggtgcgcgtcctgtgcaaccgaaaaagtcgtgcgcgctcggcgctaccatgaacctaggtttgtagcacttcgttcaggcaacggtgaaaaggatccccaaacgcgtcgggcgccccagacacgggcttgtgtgcctttcgtcatatcggtgcgtttggtccacactttgctacgctctcttaaaattcgcaacgaagctcgtccccaattagtggttctaaaattctttcgctctccagattggtggcaattttcattcccatcgtacaatg

SEQ ID NO: 715540 - DNA, 155 bp, Homo sapiens
atcaagatgaggaaatgaggatcagagagatgacatctcttgtcaagtgtagctaataaaagtaactggaaaatggaggcgcagcccaggtgcctcccactaaagcccattctcgcaactctttcactgtcgactctgttgctttctctttccca

SEQ ID NO: 715541 - DNA, 460 bp, Homo sapiens
gcagaccagtcacatcgatttgcaagggtaaaagttaatcttgtttatgccaacatctcaattggttcagcttacacaattttgatggaaaattaaatttgagcaaactttccactcattggatgccacaactgtacacccagatcagctgaagacaagagcaaagctttcaatggaaatttaaacaagtgtgatcaagaccctaaaggatttctttgaaaaattgtaacaagagatagaacatggctttactagtacacttttgaagacaaagcacagtcaaagcaatggctaccaagaggtggaagtggtccagtcaaagcaaaagcaggctggtcaagagcaaaggtcaaggcaaaacaggtttttggaatgctcaaatcgttttgcttgttgactttctggagggccaaagaacgataacatctgcttatgagagtattttgttgaaaaaaaaaaa

SEQ ID NO: 715542 - DNA, 184 bp, Homo sapiens
cgtcaaagtaacccaagcattaaagggtttttattggctcacataactgaagagtccaagggatattctagctacaggcacggttggatccacgggcacaaacgctgtcatcaggattcaaatatatccatattagggctatgctttaccctgcactggctacactctctacatggtaagccct

SEQ ID NO: 715543 - DNA, 540 bp, Homo sapiens
ggcggatcacgagggtccaggagattgagaacatcctggctaccacggtgaaaccccgtctctactaaaaatacaaaaaaattagctgggattataggcgcacaccactacacctgggtgattttgtatttttagtggagactgggtttcaccatgttggccgggctggtctcgaactcctgacctcagtgatcccaccactcggctcccaaatgctggactacaggcgtgacccggcccggctgcaccaggcctgtttattccttggacactctgaaggtcagctctcttgacctcttcccaatcatgtctagcctgcagtgtctgactcagttttcaacgaaccatctcaaatgcaagtcttccttaacttccattcataattaataatttcctttggtttccagagtagttggtcttcacacttttggtcaaataacctttaaaattatttggaaaactgtttcaccctcttgcagataattaagttgacactcccaatattcttaaagtttaagtagtcgtataggattggtctcc

SEQ ID NO: 715544 - DNA, 359 bp, Homo sapiens
cccctacgcgtgctgtgctgtgcaggaagtgaagcgatctcagcgagggtgtggctggaagagaaggtgtcccttgtggtggctgaagttcagtgacttaatccatcctccaggcaatggggagccatcggggctcccactagcatgggcagttgctccacaaggagcccctttttctgatcacctccaccctcatctctcttctcggtctcagcggcatggtggtggtggctgacaatatctcgtagctctaccagaagacctactgtgtcagctacaacataccgtgcgtgccttctcactccgttccccgtcaccctccagggcatccacctcactccttttccagagtcttgcga

SEQ ID NO: 715545 - DNA, 463 bp, Homo sapiens
taaaaattggaagaaaagaaggctgggaaagacatggagccagctgcctccagccttgtgtcttttccctcctgcctttccaagaaaggtgaactacagatgttgtagctttccccaacccagtacactcttgaatacttttgctttgctattctccagtgcttcagaggccagacgtacacggtaggctggctcatggtagtacttctacatctccacaactgggcaatgtaaagaacctaggagaccctcttatatttttcagagcttacttgatggactgtgctacaaccatcctgtcactgcttaggagaccagaacatcttttcttcttagctttgtaatactcttttattctgaagcaaaaatgtattagattgggtatgctttttaccatagattactttataaatgtgccttgttcctggagcattggttaataaaggtatcattatgctgttaa

SEQ ID NO: 715546 - DNA, 96 bp, Homo sapiens
cccccgaaattccccttggggggggtttttttccttccccccaagggggccccgggggggattttggttttttttttaacggggtttgggccggga

SEQ ID NO: 715547 - DNA, 228 bp, Homo sapiens
ccccaggaaaaaacagggtttttgggggggttttttgggcccccctttgtggtttatcccccctcacccccccaaaataacccccccctttggaagatttgaaattttcccctgaaattggtcaaaaccctttttttagcccccggactttggggatgggttttagcccccccccctttgggttttgtaaagggaaaccaatttgggaaaaaaagcccagatttttta

SEQ ID NO: 715548 - DNA, 137 bp, Homo sapiens
ccaggtaactcacctgaatggttacctcactgctgaaaacccagaggggcgtggcacactcgctgtgtgtgcgaatacagcctctaaatgcgtcccttccttttctttcctgtcttcctctggcgcttacaatctga

SEQ ID NO: 715549 - DNA, 419 bp, Homo sapiens
  misc_feature (98)..(98): n is a, c, g, or t
  misc_feature (225)..(225): n is a, c, g, or t
  misc_feature (227)..(227): n is a, c, g, or t
  misc_feature (234)..(234): n is a, c, g, or t
  misc_feature (253)..(253): n is a, c, g, or t
  misc_feature (261)..(261): n is a, c, g, or t
  misc_feature (294)..(294): n is a, c, g, or t
  misc_feature (314)..(314): n is a, c, g, or t
  misc_feature (332)..(332): n is a, c, g, or t
  misc_feature (356)..(356): n is a, c, g, or t
  misc_feature (358)..(358): n is a, c, g, or t
  misc_feature (360)..(360): n is a, c, g, or t
attctcaccagtcacctccacttggccttcatagattttgtccatgcccaacctattgagaagcctgcgggcccgaatgttgccgattccctgcgctncttaatggaagaagatgaagatgcttccaaaaaaccgttttccccatacataaagaacaggggtactcccgccctgatgggggggatggataaaaaaggtcctgctgctatacgagagaatcccgtntntgaaaanaagccccagaaagaagttnaaaaaaangggggggcccgtccccaaatgtcccttgctcanaaaaagggtgggggggctcnaaaaaaggccagcttccncagaggtcagggggggggtggtgngngntaaaccccgccattttttatgattttttcagaaatagataataaacttttggcccgcca

SEQ ID NO: 715550 - DNA, 261 bp, Homo sapiens
  misc_feature (139)..(139): n is a, c, g, or t
  misc_feature (175)..(175): n is a, c, g, or t
  misc_feature (260)..(260): n is a, c, g, or t
tcaagcaattctccgtgccttagcctcctgagtagctgggttaacaggcttgcaccaccatgccgggccagttttggtgtttttagtaaagacggggtttcaccatgtgggtcaggctgggagtaattctttatattanttgaaaatgatttttttctaaagtagagaatcctantcaaggagattcttttctggggagtctcatccattcagtatttattaaatgctgatgtgtgccaagcaaaacaaacttattttcnt

SEQ ID NO: 715551 - DNA, 141 bp, Homo sapiens
caagtgctctccctccttcatctctctctgtttcattgatatagaaatttagatctgtaaggaccatcagtgtggtgaaggtcacatgacgctgctgctgaatccatggagagaacaaggataaatttccagaactcaggt

SEQ ID NO: 715552 - DNA, 951 bp, Homo sapiens
  misc_feature (12)..(12): n is a, c, g, or t
  misc_feature (14)..(14): n is a, c, g, or t
  misc_feature (936)..(936): n is a, c, g, or t
cgggcggcgtangnactgtctgggccgcctcgtggggagggagggggcgcccggccgcccggcggcgaccccggggcctggcgccaccatgggcttcgagctggaccgcttcgacggcgacgtggacccggacctgaagtgcgcgctgtgccacaaggtcctggaggacccgctgaccacgccgtgcggccacgtcttctgcgccggctgcgtgctgccctgggtggtgcaggagggcagctgcccggcgcgctgccgcggtcgcctgtcggccaaagagctcaaccacgtcctgccgctcaagcgccttatcctcaagctggacatcaagtgcgcgtacgcgacgcgcggctgcggccgggtggtcaagctgcagcagctgccggagcacctcgagcgctgcgacttcgcgcccgcgcgctgtcgccacgcgggttgcggccaggtgctgctgcggcgcgacgtggaggcgcacatgcgcgacgcgtgcgacgcgcggccagtgggccgctgccaggagggctgcgggctaccctttgacgcacggcgagcagcgcgcgggcggccactgctgcgcgcgagcgctgcgggcgcacaaggcgcgctccaggcccgctgggcgcgctgcacaaggcgctcaagaaggaggcgctgcgcgctgggaagcgcgagaagtcgctggtggcccagctggccgcggcgcagtttgagctgcagatgaccgcgctgcgctaccagaagaaattcaccgaatacagcgcgcgcctcgaatcgctcagccgctggcgttggccgcgccgcccggcggcacagggcgaagaaaccaaaagtctgactcttgtctgcatcgggactccgctccctgggattcatattattggtggcggccgagtgtggataactacgatggatattcagtgaagaatctttgtatcnagatagttgaagtgg

SEQ ID NO: 715553 - DNA, 108 bp, Homo sapiens
cgctgtagtcggtgtactcgtaggtacagtaccattggtggcctgagtgggagtggggggccttgctaccacacccatacccctactgtgactatgcgaccaggcgta

SEQ ID NO: 715554 - DNA, 171 bp, Homo sapiens
cgtgttgcggtcgctctgaggactccccacacgccgatgtgcagccgctattaaggttcgtttgttcaacgattaaccgtcctacgtgatctgacgttcagaccggagtaatccaggtcggtttctatctacttcaaattacctccctgctacgaataggacaagtagaaa

SEQ ID NO: 715555 - DNA, 208 bp, Homo sapiens
acgcatggggatggtcttctaaagtgaagcagcacttcgaaaggcgatgttggacaaagacggataatttgcctagtgggattgggcctggtggtcttcttcttcagttttctacttgcaatatttcgttccaagtaccacggctatccttatagtgatctggactttgagtgagaagatgtgatttggaccatgcgtggattgccag

SEQ ID NO: 715556 - DNA, 565 bp, Homo sapiens
  misc_feature (103)..(103): n is a, c, g, or t
gattgaaaaatgggagttgtgcctggagcgtgttacgcaatcaaggaagggtgtcaacgtgacacctagcgcatgttgactcccggatatacggagaagacangtagtgagatgggccaggtatctcggcaggctaatttgcaagacactgcgtgtgtgggcgcggaccggaggagctccgagacccgaaaaatacgttgaattcgggtcggtgtacatggatcggtgcgactagaacgaagggcagtaccttattgcaaaacttcgtgtaagctccctacaggccggaaagtcgtgccaaacaagatacccaaatccaatcggacacggcgtccggtttggtaaaaacagggggatgcaagcaagaccaaggggtccggaatagagcgccttcacgttggagacgaacagaaaacagttcgtgaagtgcgcatataagacgtcgattccggatttttccggaccaaggagtcccttaatatggaacaggattaattaaggaagaacgtagagaacctgttggacatgggggcggaagggtggaatgcaagaagaaaggctgctc

SEQ ID NO: 715557 - DNA, 457 bp, Homo sapiens
  misc_feature (231)..(231): n is a, c, g, or t
  misc_feature (246)..(246): n is a, c, g, or t
  misc_feature (270)..(270): n is a, c, g, or t
  misc_feature (297)..(298): n is a, c, g, or t
  misc_feature (319)..(319): n is a, c, g, or t
  misc_feature (337)..(337): n is a, c, g, or t
  misc_feature (343)..(343): n is a, c, g, or t
  misc_feature (352)..(352): n is a, c, g, or t
  misc_feature (430)..(430): n is a, c, g, or t
  misc_feature (453)..(453): n is a, c, g, or t
aaaaaaaaaaaaaaaaaaaaaaaaaaaaaagcggccgctcgaattaactttatttcaacataactatgcttacagaaatacactcatattggttaatagaatgcaatttaagtttaacttatcctacataatttggaccaaaaacttggtacatggtttaggattttaaaaaaggattgcaatcggtttaattttaactattacaaatgtataaaagatcttcccatcaangctgctaaagaagcngcaagaacctgagaatttaccttnggttgccccgaaagtaacactattggnntgcttaagtttataaaatggngcacaaaacttgttgtangttcangccgtttanaagttcaatactaatgggtatgggagggaccgggagggaccttgtaccatgtgaactgtgctaccggattagtttgcngtagatgtaatctccccccaggntcgg

SEQ ID NO: 715558 - DNA, 1448 bp, Homo sapiens
  misc_feature (1447)..(1448): n is a, c, g, or t
tggaggagggagtctgggctcggtgggcccagggtgggaatggcaggggtggcgggtctcggctcgctggcaacctccacctctcaggttcagggtgagttctccggcctcagctctcccaggtgggtctggggattggcagggtggtgtggccacccggcccagtctaattttgggtgattttggggtgggaagacggggtttgcgccactgtgggccagggcggggtctcgaggactccgtggacctacgggatgagatctaacccggcgcttgggcgctcccggaaggtggcttgagaattaacaggggcgtgtgagaggccccccgggagccgggtccgaagaaggcaaaggctaactggtaaattctgactgtgtaccggtgttataacaggatattaaaacctatggggcataaagggcgcccacaaatcactcaagaagggagcttacctggagaaaggggaacaaagaaagcgcaacacgtgtaagatttgtccacaatttggtgtataaaaacacataacatataagaggataacccacacgtggactatataaatattagcgcgcggacgataatttttatacaccaagaggcattgtcttctgggttaacacgaggggtgtactcaccgcagggtggacttatataatggccgattatttaacagcggaaaataaggcggatcaaaaaattgtgtgggacaggtcacactgggggagttaccatgagaagccccaggaagggggagcgaggcactatagagggcaccccacattggaggggacccacacgtgttgtgaccactatataaaagcacacgacttgggtggtgctaccacacaaaataaaaagttgggtgtagccccacaacttctgtggtgtttataaaaaaaccaggtcggttgcgggggaaacacagcgcgggtggtacttagtaaacaagcaaaataaccaatgtagagggcgggaaggcagcaccaacaaataaggcacccaatatattgagggaggacgcgacccacaacaacgtgctggagcgacacattaccacagaacacgggaggcggccacggagacaataacgaaccacaaaaagacggaggcccagcattggaggcaacaaccttccaaaaagacacagttgaaaaacatattgagggaaagcgagtcgatgatagcccaaaaaaaaactcaataagaagagcgggagaaatatcacgcagcaaagaatcaagaaagagactaacgatctgtatagcgaagaggtagtaagcaatgaaattaagaaccgatgacgtcgataactaacaaatgattgagataagaacaaagaaggctaaaaagaatcaaataaagtaatgcatagatagacaggatcagtctgtcttcagtctgtttgctttcctcgctagcctctcatacttactgctccgtcgtnn

SEQ ID NO: 715559 - DNA, 1235 bp, Homo sapiens
  misc_feature (1235)..(1235): n is a, c, g, or t
agcggccggggcagagtgagggctttacccaggtcacccgcaatgggtggccgtacgggcgaagaaacgacaggctgaacagctgtccgcagcaggagagggcggggatgcggtgccggtatggtacatcagaggaggccagtgccggggaagaggcccgtcttcccagcccgcgtctgtggggtgacgggccgtcctgccgttggagacaagacagacatacaagggaaaatttccatgttcccagcttagacagattaccacatccatttggaacacggaaaatctggaactgacaggattatttgtagcttcgcttagttgggtggaaacgattatgtggggaagagttccgagaattagcggcagttttgaactttttgaaaaattcaaggggaaagtgttagggaaatttcaaggggaccatttgggtacaggggaacaaaccgaagaggcacttgctctacgctggctttcttgagcaacaaacgctacgtcttgaagtttgcgatgaaacaagctttttaaacagttccttccgagacatttttacagggggttgcgacggcgcaatgccaaccttttggcgcccccattcgaatttcaagggggtagggggcaatttgaaagccccttcctttttccccttttaaggaagaattcgatatattggtggaagaaagttttacccagcgcaagttgcctttaaaaagagcccgcccgtttagaacacggccgggcaggaaaccccatatttcctttaatttccgcgaggggggcccagacttttagggggcaaaggacaatagttccggccgtttgggtcccaaacacgggggaagtgggacaaatataacacggccaaaagatttttcaacccgcaatttaagataagaaaaaattggttggaaacgaagcgggggcaacacacaggtggggcacattaggcgttaaataagtgggggccgttggcagtttggtttgaaaacaaccggctttttccaaccaaatattcccctttttgagcggcttccccgtgttttcccgagacaagagagttaatttcaaatagaatcttgcgggcacaacagaaaaaccctgtggcccaaatttttggccagaagcgccttaaagcttattatggggggaaagatattcacgttccctttatcccaagaggagagatctcacagtgggggcacacctattattcccgaagagctttgtgggggcan

SEQ ID NO: 715560 - DNA, 261 bp, Homo sapiens
actccaatctcaccagttctaaacaagggtattagattctattgtgactccattagaatttatgatagattattttttagctattttttccctgtgtgaacttgttttcctaaaaatcatgtaaagtaagagttctcttatgtattattttcggaagaggggtgtggtgactcctttatattcgtactgcactttgtttttccaaggaaatcagtgtcttttacgttgttatgatgaatcccacatggggccggtgatggt

SEQ ID NO: 715561 - DNA, 236 bp, Homo sapiens
gatccagcattctcaagtgcaacctggacgagggccacaaaaagtttagctaagggagcgcttcaggtgagaagcagcacccccttggtggacacagtcctgcgactgtggaaaatgccaccatctctccccttggcctgagatgacagagctgttcagatccacgaatgtgcatgattctcataaccccccagacctgagagcagaacaccagagctctgtagctaaatgctttg

SEQ ID NO: 715562 - DNA, 157 bp, Homo sapiens
cagaagggaaaggtttgctttgttaatcatgccctatggtgggctgaaattaactgcttgcacaaatatacgtttcacttttaattaattgtgcttaaggctttaattaagatttgggggtcccttcttagacgcagctcgtactgacgatcgtggg

SEQ ID NO: 715563 - DNA, 681 bp, Homo sapiens
ttagtggtcgtcatggtgaccaagaccaaagccggacaggtacctcagtcacccccagaggcctcacccagagctgccccagagtgcctctacatccttcgacgatgtggcacgcatgtcaggacgatgtcctcatctgccacacacgtggcctggaccagagtaggacgaagagcccggttccatagagcaattcgggccacgaagcaggttccgcatggagctctggagtcagtgctcctcgagtcccttcctttcactggtgagcatgggagtcgtatgatgggaagtaccgcaggcacatacctaccgttcagatgtacggtctactggaagtggtgaggatgatagcatgcacgggaagaatacctgtacgtggagacttatagagccctgagtcatgcggcgggtgcgatcgacccgtcgcttagcacgtagcgcaatttgcacggaccaaaacgcatcgcaacgcagaaggcacggatcggacatgtgcatccctttgggtcaaacccggagcaaattacacttggaaaggatcccacacggatacgcaattggcatacccatcgcgttgcatgcgtgccaaaggtgaagtacgccgttggttgggtactcgcgagagcgaggtcccgagtcccattgggcccttccgacttggtgaccgaaaccttccctagg

SEQ ID NO: 715564 - DNA, 703 bp, Homo sapiens
  misc_feature (3)..(3): n is a, c, g, or t
  misc_feature (56)..(56): n is a, c, g, or t
  misc_feature (67)..(67): n is a, c, g, or t
  misc_feature (74)..(74): n is a, c, g, or t
  misc_feature (112)..(112): n is a, c, g, or t
  misc_feature (114)..(114): n is a, c, g, or t
  misc_feature (119)..(119): n is a, c, g, or t
  misc_feature (123)..(123): n is a, c, g, or t
  misc_feature (152)..(152): n is a, c, g, or t
  misc_feature (165)..(165): n is a, c, g, or t
  misc_feature (224)..(224): n is a, c, g, or t
  misc_feature (231)..(231): n is a, c, g, or t
  misc_feature (247)..(247): n is a, c, g, or t
  misc_feature (299)..(299): n is a, c, g, or t
  misc_feature (301)..(301): n is a, c, g, or t
  misc_feature (306)..(306): n is a, c, g, or t
  misc_feature (308)..(308): n is a, c, g, or t
  misc_feature (315)..(315): n is a, c, g, or t
  misc_feature (324)..(324): n is a, c, g, or t
  misc_feature (382)..(382): n is a, c, g, or t
  misc_feature (408)..(408): n is a, c, g, or t
  misc_feature (411)..(411): n is a, c, g, or t
  misc_feature (425)..(425): n is a, c, g, or t
  misc_feature (448)..(448): n is a, c, g, or t
  misc_feature (543)..(543): n is a, c, g, or t
  misc_feature (545)..(545): n is a, c, g, or t
  misc_feature (549)..(549): n is a, c, g, or t
  misc_feature (563)..(563): n is a, c, g, or t
  misc_feature (595)..(595): n is a, c, g, or t
  misc_feature (696)..(696): n is a, c, g, or t
tgnattctctctccaagtccttcctttaatgtcagggagtgcttcaacccaaaaanaagcagtatanataccanagagaaagggacctgagggcatctgagtaatgcatggngnggtanatanaaaccttggcccagcccaaaggagcagtnaagggcctggaanaaagatggtttgctctttccccctcctcctctctctttcctaccgggcttaaagtccgnggaaganaaagtttttaatcagnggaactgaaaaggcctcagggccggggaggggagatttggttgttcagtaananaaaangngtttaanaaaaaaaanagcccaggcttcccagcagtagcccatgtgttggctggttcagcagcctgacctctanatctagacaagagaagtgaggagggngantgctgggcattggngtaggtttatgacggagcagcanaagattttccgtgcccagtgaaaacgtatacaaaaattcaaagccccttcccctcagccctgctctgctgacaaggaagctgctgagagtgagtnanagcngggcacaaagtgtnttgtgagaccagctatagggtctaatgcagtnaagtcagttatttaggacctattttcacacaggggcaaggaaaaaccagaaacaacttctctcttaccctttaaactaagatacttcattctacacgattncctgaaa

SEQ ID NO: 715565 - DNA, 205 bp, Homo sapiens
ccgataagtagctgctgattctaacaaggaccttctattaacacgcctcctggcgctgacgggtcccatcaagggaacaaataaaaagataccttgtgcatagcgggcggagctattcctatacccaagaatcaaaaaggagggacctcgcctactttacctccctgtccagcttattcccggtgctggaaaggcgcctccaggg

SEQ ID NO: 715566 - DNA, 907 bp, Homo sapiens
tggatgtagctgctggtgcttaggaacccagtgtgggctgcccgagtcggagatggtttcttccggcggaggcggcggggccgtggccgagactccgcagggacgcgcccccgccgccgccgccgcgctcccccgcgcggcctgagtgaggcgccgccgccactgagtggaatgcgagcccggcccttggcgcgcgcggtgcagcatgcgggccgctggggttgcgctggggcacctgctggctgccgctggctgtaggagctgtccagccggcccctgtgccgccctgccctggctgcttccttctcagctcgcaggcctgcctcagcgagagccgccctgccagcactgtgcgcctgcctgccgcccggcctgcgacgctcgggagcaaattgcccgccggtgggctctgcctgctctgcccgtgggccagccatggctgtgctgtggttgctgctgctggggcttctatgcctggcctgtgtgcctggggcccgtctggtgtgcctttgctggcatcccccgttgattgcgtgcgtgattgtggctgtgctgtgccatgcctgggtggccccctgaagagggacagatgcccgtgggtctgcgccgagctggggttgagtgcgtccgggcgggccgctccgcaggcccgccggatgctggcgacggtgtgtcatggtcctcaaaaaaccttcttgttgagacctaaggaacccatttctcctccatatgaccaggtacaatacagtggaaagccttctcaaaccccaggggtccttgtgacattcgtcatggtatttaaggaacctagctaaaggtccaatagtgagtacccattccaggaaggtaggctcagaagattaaaggaaattgacacctgtcaataccgggagagaacacaatgccc

SEQ ID NO: 715567 - DNA, 1863 bp, Homo sapiens
  misc_feature (1299)..(1299): n is a, c, g, or t
tcaactttcaactcccatatcttaattggggacaaaggagtgaagtgatgcaaaccatcaccaaaggcccacccaccaagggtgtccaggctttcagcaccatagttacagcattgacgtgaggtacatttattcaaatacaggtgcaaccttggggatgtggattgagaagtgggagaaaatttccaacacaggagaagtggaagacataagagtgtcctttcatatgagctgtgtgggtgctagaggtgcatgtgatattggagcacgtggcaccagctccacctatatgtggattagaacacgacagggaggtgtcataaagaattatctcccactatttggcgacagatatagagatataggcgaaatgagacacagaacatctctccccatataatatatacagaccggtggaaacacaagtggagacagtgtgaggaatataacctgtgagaggggccaaaaatctcccttatatttaaaaatatatattttggtggaaaagaaaggaatcgcagagattttcatcaccccttatacacaggggcgtgggggatacatagagggcagggcgaaacaaacagtgtgaaaaggggtaaaacatttagacaaaatatcttatacacggacaagaggacacacctcagaggactccttgtgcgtgtcgaaaaagaacacactgctgctcaatctaagtgtgccaacagaattgtggaggacaaaaaattgagtcatcatcactggggggagaactgtgtgttgtggttcaacccactcgtgtggtggcacaatttactccccaattatacccctcagtggttgtttggacacccgtacagacaaaagggaaatgaacccacaaattaacaccgtccaaggtagcaagagagtgggtttcccccgaaagggagtatataacacaaggaaaaacaacacgagtgtggggaggaggtgttaaattaccgcgcccaacagagagggggcgagacgaggagaaaacccttatacacagatgatgggcacaaaaatcaccgcggaccaccccaaagaagatgggtaggcaagcacacgaggattaatcatacaaacatcaccaacggtgggtgtgcggttgagtatatagtgaacatgcagaccaggagacaccttatcagccccaagacgaccacgggatgaaactacccatcaacagcagtgaggccaagaagagttattatgagacaagcaacgacgttggtgtaacatccaacaggaagaaaaggagcccgagagaaatgtggtccccttagtggtggnttgttgtgaaccccactaccgtgggtggtgtggcaggtatgagcgccacaaaaagagccccatgagagagagagaagagagcaacactcgaggagagaggttgacccccccccggagtacacgaaaaagagaggacgaaaaaacaccacatttagagcacgggatcgccgcggcagcgcataagtagaggcgtcctgggagcaatcagaggagggacccaaaccaaaagatagtatgcgaggggagcccccaggggcacgccacaaaagatggcttctcccaaacccaagaggatcctggtcaggtaggttcactcaacaaggggggagcagagaggactcaccagcgagacacaacatacatagatgagcagaagaacccggtcgccaagcgcaaagagacagcacactagacacaacataaaacagaggagagcaaaagcacaccactgagtaaaggataaagacagaaggaacaaatgaagaagcgaagaaagcaagaaagacaaaaagtaagaaaggattgcactaagcagagagacaccaagagaatgcaaaaagacac

SEQ ID NO: 715568 - DNA, 596 bp, Homo sapiens
gacagcctcaagggcttcagcaccggcgcccatggcagagccagactcactcagattcagactctgagggaggagccgctggtggagaagcagacatggacttcctgccccatccagatggggaggtgtgatgcgcgtcattgactagagcgaacgctgtcgcagagtcatctgtttggtgggagctggaatctcccacatcccgcaggcatcccccgactttcgctctccatccaccggccttctatgacaacctagagacccctacaacaccatactaaccccacaccacaacccccaaacaccaccatcaaccacccccccaccccctccccacacacacccactaccgcacacccgcacagcacaaccacgccggagcagagcacacgcgatgacccgcgccagccgccgccaaaacgacgcggacgaccaccctcccccccccaatccgccgcggacccgcccgaacacgcaccacacgcagggcgggcccaagaacacacaccagaagcccggcgagggaaacggaccagaccgccagccgacacgagccacgagacggagcgagcgagaccccgacacccaggagccga

SEQ ID NO: 715569 - DNA, 317 bp, Homo sapiens
actgattcctctgctcttccttccatcttttgaacctgtcgatgagctcgtacaagtagcacgttttctctgctgggggagaataaacttgtgcttcaataactccttagcagtgggtctaaagctcggctccttattcaaacaggcctccacaaactccttgaggggtttactgtagtttccttccaacgtcggagggttgttctttggaatgaggaataaaactttcagggggtgcagctcgaaatgaggtgcttcccctctcgcaagttcaatagctgttatgcccagggaccagatgtctgccttcgagtcat

SEQ ID NO: 715570 - DNA, 1228 bp, Homo sapiens
gaattggttgcagcgcaggccagtacataaaaatgggtttgctgcttatcagcagtctcgattggtgcctgtaatatgccagagacccagtggttcatgacctacttagctctagtcactctggccaagctctgacctgcttgccactgatagccagggaggacattatataacgcacagcgattgcctcaaacactcgtccaatgtctagcgagagtaaccaagtttgcaggtatggtcgagaagctagcctgtgggtagtcttgagcattccccgagcgcccttcaccctcatctgttcgcacgcgtccatgcaatttcatacgatatgcgtctgtatagtagctgtgcgtcatgctcctagatggcaattcaggagcattgtggtctgtgtttcaggtaaagattaactggtatgaaaattgtcccgcgagctcgctgttcggcgaattctatagagtgggacagagcccaatgatgttggctctatgggtacatgaatacttgaatccccgacctaaggccattgaaaagcaagctagtggagcgtacgtagaaattcaagcggtagtgatgcaaagcaatacctagataactaggatactagatatggtgacttttgatgcacattaaccacactgcctagactggccttttggcacttgacttgtgtctctacttttgacgtcgtttgtagaacatcaaagataccttgtagacgggtaagaaggctccttagacatgtgccctcgattcttaagcgagaacgatgaccccagatggtatcatcgaaggacgcgtctaacaggtgacctgggtccgcagcaagtgactagtccgagcttaagggtcactgggacagtgcatgaacggtgagaaattcttggacatcccaagcggagagtataggcctggtttgacacactttgtttgactccattacgaaagtattaacgtctggttaagagagtcttgggaaccacgtagtccaggagattaaccctttcaaggggcaacaatccaggggggtccaagaatcggtggcatggtacattcagtaagaggtggcatctttgctgtgtgcgtacaactcttgggccacggctgtaatacttggaatctggggaaagcgaacacttacagaagttcccaattcccaacgcagtgaatttagacggccccagagtgggtttacgcccaagagggcctagctgttgtacgaaaattg

SEQ ID NO: 715571 - DNA, 876 bp, Homo sapiens
tgctctgtgtggtcacagatcggatattccttctgcatagtctattaatggtcccctgaaatgaggtactgcaaatggcttgtgatattaacttgtatgttcaatgtagactagatgaaggaccaaccttatctctctaaatcgtactatagtcccttatatatttgatatcgtctgtcacacatacgacatctaggcgatatcatcactaattggctatctttgcacatggctgcattgtaccaggcccatcgagtactacaaatgcactcgttcattgttaaagattccaagctcctggtggtcgttgccattaatattgggacctactcacataggttcttgaaatcgttagattccgaatgattgcaattgaggtatttgggactgggctaggcttgtaagttccctttgaaggcttaattacggaaggtggccacttctgacctcaactcgcggaatagaaaattgctccattttcaaccgtagcttttttagaaccaaggtaaaatttgctatgcctggggatcatgggtttgggtgcccacttttttgcgaacccgagaatcgtgatcgaaaaacgagaaacgggttttgacctggaagtgccgcgcacaagagaatcgattgtttcgctataaaaaggaaagggctccaaactcttttgcggaggcaattgcgacctgtgtgtggacgattggtcgaaactatacctttccttataatgcgtgggatttattcccccagatttgtgtcacacattccccttgggggggggggtaaattttgattatcttaacccaatttacttcattggacgctttcctaattccaaaacaaggtctgcttgggggtgggaagatgcctagacgaact

SEQ ID NO: 715572 - DNA, 772 bp, Homo sapiens
tgggctggactcaggatttaaaaacgggaacggtgaaggtgacagaagtcggtgggagcgagcttcccccaaagttcaacaaggtggccgaggacttggatggcacttggtggttttttaaatagtcatcccaaatatgagatggcgttggttacagggaagtccctggccatcctaaaagccaccccatcttctctctagggagaagggcccagtcctctcccaagtccacacaggggaggtgatagcatggcttccgtgtaaatttatcgtattgcaaaattttttaaatcttcgccttaatactttttaatttggttataaatttggaattgatgacgccttgcggggccccccctttccccctttttggtcccccacattgtgagatgtatgacgggcttgtgggctctcccgggggagttgggtggacggcagccaggggttaacctggtacactgtgactttgagaccagttgtgaaataacaacgtgcaccaccttttaaaacaacaaaacaaaaaaaaccccgcgcaagaaacagagttccccggcgaacaactcatatgtcgacgggagcggaggaaaacaaagagggctatgggcaagggggcaacggtgcaacacaaacagcggttgcacggggaacgccaagtatccttgggctaccacgaggggggcaacaactaggcgcggggatcccccccgtaatggggaccgcaactaatcacacgaccagaaaagaccgggtgaccaccggcattagaacgccg

SEQ ID NO: 715573 - DNA, 362 bp, Homo sapiens
tccccatcttcgtgccccatgatctttacacacagagaccttcccaggagctgtgacttgaacttcacaatcggcagggtccacccaggagccgtgtcctcctcacagtgcaattggatcccctcctctctcaacctgtgtgggaagactggaaacaaaaaatagagaaagttggaggtaacacactaaggggatgggcatccccaggacagaggaaaacactgaggggatggatgggccacacctgagcaatctcaggaccgaggaaaacactgaggggatggatgggccacaactgagcatcctcaggaccgaggaaaacactgaggggatggatgggccacacctgagcatccccagga

SEQ ID NO: 715574 - DNA, 587 bp, Homo sapiens
  misc_feature (9)..(9): n is a, c, g, or t
  misc_feature (577)..(577): n is a, c, g, or t
gttcttcangtggtgattctgagattttagtgcacccttacctgagcagtgtacagtgtacctaatcccctttctttgggtacgatacgacaaaagaatagaaatgatggccaggcgcggtggttcacgcctgtaatcccaacactttgggaggccgaggcgggcggagtcaccccattactactaaaaatacaaaagtagccagacgtggtggtacatgcctgttatcccagccactcgggaggctgagattataggcatgctccaccatgcccagttaatttttgtatttttagtagagacgggttttcaccatgttgaccaggagggtctcgatctcctgacctcatgatccacctgcctcggtttcccaaagtgctgggattacaggtgtgagccaccgcacctgactgcaaatgattttttaaattttaatagttttttgggtacaggtggttttggattaaacagataagttcttcagtggtgatttctgagattttagtgcacccttacctgagcagtgtacagtgtacctaatatgtagtcttttatccctcactcctctcccaaccgnatcacccgtt

SEQ ID NO: 715575 - DNA, 305 bp, Homo sapiens
gtcggcaatgagaaacattgaggacttctagtccaaggaagtaatattattggatctgtatattaaaataattatttgagaggtggtacacaggcctgattgaaataggtaagagttggtggctgggaaacgggttaagaggttactgagcttggaatagaaaagctaaaagggatgtgagcaattttgcaggtggcagcctcatatggcttgccaattcatgcaggcagcaaaggggcaaaagcaagtttgggtaactgcaacagcatgctgggtggtgtggatctgcatcatctagcaagtcc

SEQ ID NO: 715576 - DNA, 503 bp, Homo sapiens
gtacctcaccaacccccaaggtcctaaacttcccaacctgccatttaaaatttcggttggggcgacctcggacccagaaccccacctccgacccagtacatgctaagacttcccccagtccaagcggactactatactccaattgatcccaataacttgacccaccgggaccagttaccctagggataaccagcgcgccaatcctattctagagtcccaaatccacaccaatagggtttacgaccctccgatgttggatccaggacatccccgatggtgccacgcccgctattaaaggttctcgtttgttccacaccgattaaagtcctaccgtgatctgagttcagaccggagtaatcccggtcggtttctatctacttccaaattcctccctgtacgaaaggaccagagaaataaggcctacttcaccaagcgccttcccccgtaaatgatatcatctccacttagtattataccccccccccccccagaaccgggtttta

SEQ ID NO: 715577 - DNA, 80 bp, Homo sapiens
actcccagcagcgcacaaactgctctaatttcttctgtcttgtttatgccaaaaaagcaaaccaaaaaaccactcttgac

SEQ ID NO: 715578 - DNA, 453 bp, Homo sapiens
  misc_feature (32)..(32): n is a, c, g, or t
  misc_feature (66)..(66): n is a, c, g, or t
  misc_feature (166)..(166): n is a, c, g, or t
  misc_feature (171)..(171): n is a, c, g, or t
  misc_feature (451)..(451): n is a, c, g, or t
gtccctgtggtccccagctacttgggaggctnaggcaggaaaaatcgtttgaaacccgggaggagnaggttgcagtgacctgagatcacgccactgcaccccagccctggcgacaaagcaagaaggagtctcaaaaaaaaagaaaaaaaaagtgtgtatggccaanagtgngtgtcacgcctataatcccaacatagctgaggtgggaagattgcttgagcccaggaatttgagaccagcctgggcaacatggtgagaccctgtctctacaaaaaaatacaaaaattagctgcatgtagtgacatgcccctgtggtcccagctacttgggaggctaaggtgggaggatcgcttcctcagctcctgaggctgacccaggaggtcgaggctgcagtgagccgtgatcacatcactgcattccagcctgggcagaagagaaagatcctgtttcnta

SEQ ID NO: 715579 - DNA, 229 bp, Homo sapiens
agtactatataaggaccaatactatccacagggagtaacatactaggtgctccgtgaacaccctaccctatatactagctagcgtcggccccaaccactgccctgagccaagacctagggtagctaaccctctccaccaggccacctagtggtgatctacaacacaagtggcacttgattccacgcactcgattccatgcccccatcacctgctgtctttgcccgcggg

SEQ ID NO: 715580 - DNA, 658 bp, Homo sapiens
gggggtcgcggggcaacctcgggctttcttgtccaaggtcatgccccatggataagcccgtgggggtcatttcgtatccctgtggccatgttaggagtcgtaatgcacggtatcgtcacccagaatcgggattgttaacgatcatggtcgaccatggaagtaagcatttcaaagttgctttaagatatggagcaaaaaactcagtaaattcgttatcatcagtctagtgcaatcactgggaaatagagtctcactctgtcgcgcagctgtgactgcactgccacattaccgcctcactgcaacctccgcctgctgggctcaaacgattataaggccgcagcatcctgagtagctggtattacaggtgcattccaccgcagccggctaattgatagtatgtcagtagagtcgggtcgacaccatgttggccaggctggtcatggactcctgacctcaggtgatccacctgcagcagcctagcaaagtgctgggattcatcgcgtgggccgcagctgtcagccagtaaattttttacaagcacatgctagaggatacaagaaaggaatgtgccagaatcgtaatcactgaagctggatgatggatataatcaggagtctgtagcgatctctctactgttccaagtgccgaattcctgcag

SEQ ID NO: 715581 - DNA, 1197 bp, Homo sapiens
ctgtgcacgtgcctggcgcagcctgtttccctatgaacgtctttcgttgtttcatcgctgtgttttattttcgcgagcttgttccttcctttttggcctattgagccggtgttcaaaaacgcaggttgtcccggtccgatctccggggatttctggcgcaacccactctccctccccactcctcctggtcaccccccaccccccttgggatcccccgggcctcgcgccaccccttgccggggtgaaaggaggaatggaaaaggtgaagttctttgctttacggcctccgctgcccttttgcgcctgtgcaattgggacttgttggccctggggtttcggggcacacactttgtccctgagtccagaccactaaatcccaggggcttacacccggacttctctggtttgcccactgggtcatcataccccacttgggtggtcttcctcttccctgtgtggcttttttgggcttccttcggggccctccaaggagaagctaattgtctgtatgagtcaccctttgccacgtctgttctgtctcttaatcacatgttggtgtgaggtgtgcccccacgcccacttgtctcgcgctaatgttgtttttatgaagaatataaggctgaaatgttcacgaaggttttatatataaccacaactttccgcgccacgccacgaatgggaggaattttattcccgcgattaaccacaccccccccactcggcttcgagatcctcggacccacggaattgcacggcacgatttttaaagtgctcgttggggcgttgctaaactaccaccacgaattgggaggagaaaatgccctctccacatcgtcgagagaacccgcaggttccccgagactcctcgctgcacatctaaatgttaactgttgggctttgggaattaaatttccaccgcagaaggcgaatccacataaggagggctgtgttggagaagaattgtggggctggctgaggagaaaaatgtgctggtggtaggctgcacgcacgcccttggaattgcttttgtcgaggttttgggaattgtctttgcctgctgcctcgtgaagagtaatcacgaaagtggctaacgaaggtgaatgtaaggggtctggtctcctcacgcctcctcaatctgggggagtggaatagtatcctcccggtttttccattaaacggattattttttcagaccga

SEQ ID NO: 715582 - DNA, 540 bp, Homo sapiens
  misc_feature (10)..(10): n is a, c, g, or t
  misc_feature (28)..(28): n is a, c, g, or t
  misc_feature (36)..(36): n is a, c, g, or t
  misc_feature (91)..(91): n is a, c, g, or t
  misc_feature (175)..(175): n is a, c, g, or t
  misc_feature (497)..(497): n is a, c, g, or t
  misc_feature (530)..(530): n is a, c, g, or t
tccagacctngcggaattaggaccaggnacgaagtnagcctgattgtgtaagagcatctgcactcagaaacccatcatttggataagtgtnaggggtgtgtattggctgttttttcattttaattttttgtttttagagacagtctcactctgttgtcgaggctggagtgcagtngtgcagtcacggctcactgcaacctctgcctccaggttcaagcaatcctcccacctcagcctcccgagtagctgggactacaggtgcgcaccaccacgacctgctaatttttttatttttatagagacggggttttgccctgttgcacagactggtctcaaactcctggcgctcaagggattccgcctggccttcagccttcccaaagtggttagggttatgggatgttgaggccaccacacccaggcctggtttgttttctcatctggttgctgggtagggttgcagagattcccaggaaccccgtaggaatggttaaacntgcataggcaggttgaggcagttcatttttttnccgtgatttt

SEQ ID NO: 715583 - DNA, 226 bp, Homo sapiens
cattacatgtccaccagaaatcttcatgatctataaaacattaatatgtatatctattttactcatttaattgtgtttattttgtttttaaatcaatcaagtaatctaggactagcattatgtttgctagacctggcatttgctcggtacataaggttcaaagtttcctttccttttttttatttattttatattttgcactgtattttttccataccctgaagat

SEQ ID NO: 715584 - DNA, 179 bp, Homo sapiens
ggatctgaggtcatatatattaattagcctcatgatcaccatgttaaagtcagtatggagaaagatcattctgacctcttcagaaaccagctggtatatgaacattcttgatcacccagattgtgtttgaaaaccgtgattcttttcacccatcgtcccttaggctcacacaaataaaa

SEQ ID NO: 715585 - DNA, 172 bp, Homo sapiens
tgaggtgccgtattcccagtaacatctttgtgagaccagtgggtgagaaagacacctggtcaggaatgcggacacgggtcaactcaggctcgcccatggcgtcagactagaggcgaacaaggactctcgtgtataagccaatcctgaggcaaaagaaacattttaattcact

SEQ ID NO: 715586 - DNA, 384 bp, Homo sapiens
  misc_feature (29)..(29): n is a, c, g, or t
  misc_feature (35)..(36): n is a, c, g, or t
  misc_feature (56)..(56): n is a, c, g, or t
  misc_feature (70)..(70): n is a, c, g, or t
  misc_feature (81)..(81): n is a, c, g, or t
  misc_feature (84)..(84): n is a, c, g, or t
  misc_feature (87)..(87): n is a, c, g, or t
  misc_feature (94)..(94): n is a, c, g, or t
  misc_feature (96)..(96): n is a, c, g, or t
  misc_feature (108)..(108): n is a, c, g, or t
  misc_feature (119)..(119): n is a, c, g, or t
  misc_feature (125)..(125): n is a, c, g, or t
  misc_feature (129)..(129): n is a, c, g, or t
  misc_feature (138)..(138): n is a, c, g, or t
  misc_feature (154)..(154): n is a, c, g, or t
  misc_feature (156)..(156): n is a, c, g, or t
  misc_feature (163)..(164): n is a, c, g, or t
  misc_feature (166)..(166): n is a, c, g, or t
  misc_feature (168)..(168): n is a, c, g, or t
  misc_feature (173)..(173): n is a, c, g, or t
  misc_feature (184)..(184): n is a, c, g, or t
  misc_feature (189)..(189): n is a, c, g, or t
  misc_feature (192)..(192): n is a, c, g, or t
  misc_feature (194)..(194): n is a, c, g, or t
  misc_feature (199)..(199): n is a, c, g, or t
  misc_feature (202)..(202): n is a, c, g, or t
  misc_feature (209)..(209): n is a, c, g, or t
  misc_feature (215)..(215): n is a, c, g, or t
  misc_feature (217)..(217): n is a, c, g, or t
  misc_feature (221)..(221): n is a, c, g, or t
  misc_feature (223)..(223): n is a, c, g, or t
  misc_feature (225)..(225): n is a, c, g, or t
  misc_feature (230)..(234): n is a, c, g, or t
  misc_feature (236)..(236): n is a, c, g, or t
  misc_feature (242)..(242): n is a, c, g, or t
  misc_feature (245)..(245): n is a, c, g, or t
  misc_feature (248)..(248): n is a, c, g, or t
  misc_feature (259)..(259): n is a, c, g, or t
  misc_feature (280)..(280): n is a, c, g, or t
  misc_feature (288)..(288): n is a, c, g, or t
  misc_feature (296)..(297): n is a, c, g, or t
  misc_feature (303)..(303): n is a, c, g, or t
  misc_feature (305)..(305): n is a, c, g, or t
  misc_feature (334)..(335): n is a, c, g, or t
  misc_feature (343)..(343): n is a, c, g, or t
  misc_feature (347)..(347): n is a, c, g, or t
  misc_feature (363)..(363): n is a, c, g, or t
  misc_feature (370)..(370): n is a, c, g, or t
  misc_feature (373)..(373): n is a, c, g, or t
gaggacggacggcctagcccaggccaagnctgccnnttgccccggtggtgggagcngggagacccctgtncttggccgggncanggncgggggncncgcaggatgacnccccgcgaccnctggcncatncttgcctgncagtgtacagtatttncnccaaggnncncnccgancggcatgtatncccancancnggtgnccnctttgtncatgtntnggcnananaatannnnncngggganttnccnccttacccaanacctggcgagattagtaatgntcccatancatttaanncaaatntnatgggttacccagaccgccctggatggcnncgatatanccanaggcccccatatagtnatggagnccnatatgggtccc

SEQ ID NO: 715587 - DNA, 126 bp, Homo sapiens
  misc_feature (53)..(53): n is a, c, g, or t
  misc_feature (117)..(117): n is a, c, g, or t
ccttccactgccttgaactttcttcctttttattcctggtgccatctgtccangcagctagacaagaacttgttcaccagcagccggattcaggccttcccaggggcataataaggnaccaagccc

SEQ ID NO: 715588 - DNA, 447 bp, Homo sapiens
gatgttagctacaaagactagtaaatgtgcttcatattcaaacatgctgtatcgcaagcctatgtgatcaattaataaacgctatttacttgtgttccttacagtcgttgttaggtatttaaatggtaggtaatatgttagagtctagcaagtttaataaatcatgagatttcccatcgttatacccttttgtattcacctttcttggatcacacattttgagtgaactacgggtttttatttacagacatttgttgtattttatggttgtaactgcacatgcttttcaggatgagactgaaagaaggtagggcaaaaatggttgaatctattttcagatagtagttcattcttaagtgaagtgtcttgtctgcattatgcagcctggtatgtatccagtactaaataggtaggttaaatgtggtaattctagttcagtgtcttacc

SEQ ID NO: 715589 - DNA, 171 bp, Homo sapiens
gcgtgcgcaggggcttcgagtgcgcagaacacacggattgctagttgaatgcacacctgaggcttccccatctgctcacggttcctgcagaccaggccagagtccaggctgtgttccacgagcgtggccgcaactccctaggctcgactaaagcattctactagctcactc

SEQ ID NO: 715590 - DNA, 377 bp, Homo sapiens
gaaaagccgagaactgactttgcttactgtgagtggactgactctaattgaatctgcggggctttgatactttgatggatcccagcggaataaattcaggctgctgaaactataaaccctgagcccaggaagcgggctcttctttcttcaaaagaagcccttcttgttcatattcaggagctcatgttatattcaaaggaaattctacgtctataacagctatattgtttggtatcatagtgcattgaaaatcctcacctaaaatggagtcatgactgaagtatgtgcaatatttaacgggcatagagactaatctgcagttgtacttataagcttagaatgtatgttcattaccaaatgttgtgtcctaagagttt

SEQ ID NO: 715591 - DNA, 108 bp, Homo sapiens
tacaacgaggacgtcgtaagcgtgcagctgggtgtacagcgttaccatccgtatgtgcactggtgctccagcgtctgtgtgccactgggccccataccacgggagcca

SEQ ID NO: 715592 - DNA, 1035 bp, Homo sapiens
  misc_feature (101)..(101): n is a, c, g, or t
  misc_feature (132)..(132): n is a, c, g, or t
  misc_feature (142)..(142): n is a, c, g, or t
  misc_feature (144)..(144): n is a, c, g, or t
  misc_feature (168)..(168): n is a, c, g, or t
  misc_feature (176)..(176): n is a, c, g, or t
  misc_feature (223)..(223): n is a, c, g, or t
  misc_feature (250)..(250): n is a, c, g, or t
  misc_feature (525)..(525): n is a, c, g, or t
  misc_feature (539)..(539): n is a, c, g, or t
  misc_feature (559)..(559): n is a, c, g, or t
  misc_feature (573)..(573): n is a, c, g, or t
  misc_feature (581)..(581): n is a, c, g, or t
ggagcgcgggaaaagggaagcgaagccggagctgcgggcgctttttctgcccgcggtgtctcagattcattcttaaggaactgagaacttaatcttccaanatgtcaaaaagaccatcttatgccccacctnccaccccagntnctgcaacacaaatgcccagcacancagggttngtgggatacaatccatacagtcatctcgcctacaacaactacaggtngtgggagggaacccgggcaccaacagncgggtcactggtatcctctgtgtcatcacagatgcctaaaaacccccaaaagtccaccacgataagccgctgcatagcacctacaatagagtgatacgagccagacatacggtctggtgaccaaagttactaggcttgccaaccctgacctataggttggtaggggatgattgcgcaagcattattggtaggcattgtgacgagatctcacgtgatgatgaccagcatagaatactaataaatcgaatacgatggcatacataagatagagtacnatgaatctatgaanggctatcataattcccccgngtaccttgcttacntaaatgcnaaaagtcgtgcagaagctgctttagaggaagaaagtcgacagagacaatctcgcatggagaacggagaaccgtacatgagcattcagcctgctgaagatccagatgattatgatgatggcttttcaatgaagcatacagccaccgccgttccaaggagaaaaaccagcgctcatcagtgaaattcttagtgagagtgtggtgccagacgttcggtccagtgtcaccaacagtaaaatgcagtctcaaacggcagtccaggccttatggttcatcaggaaatagaagtgacttttcaatgcagaacgccccgggaagaaaagaatcctggagccatcttaacatacttcacgttcggcggaacaatgttggcaatgtatgagcagaaagcccacagggaaggaaaggcaaggcacaaacttcagaaatagggaagaactgagggtacaaacggtg

SEQ ID NO: 715593 - DNA, 336 bp, Homo sapiens
  misc_feature (33)..(34): n is a, c, g, or t
  misc_feature (80)..(80): n is a, c, g, or t
  misc_feature (98)..(98): n is a, c, g, or t
  misc_feature (103)..(104): n is a, c, g, or t
  misc_feature (201)..(201): n is a, c, g, or t
  misc_feature (233)..(233): n is a, c, g, or t
cgactctagagatctctatcgccaacacttggnnagcaaggtgaggatcactgaggccaggcatttgagaccagcctggnaacataggagaccctatncctannaaaatttttttttaattagctaggcatggtggtgcgcacatatggtcccagctactcaggaggctgagatgtaaggattgcttgaacccaagaagtngaggttggactgagccatgattgtgccactgngctccagcctgggagacaaagtgagatcctgtcaaaaaaaataaaaaattttaaaaaaggaacatctactatgtgctaattgtgcgtgttggggataacatca

SEQ ID NO: 715594 - DNA, 1338 bp, Homo sapiens
ggcgatgaggactaatgtgcggacgccgggaggcttcgtgcgcgttgctacaggtccgggcgtcgggtccacagcgttcgcagaggccgtcacaagtggcttgggaaagcggatgagcacgcggctcctattcccaggtagccccgatgctgctgtcgcccactagtagctcttccttgtcggccttccggtaccctcgtcaggcctcaagtacctctggctactctgcgttttgcgagaagtcgcaggttcacggcctcctcctgtttgttgctgcagacgtccctgcacgcactagcatggcgagtgaccctgagggtagagcgtatctgggaggagtacgtgcatggatagtaagtctcgaagacgatggcgggcaaggaggccagaagcgcttatcggcatagagacgtgtggaggcgtgaggtgtctatgacaacccccaagcgtcggcgacctagatccaaggaaatttggacgttggcgcatagtgtgtaccctggacgatatgatcaggaacttcgcgtgggggcgcgtaaccccttgtgggattgagtgcggcgcgccccacatgtggccttgcgagttgctagcatcgatcctatagggcaccccggcatgggcgcgattgtgattgttcttgcccctccattcaagtccggttgaaccgggggcacaacggtcgaacggacggggtcaacgtctgcgaaggggattcccaaaccgaacatgcaagccttttgtccccagtggacgtaactccaaggaacagggtgttaatcgcaacgattcggaaactttcaaggacaagaacaggtgcgccaccagggtgtataagggccacggggaaatggaagcccaaagttcagttggagaacgggatatgttattagaggcagaagagggccataatgccgcgttccacggggaacggcaacttggcgggcggagcttattggtacaccaccgacggaaagaggacaaagaggaaccgaatttggagcattctaatttaaaagaaccattcccgattaaatgtaaacaacaaatcgccctttcccattcacaaagttttaccgttcgcacccactgggagtggaaacacatcaaacggggaacacccccactaaaaaatcactctttcaaagtgtccctccaccatgtatcagtttacacttgtggacaattgaggggcaacgtcacaggaaacggataactgggtgacgaccaaaaagacacacttgtaccctttggtatggcacacagcgaaaggatacgcacctggtctagagaaacaccaacggcggctggagcccccatctcctgtggggatgtggt

SEQ ID NO: 715595 - DNA, 161 bp, Homo sapiens
tctttgacacaggttttcactcctacgccccggatggcgagcacggggtatggctcactggcagccttggccgccggggacactccaggtgtgcacggcggctagttttggtgcttttggtaaagtttggctatgtttacccaggctactcttgaactccg

SEQ ID NO: 715596 - DNA, 790 bp, Homo sapiens
  misc_feature (586)..(586): n is a, c, g, or t
  misc_feature (707)..(707): n is a, c, g, or t
  misc_feature (711)..(711): n is a, c, g, or t
cccgaaatcggacattatggccggggaaagcgtgaggcaaacaggagatgtggaacaagggaaatgaataagtgagcgtgtttcgcgaagattaagtgtatcttgtatgtagtaattttataagtgatattaaaagagagtgaagaacgccccgcacccaccaaaacgactcacgcctggatcaggaggggtagcaggtgcggccctgtaggggtggcagtatgttcattcgtttgtgaggggtcacgtttatactactgtgtgggtttcggttcaggcgcccatgttattgcttggtatttatttcggttttggtgtgtggttcgtgccagtacagaggccctgacgcggtgaggcagttgaggcagggcgtgcgggagggaggaatgtatgcgtagtccaaagcgtgggatttatggccagtacatgtaggtatcgtgcggggtagtccgctccgtgtgcccggtatcggcgctcggtccgactgctctgtgtgcacgcggcgtgcctccgcggctctcggtgcagcctccgttttcgccgcctcgtcgccggcccccgctcaccccctccacgcttactcccnctgacatcacgagagtacactcggtctgctgccgctggtcgtatacacgccggattatattagttaatagtggtccgatacgtcttatttcttagtcttcccgtgttcgatgctgtctcgngcgntcccacggcagatgtacgcagcaggcgacgttgcagacagagcatacacactcctcacatccacaatgctacatatcct

SEQ ID NO: 715597 - DNA, 1044 bp, Homo sapiens
  misc_feature (101)..(101): n is a, c, g, or t
  misc_feature (132)..(132): n is a, c, g, or t
  misc_feature (142)..(142): n is a, c, g, or t
  misc_feature (144)..(144): n is a, c, g, or t
  misc_feature (168)..(168): n is a, c, g, or t
  misc_feature (176)..(176): n is a, c, g, or t
  misc_feature (223)..(223): n is a, c, g, or t
  misc_feature (250)..(250): n is a, c, g, or t
  misc_feature (316)..(316): n is a, c, g, or t
  misc_feature (340)..(340): n is a, c, g, or t
  misc_feature (534)..(534): n is a, c, g, or t
  misc_feature (548)..(548): n is a, c, g, or t
  misc_feature (568)..(568): n is a, c, g, or t
  misc_feature (582)..(582): n is a, c, g, or t
  misc_feature (590)..(590): n is a, c, g, or t
ggagcgcgggaaaagggaagcgaagccggagctgcgggcgctttttctgcccgcggtgtctcagattcattcttaaggaactgagaacttaatcttccaanatgtcaaaaagaccatcttatgccccacctnccaccccagntnctgcaacacaaatgcccagcacancagggttngtgggatacaatccatacagtcatctcgcctacaacaactacaggtngtgggagggaacccgggcaccaacagncgggtctacgggcgatcgctctggatatccaccgattctcaatagaacgctcccaaagactcgatnctagataaagccgctgagtgcccnatacagtgatggctacagccacgcaaaggtcttgggcaccctaagataagagcgattcctaatcctgtacctaatagcttgtggggagattgggacatgattaattggatggcatgtggcgagatgctcaattgatgaagaaagaacgagagaattatttaaacgagatatgaagcagaaaaggatagagtacnatgaatctatgaanggctatcataattcccccgngtaccttgcttacntaaatgcnaaaagtcgtgcagaagctgctttagaggaagaaagtcgacagagacaatctcgcatggagaacggagaaccgtacatgagcattcagcctgctgaagatccagatgattatgatgatggcttttcaatgaagcatacagccaccgccgttccaaggagaaaaaccagcgctcatcagtgaaattcttagtgagagtgtggtgccagacgttcggtccagtgtcaccaacagtaaaatgcagtctcaaacggcagtccaggccttatggttcatcaggaaatagaagtgacttttcaatgcagaacgccccgggaagaaaagaatcctggagccatcttaacatacttcacgttcggcggaacaatgttggcaatgtatgagcagaaagcccacagggaaggaaaggcaaggcacaaacttcagaaatagggaagaactgagggtacaaacggtg

SEQ ID NO: 715598 - DNA, 342 bp, Homo sapiens
ctgtacaatagtttttggttttttttttaaatacagatggggtctcccactcttgaccaggctggtctcgaattcctggcctcaagtgatcctcccatctcacgcctgtaatcccagctctttgggaggccgaggcaggcagatcacgaggtcaggagatcgagaccatcgtggctaatacagtgaaaccccgtctctactaaaaatgcaaaaaaaattagccgggcatggtggtgggcgcctgtagtcccagctacttgggaggctgaggcaggagaatggcatgaattcgggaggcggagcttgcagtgagccaagatcacgccactgtactccagcctg

SEQ ID NO: 715599 - DNA, 367 bp, Homo sapiens
acccttggaccagttggcacagcatgcacttctccccctttgaggcccataaaagccccaggctcagccagagctgggcaaatgttgggatgaccacctgcagacaggagcaacccactctagggccccctctttgctgaaagctgcagagatgatggaaagatgacagggagatgatgggacgaccagctgcagagaggagctaccctctctactgatagctgaacacttgttgggacgacttgcctaaccctttctgctaggagctgaacagacgttgggacaccctggctgcagaaaggagctgcccccctgtgggtttcctcagagctgttctgtccctcaataaagctcctcttcatctggc

SEQ ID NO: 715600 - DNA, 648 bp, Homo sapiens
ggtgtcttcagatttgggggtctggaggtcctcacaattgctctacagctcagagcagcaactgctgaggctgccttgggaagaggatgatcctaaacaaagctctgctgctgggggcccttgccctgaccaccgtgatgagcccctgtggaggtgaagacattgtggctgaccatgttgcctcttatggtgtaaacttgtaccagtcttacggtccctctggccagttcacccatgaatttgatggagacgagcagttctacgtggacctggggaggaaggagactgtctggtgtttgcctgttctcagacaatttagatttgacccgcaatttgcactgacaaacatggctgtgacataacacaacttgaacatcctgattaaacgctccaactctaccgctgctaccaatgaggttcctgagggcacagtgttttccaagtcctccgtgatgctgggtgagcccaacaccctcatctgtctttgtggacaacattttcttctcctgtggccaacatcacatgagctgagcaatgagcactcagtcacagaaggagttactgagaccagctttcttcttcaagagtgaccattccttcttcaagaacaggtaccctaccttcctccctttttggtgatgagaatta

SEQ ID NO: 715601 - DNA, 805 bp, Homo sapiens
ccacatggtgacaatgcatgatgtgcttgacgctcagtggctgtatgataaccacaaggatgagagttacctgcggcgagctccgtttaccctttggaaaagctgttgacatctcataaacgggtggttatgaaagcatcagggcagtaaatgccatctgctatggggccaagattatgcttccacgtgtgtacttcgatatgacgacggccttgaggtcaatcaggagattgtggttatcaccaccaaaggagactcgatctgcatggctattgctattaatgaccacagcggtcagtctctacctgcgagcgatggtatagtagccaaggatcaagagagtgatccatggagagagaaaagttaccctcggaaggtggggttgaggtccaaaggccaaggtcaaacagaagctggtgatcatagcgagggacttctggacaaacatggtaagcccacagacagaacacgctgccacctggaagacaggagatactgttgacgtacagtggagtctagcaaaaaagaggtggttgctagaaagtgggtaaaagccccgacaggtagttggcgaaggctagaaaaactgtgaagcggaagcgagacagagtgagagtgaaatgtgacgatgactcctccagctagcgtcctcagggcgatcaaggaaggaagaagaagaagagtacgagaggacaagaagggcaaagactggtctgagaaaagcgggggccgaagccgtgatagatgggcgacaggtgtataccaagcaaaggaaggaaaggaagcacgaagaagagaagccaaa

SEQ ID NO: 715602 - DNA, 1130 bp, Homo sapiens
gcctgtaaacttcctaacgtaaccaacaacctcaaaacaaatcatattcatacaaaacataacaaaaacaataacaaacacaacaacataccataaacataaaaaacacataacacataacacccataactacatattacaaagaaaaacaaaataataacaatatacacaatacatataaatattcaacacctataatacataacatcaaacaccatacacaaacaacatcaaataaccataaataatcaaccaatcaaacaaacaaaacaactaaatatatcaatacattctaacaatacacaatcataaaaacacacataaatccactcaaacaacataacataatcaacaacccacactaaacacaatacaccacatacacaaaacactaccaataaatcaccacataataaaattagaattacatacatctaatatacatactataaaactaatataacacataaaactaatatcaaacacatctataacacacaaattcccataacaccattcactatcatcacactattacaccaaccacacaatatcagatcaatacaaaaccacattacacataaactaataaatataatatcaattacaactcaccaccacaatgcaaatccaataatacacaacatcatcacacacacatcacatcaacaaacacaacatacaccatcaactacaccacaaactacaaacaacaaatacccactgattcaaactacaatccacaaacaacaaatcaatctaataataaacaccacatcacctcactcaacacattacaactaacaaatcactacactaacaccttcgacaattatacaaatacacaacacactcatactacgaaataacataaacatattacacacatcaaacacacaaaatataaccaatatccacagtatatctaaacaatataccactcatatatatccaccatctacaacaccaaacactaacaacaatataacacatacctatcataccataccacatatcatatcacatatcaatcaatataaacacataaaagtatactcactttactaaacacttaaccaatacatatacaacctccacaacacactcaactcctacaaattcaaataaag

SEQ ID NO: 715603 - DNA, 280 bp, Homo sapiens
  misc_feature (227)..(227): n is a, c, g, or t
  misc_feature (255)..(255): n is a, c, g, or t
ctttcccttttaaactctagatcagaattgttggcttgccttcagaacataaatgcccaaaatttggacatgtttcccctcagaaaaattcattggcaggcccccaggggattttcctccttcttcctgtaaagggccccaataaaaaccaaattatggggctgcttttgtccccctagcatagagaatgggttgaaatttaactttgtaagcttggatgggggtgntgatcttttttttccttccagccccccntaataaaatatcatattaaaattca

SEQ ID NO: 715604 - DNA, 131 bp, Homo sapiens
ccttttttcccggggggccccccccctttgggggcccccgggtttttttttcccccccccccccccccccccctgggtttttttttggttttgtgggggggggggggattaaaaaaggggttttttgccca

SEQ ID NO: 715605 - DNA, 394 bp, Homo sapiens
  misc_feature (331)..(331): n is a, c, g, or t
  misc_feature (387)..(387): n is a, c, g, or t
ccaggtatcatggcaaaacaaccccatctctacaaaaaatacaaaaaacaaccgggcatggtggcatgtgctgtagtctcagctactcaggaggctgaggtgaaaggatctcttgagcccaggaggctgaggatgcagtgagccaagatcaggctaccgcactccagccaaagtggcagagcaaggatcctgtctcaaaacaacaacaacaaaaaccctcattgtgatgtaggagtaagtaaggaagcttcatccgctggacctctttcactttgagggttctccctgttaggagttaagcagccttgacagcttctttgaaacaggttantagagagcattttttttaggcaccaccacaaaaacatttgggattgcaaagcagcnttttagg

SEQ ID NO: 715606 - DNA, 236 bp, Homo sapiens
ctgaccgatgccttctgtagacctctgagtcttcgcgggaggtcatgtgcaatccaggccccttgtccgtggaaaacactggtcccttctcactcagaaggagatgctctgaattgttcctttggattgagtccttcacccggtagctggaagttcttgcaaaagtctagcctaaatctttcattatcaaaagcttcacttttgcaagtacacatccgtcgcacactccgtcctgg

SEQ ID NO: 715607 - DNA, 417 bp, Homo sapiens
  misc_feature (188)..(188): n is a, c, g, or t
  misc_feature (370)..(370): n is a, c, g, or t
tgcgcccaagagagctgggcccctcgtggcacggaggccacagttgaattctcctgtcaggcggctgtctcgctgtgggttcatcaggccaaagccttggaagtccccaggggcaaagtgggtcgcagatcaggtggcgtgtgtacgcagagctggcgcactgctgggtgatgcccatacagaagggngccaggcagccgtctgggttgctggcactcaggtggaagtggtggggccggcagtggctgcaagtgaggccttccacctaggccttgcactggcactgaccagcagcatcacactggctgctgacgctgccttgggggtcacagttgcagcctatgggccctggcaccttgctgtctctctngcatggctcgcccttgctggggttggcatagtaacctggggcgcatt

SEQ ID NO: 715608 - DNA, 595 bp, Homo sapiens
ctgattttgttaaaagatatcagaagtgtccttggagccaactagaggcacgggtcatccttgcccttgtcctccccttgtcatccctatgtggaaaacgtaggtggtaaggtgggagaaatcatcagaaatttggaaatcaaaggacagaattgggaagaacaagtgaatatgtctgtctgaatgttttcaagaaatagctggattgtagttagcgaaggctttcatcagattgaccatgacctgtgtgattggcgatatgtataatgactactacgttcgtggatgacgcttgtcatgtgtactctaaaccagtataatgacgtggaggtcgaagtcttcagagatccgcacagctccgggatgtgcccttgggaagagggtctgtgttcacaattacgtggacggggaggacccttgggggaccgccattctaaatatcatgtaggaagtgtataaagccaaaatgctaattatgtctttgtggtgtgataaaggaatgtagtgaaagagacatgaacccaaatcttgtggaattcatcaactctttactcagagcctctctccaatgcaggtcacactccaatgatgatgc

SEQ ID NO: 715609 - DNA, 446 bp, Homo sapiens
  misc_feature (5)..(5): n is a, c, g, or t
  misc_feature (34)..(34): n is a, c, g, or t
  misc_feature (126)..(126): n is a, c, g, or t
  misc_feature (190)..(190): n is a, c, g, or t
  misc_feature (197)..(197): n is a, c, g, or t
  misc_feature (252)..(252): n is a, c, g, or t
  misc_feature (269)..(269): n is a, c, g, or t
  misc_feature (316)..(316): n is a, c, g, or t
  misc_feature (342)..(342): n is a, c, g, or t
  misc_feature (362)..(362): n is a, c, g, or t
gaaancaatgacgcaaatctcggctcactgcaanttctgccctccctgggttcaaacgattctccctgcctcagcctcctgaagtagctggaattaacaggcatgtgcccaccatgcccagctaanttttgtattttagtagagacagggttcaccatgttggccaggctggtcttgaactcctgacctnaggtganccgcctgccttggcctccccaagtgctaggatttcaggcatgagccactgtgccnggcagagccaccgcgcncagcctcaatttctttctatttccttttttgagacggggtctagctntgttgcccaggctggagtgcagtggnacaatctcggctcactgcanccccccacttccacattggagtgattctcctacaggcatgcaccaccacacccaataaagcgaatggaccatcaaaaaaaaaaa

SEQ ID NO: 715610 - DNA, 575 bp, Homo sapiens
cagggacggacgagtcctcacaggtaatacaaaccaggttatgtcagtagtcactaaagtagtctttttccgggcggtcgagccacagaagccttcccaagttcagggtccgacctctaacggcaggccaagggatccagttttccaaaatcctcctcccaccctccttatacatataaaaaaaatcttagtccatcaaaaccggcctacccctcagatcctcccacatagaggaccttcctcacatagaggaccaacacagatgcgggggggtctggaagaaaagaaccagccacccaatatttggcggaaaggtggttctattcgggaaggaaattggagatgagataatccaccttcaaagtcaaaagtaagggggaggggaggaagaagatagaattggtctgaagaaaggggagggcccttaacagaaacgatgatatatgggggaggtggggggcgcttgcttctcagatacttactctgaagcatttctaagtgggtgaggcagatttttactaactaagattttttccttaacggagactgggagaaagattcagaaaacgagatca

SEQ ID NO: 715611 - DNA, 1354 bp, Homo sapiens
ggtctagtccacgctcggagccatgccggtccatggggcccgctgccaagtctgtggcaggtcttcggacgctcacgaccgacgaagcgacagggtgtggcagcactgtgaccaagcgggcgaatgcgtcatccagtccaacggctgaactgggtggggtccctgggcacggatgagttgacgccgtgtcacgcgtacaagttctacaagcgtgcatggagcctgagtttctgcgtgttcatcgagttctaggtagcgtagtttggcttggttgatcgtacattccagtgtccgctgataacaagaggtggatgtgctctaacggctgggtccgcgagtgaatttgaatgactacttccgttcagtgccatttctccacaaggcccgttggctggcaccgtagttaaccacgtaacatatgctgggaatgacgcgcttcctcaagaaggagcactgccaaagagccatcctcatcgccagtactgacctcgggagcctagtctcggctaagccttgaattcatccgtccgatggtgagtccaaaagaagttagagagggagtcctaggtgccacagcagctctgcgtaccgagataatcgcctaccttgataaggctcacattcggtgacttctaggaatcttcactgtgtatattagttaaaccctatgtctctctgggaccggggaattgttccaaaagagttctttcccaaaggaaggatctccccacaactaggaactctcggagggactagtgccacactggggtcgggttagttggcaggagacataaacacacgttgcgattaattgcataccatcttgcgacaactttgtggccaaaattagacgttgctcttcccatgtgtaggaccacagtaaatgtttcctattcgccacacccaaaacgcggctggtggtgcacaaaaacaatacccggaggtgaggggcgcaaagtcccacgacaatcaaaaagttagagacggcacgcgactcatcataacattttaggcgaggaagataacaagccaccgggggtgttataacaccacgtgcggcgagttaagacaatagacatgtggggccgaagaaaacacacaacggccgtgggagccacagcgtcaaacgcagcccattaacactagggaggggttgggtatcgagaccaacacaaagcaattaggatgagtagataagcccggtaacagagccagccgatccacagttatctgagtgcgcacacggaagaccagcaaaagacagaggggaagcaaaccaacccccagcggagaccttgggacgatggaaagcaatggagcccgcacacccagtaaacgtccaaacaaccaatgg

SEQ ID NO: 715612 - DNA, 380 bp, Homo sapiens
ttctagaggccgagatgggaagatttcttactcctgggaagttaagtctgcagttcagttgagatcctgccactacactttagcctggttgacaaaaacaaacactcaagcagttcttctccattagcctcctgagttagctgggattacaggcacatgccaccacacctaattttttatattattagtggaaacagggtttcaccatgttagccaagctggtcttaaactcctgacctcaggtgatctgcctgtcttgccataccaatgtgcttgaactaccgtgcctggcctgctttctattctttaattgtacttaacatttgatagtcaatcaaggttgaatacacctgttacccagctaacttatggggttggcg

SEQ ID NO: 715613 - DNA, 388 bp, Homo sapiens
tggatcctctatcaacccataagactacacctagacataacagtaaaaatagtgttatgattgtgcttactatagttccttttataggataagctgaagatggcggtatataggctagaataggcaagggttggtaaggtctatcggggtatatcgattatagaacaggctcctctaggtggatgtgaagcaccgccaagtgcctggaccctctctagctgtggtgggacagccacgtactcgtttccacaccaagactcagactttttgagccaaaaaagccacattcttacactatccagcttgttatggttaatgtaaaacttaccagatgaaccttgtgtatcagcttttttctcttccccctccccttgagagagggtccagg

SEQ ID NO: 715614 - DNA, 501 bp, Homo sapiens
  misc_feature (29)..(29): n is a, c, g, or t
  misc_feature (267)..(267): n is a, c, g, or t
ccaaaggggaagttgctgaaagccatcanacgtgactttggttcctttgacaagtttaagaagaagctgccggctcatctgttgggttccaaggctcaggttggggtttgcttggtttcaataaggaacggggacacttacaaattgctgcttgtccaaatcaggatccactgcaaggaacaacaggccttattccactgctggggattgaatgtgtgggagcacgcttactaccttcagtataaaaatgtcaggcctgattatctnaaactatttggaatgtaacaactggagaagtaactgaaagatacatgctgcaaaaagtaaccacgacgttatgtgagtatttaagctctttatactgtttttgtagtgtaagagacgcagaaccagaagtgctcccctcagcatttttgatgtgcttagcactatttcaaacaacttaatgttctgatatttctactaacatttgttattggcagtgatgaaagtaaagctgtg

SEQ ID NO: 715615 - DNA, 178 bp, Homo sapiens
acatagcaagcgaggcaggcataatgccgcatgttccaggtttctgcagtcagcagcaaatgcatcctgtcaatcatcaggacctcgccctgcatgttgtcaggaccagcagtgccagcatcaacagcacatcattgcaggctgcccattggctgatgcacaggtcagctggcatgca

SEQ ID NO: 715616 - DNA, 107 bp, Homo sapiens
ctagaggatcctaatatgctcacgctctagtcagtcctctggacctggactccctgcagaaagacagcttgacccccaagctcagaaatgggacgggaggagcggtg

SEQ ID NO: 715617 - DNA, 423 bp, Homo sapiens
atccccggcaaggatcctgtaggctaataaaatattattcaaaaaaggaagtgaaagcataatgcattgcttggcttggcactggacataaatcaaagctatataacaaacactgaataccaattttgataaaatacataatttacttatactggagtaatgtaggaaagaaaatggagaggctgtatggtcatcattagggctgttcaccaatattccagagcatcttttcccaggcacatggtagggttgtacttccaggcctcttttcagattaagtatagtcatgtagcttgctttgacccataaaatgtgagttcaatttatttttttcataccagggcagaagacagtgggtgtagccatttatacatgccatgttagacccagctctagcatacgtgaagccttcctctacttttc

SEQ ID NO: 715618 - DNA, 199 bp, Homo sapiens
ccccgggccccggggggggcccccttttaattttttgcccagcataaaaattttttccccttcaatctcggaaaggttttataaaaagggggtttttgaattaaaaattttgggggccccttttttgggggggggggttttaaaaaggaaaaaaaaagtaaaagggggaattttttttaaaaaaatctttccccctcta

SEQ ID NO: 715619 - DNA, 290 bp, Homo sapiens
tgtgtcagactacatgtagtgtggacaggatgtacatcgagtcatggcagccaaggatactgcaggagctccttgtgggggtcagtatggggaggtcatgcctgtgtaccgggcgggacagccactgagacgtgcaggctgggggccatgactagcctggtgagggcatctacctgctcaagttcgagaattcctactccctgctgcgcaagaagactctctactgccacatctactacaccagctgaaggactgcgtggcacaggggcaggctgtcgggctagtcgggg

SEQ ID NO: 715620 - DNA, 137 bp, Homo sapiens
  misc_feature (31)..(31): n is a, c, g, or t
  misc_feature (68)..(68): n is a, c, g, or t
  misc_feature (83)..(83): n is a, c, g, or t
  misc_feature (110)..(110): n is a, c, g, or t
ggcgggggaatagcaaatacacaacccctcnaactaatttattttaaaaattaaaccaccaaataaancaattttattattanttatacaaccaaaacaaaccaaatcanaattaaaaaacattttcctaataataa

SEQ ID NO: 715621 - DNA, 128 bp, Homo sapiens
  misc_feature (9)..(9): n is a, c, g, or t
gtccggcgngggggcagcagtccgtgctgggcaaattggctcaggccggggcacggcagctaaggttcttggcgcagttgttcgatgcgcgcatccttttccatccagagctgagaacgacccaccga

SEQ ID NO: 715622 - DNA, 884 bp, Homo sapiens
gatggccgagcccgacgctatgtccagcaaaggctccgatggtgctggcctacagtggcggcctggagacctcgtgcaatcctcggtgtggctgaaggaacaaggctatgacgtcattgcctatctggccaatcgattgcgcccagcaaggaacgacttcggagggaagccaggaagaaggcactgcagcttggggcccacaaaggtgttcatctgaggattgtcaagccgagggtagtttgtggacggagttcagtctggccggccatgccagctcgcagcgcatctgtatgacgtgaccccgcttacctcctggtgcaaccttcctcatcgccagaggcccttgtgactctgctccgcaaagaccatagggtggaacattcgtctccaggcggagcgcatggggcggccacaagttaatgtgctcacccacgggacgcacacagggaccattggggaatcgactcacgcgctccggctttgagctcagctgtcttacttcacgtggaccccccccagatcaacgggtcctttgcatccccttggatgagatgccctgaatttcttacaaccgcgtgccattgtgcccgtgactgacctcgcactggacgtcacgcacacaggcaacggacgggactaccccatccgcgtgtccatgttcccaagaagaccgtggaagggtctggattgatggactcgtcctatgcccatctacttacatacgggtgggatatccctggaaaacgccaaaggaagcaaagcgcctccagggtctctacacggaatgagccaggacccagccataggctcgcaataccctgtactttccgagaccgcgtccaccacggtcgcctgggatgtgccaccctatgtgtggcccatcc

SEQ ID NO: 715623 - DNA, 961 bp, Homo sapiens
gtatatttgtatattgcatgtgacaaatacttattcccagtgtgtttaaaaatactttctaagggggggccctgtgatggaggaaacaggccgctcgcacatctactcttcccaatagtgtgtccaggtcgttctccaagactctgggggtccctcacgggttctgatgcacagctgtataagtgaccgattgagtctgaggaacagcggatggggacgggatgcgcaaggaggcctaggagcctccaggggctggcgcagctacacagacataggtcggaaaaagacgtgcccaaggcggagtagccacgccccgagagcacggggggtgtatcggtgccccaccacagttctctgttagcgaggagtcctaatacagacatgtgttctgtgggttcatctctgctggtgtggagctcttaaaaaattgcctgcaaggcgggatccccgctgtacactcaagagcacagtaatggctgagaagggggattatcctggcacggagtgactgggtgagaggtgcgtgtgccacgaggtccctcagaaaaccgagaatttctccaaggggccactcttaagtgtactgcgggtgtggcgggcaaggaaaaagaagcgttacagtgcacagcggtgggcccagtggggtaccacttagagcgtgttgttcccgtgaaacacccaagttttctctgtgtttcaccaagagtgtgggttcaagcacttcgtggcggcggcggcatcctccccctatagtgagcgtgcgagtgcccggataaatagaaaaatcttgcggaaataaaagcgcgagcgcgtataaaccccgtggccagcttaaaggaaacgacggggggcaacaaaaacccgggaagagacacacgaaacgacgaagaaggcagggaatcggcgaatgggagacgggcgacaagaggcagaagggaagacatcacacgaaaatagccag

SEQ ID NO: 715624 - DNA, 832 bp, Homo sapiens
  misc_feature (57)..(57): n is a, c, g, or t
  misc_feature (69)..(69): n is a, c, g, or t
  misc_feature (71)..(71): n is a, c, g, or t
  misc_feature (81)..(83): n is a, c, g, or t
  misc_feature (88)..(88): n is a, c, g, or t
  misc_feature (132)..(132): n is a, c, g, or t
  misc_feature (174)..(174): n is a, c, g, or t
  misc_feature (178)..(178): n is a, c, g, or t
  misc_feature (204)..(204): n is a, c, g, or t
  misc_feature (212)..(212): n is a, c, g, or t
  misc_feature (214)..(214): n is a, c, g, or t
  misc_feature (223)..(223): n is a, c, g, or t
  misc_feature (234)..(234): n is a, c, g, or t
  misc_feature (246)..(247): n is a, c, g, or t
  misc_feature (267)..(267): n is a, c, g, or t
  misc_feature (274)..(274): n is a, c, g, or t
  misc_feature (313)..(313): n is a, c, g, or t
  misc_feature (329)..(329): n is a, c, g, or t
  misc_feature (347)..(347): n is a, c, g, or t
  misc_feature (357)..(357): n is a, c, g, or t
  misc_feature (364)..(364): n is a, c, g, or t
  misc_feature (381)..(381): n is a, c, g, or t
  misc_feature (396)..(396): n is a, c, g, or t
  misc_feature (417)..(417): n is a, c, g, or t
  misc_feature (831)..(831): n is a, c, g, or t
tagtcgagggtaaccgagtgagcacgccagggagcaggagaccaaacgacgggggtnggagtaagagtngnagtgggagtnnncggancggagcacgagcctgagcgggagagcgccgctcgcacgcccgtngccacccgcgtacccggcgcagcagagcaaccagcgcaggcntgcnatggagcccagcagcaagaagctgangggtcgcntnatgctggcngtgggaggagnagtgcttggatnnctgaagtttggataaaaaantggagtnatcaatgccccccagaaggtgattgaggagttctacaanaagaaatgggtccacngctatggggagagcatcntgcccaaaangctcacnacgctctggtccctctnagtggcaatcttttntgttgggggaatgattggctnattttttgtgggcttttttgttaattgttttggaaggaggaattaaatgctgatgatgaacatgatggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgcgtgagcatcatcttcatcccggccctgctgcagtgcatcgtgctgcccttctgccccgagagtcccgcttcctgtcatcaaccgna

SEQ ID NO: 715625 - DNA, 149 bp, Homo sapiens
gaagcacagaggagggaggagggaaccagctactagatggttcgattagtctttcgctcaggatagctggcgctctcgcagacccgacgcacccccgccctcctctgtgctagtccacccccgtgtcctgtccacctcctctgtgctgt

SEQ ID NO: 715626 - DNA, 106 bp, Homo sapiens
cactaattaagagatgttcctcagcaggcataagtgaaagggtctctctgggagaatagtcaagctacttaagtcgataaatacaaggggccaaaacttaggagga

SEQ ID NO: 715627 - DNA, 831 bp, Homo sapiens
  misc_feature (86)..(86): n is a, c, g, or t
ggtcgaatcatcctctgaacatgctctcaataaggaagcactgatcaagaagatctggatggagcacccgatgatgcccctataangagtcgctgttggaaactagtggatcgctagcaagtgagatgatgatggtcgacatggaacctggggatccaaaccagatgtacacactcggtgcggagtccactggaaactcctatggtatgtgcttgggtgaccatttcatcgtctagaccgtagtagaagggatataattatccacgtcatcgacgatgtctgagacaccgggaatgatgagggtggagcacacatacgagtgccggccccatagaatgtacgcggcgttgcgatacgtttgacagtggacaccaatcggagtcttagcatcggcaggcaaggactgccgaaaggaaggtacccattgcacctcgatacataccccaataaagttctgccatgccagtgagccagtaagacggtactccaaaaagcaaaagtcacgcggtgtaaatcgtgggtagaacgcttcctgattctcgcacaggtgcgaacgtgggactagatcagacctgaattactgggtacccccggaaggcccgtggacgagataagacgcataggaacgaaggtgctagcgcattccaaatgtagtaaaccatgacctgacaagacgtcacatctaaactaattggcacacacaattcattaggctcggttccagacggtccaatggtccttcttacacaaactcaatcggcaccaattaacactttgtgcgcgaagagaggtgaggtctcgtgaatccggctggtgatagaaatgacttgg

SEQ ID NO: 715628 - DNA, 176 bp, Homo sapiens
  misc_feature (48)..(48): n is a, c, g, or t
  misc_feature (144)..(144): n is a, c, g, or t
aaatgtccattgctgtattgcgtgaccgtggtccttgcctgtcaaatncaacaatgaccaaatgatgatgcgcccttaataccaggatgagaccaaacctacacatctcccaagtgccgaacaaaaacctgaacaaaaaccatntgcaccctacatctggctgacatttacatttt

SEQ ID NO: 715629 - DNA, 253 bp, Homo sapiens
tggggagcaataaagctgtttatttcacatgggtgcaggtggtctgagtctgaaaagagagtcagcgaagggagataggggtggggccgctttatagggtttgggaagataatggaaaattacagtcaaagggggttgttctctggtgggcaggggcgggggtcacaaggtgttcagtgggggagcttctggtctaccccgtcccaaatttaaaagtatgaggggtcctgtctataggatcccattcttattt

SEQ ID NO: 715630 - DNA, 1172 bp, Homo sapiens
cttctttgtgtcgctctctgtttgtggggctcgccttttggatgtttgatagccgagtctctgtcgcgctcctgccgtgtgtgacgctggtgatcttcgtcctgcggtgttgccccactttgtctgtctaccgaggcttctagccgttgtgtgcaacaccccgtgtgtcttatccagttttatagacgcagcgcccctgccccaggggttcccgccgtgcttgcccaattgaatcccccggcatccttcctgccaccccgagttctcccccgagttgagtccctgttgacccttagtccacatggtaccccccaagtctctctggtgacaagatacgggaaagaggaccaggattactatccctatgcacacaggcccttttgagccacggagaccttgacgtatggtcccggaagctgagaaagtaccaagctgaagatgagaaccgagggcaccaggtgtcatcccagaattcacttggagtcctatgcccttccacctggaacccactgttgaagatgagaaacttcacaggccagattaaccgatgaggcccccaccagacagattcttggcacacaagtgttaatgagaatttatccaacatggcgttgatacagaatctcagactctcccgaagaaggaagacaatttgagcacacatctccaccacggcatagagcctgtgaagaaaaggtttgcacaccccacggtcatgtcacccacaagcgtgttacacccagaggtctcacaggaaggcacatgtccacaggagggaaaatgccctcgtggggaaatttctcttggttggttggagagcctccctccctctctggtgtgtgctctcctccacgggcccacaccacttgaaagaggggttgagttaacccacaccccaggtgtatgagatgtatcccattgttccaccaccacatttaaaaccactttgagaggacccttaaattcgtacgccaatttctgtggcacgttttaaaaaagttatacgctgctatagtaagttatctgggcacttctcacataacttgagaatactggaaacacatactgcacccggggaaaggaaataaccacttgcacctttattaaacccctgtatttgtaagtggaaaatcccatgtttttaattaaactattttaaattggcccccata

SEQ ID NO: 715631 - DNA, 230 bp, Homo sapiens
ctcaagactgcgccgtggtgccagcagcgcttcaagcgcaagggacgcatgagctaccacgtcgctctacatacggcgctgtgcacaagcgcctacaactgctcctactgtggcaagagcttctcccggccgaatcacctcaacagtcacgtcagataagtgcactcagatgagaacgggccttcatatgtgagaaatgtgaggcagctttcgccatgaaggatcggctg

SEQ ID NO: 715632 - DNA, 379 bp, Homo sapiens
  misc_feature (2)..(2): n is a, c, g, or t
  misc_feature (330)..(330): n is a, c, g, or t
cntctgggatgggaggcagcaggaactccagtggggcaggctggttgggaaaacctggggcacagaggctgctgcagggccaggtgaactctacttcttattctgtcaatacgttgttaacacgtacttttctgaaattgaatagattcttatagatgattgaagaaaatcaaattaattcaagtagtcatgaagcagaactatgttagctgccaggcaagcagctgatttcctttaataagatgaatcattaatgggttgggagatttaggccttcgtgtgcagtaagggaggaaacagatatgagtgggagaaaatgtgaggtatttnggaaccacaacaatcctgttagttactcttaatacccttagaccttctg

SEQ ID NO: 715633 - DNA, 876 bp, Homo sapiens
  misc_feature (23)..(23): n is a, c, g, or t
  misc_feature (110)..(110): n is a, c, g, or t
  misc_feature (129)..(129): n is a, c, g, or t
  misc_feature (132)..(132): n is a, c, g, or t
  misc_feature (137)..(137): n is a, c, g, or t
  misc_feature (158)..(158): n is a, c, g, or t
  misc_feature (172)..(172): n is a, c, g, or t
  misc_feature (179)..(179): n is a, c, g, or t
  misc_feature (200)..(200): n is a, c, g, or t
  misc_feature (202)..(202): n is a, c, g, or t
  misc_feature (211)..(211): n is a, c, g, or t
  misc_feature (213)..(213): n is a, c, g, or t
  misc_feature (227)..(228): n is a, c, g, or t
  misc_feature (230)..(230): n is a, c, g, or t
  misc_feature (233)..(233): n is a, c, g, or t
  misc_feature (250)..(250): n is a, c, g, or t
  misc_feature (256)..(256): n is a, c, g, or t
  misc_feature (259)..(259): n is a, c, g, or t
  misc_feature (262)..(262): n is a, c, g, or t
  misc_feature (266)..(267): n is a, c, g, or t
  misc_feature (274)..(274): n is a, c, g, or t
  misc_feature (291)..(291): n is a, c, g, or t
  misc_feature (293)..(293): n is a, c, g, or t
  misc_feature (298)..(298): n is a, c, g, or t
  misc_feature (308)..(308): n is a, c, g, or t
  misc_feature (310)..(310): n is a, c, g, or t
  misc_feature (318)..(318): n is a, c, g, or t
  misc_feature (326)..(327): n is a, c, g, or t
  misc_feature (358)..(359): n is a, c, g, or t
  misc_feature (361)..(361): n is a, c, g, or t
  misc_feature (522)..(522): n is a, c, g, or t
  misc_feature (539)..(539): n is a, c, g, or t
  misc_feature (691)..(691): n is a, c, g, or t
  misc_feature (695)..(695): n is a, c, g, or t
  misc_feature (713)..(713): n is a, c, g, or t
  misc_feature (718)..(718): n is a, c, g, or t
  misc_feature (723)..(723): n is a, c, g, or t
  misc_feature (727)..(727): n is a, c, g, or t
  misc_feature (741)..(741): n is a, c, g, or t
  misc_feature (746)..(746): n is a, c, g, or t
  misc_feature (751)..(751): n is a, c, g, or t
  misc_feature (754)..(755): n is a, c, g, or t
  misc_feature (758)..(759): n is a, c, g, or t
  misc_feature (768)..(768): n is a, c, g, or t
  misc_feature (779)..(779): n is a, c, g, or t
  misc_feature (781)..(781): n is a, c, g, or t
  misc_feature (784)..(784): n is a, c, g, or t
  misc_feature (789)..(789): n is a, c, g, or t
  misc_feature (795)..(795): n is a, c, g, or t
  misc_feature (797)..(799): n is a, c, g, or t
  misc_feature (803)..(803): n is a, c, g, or t
  misc_feature (846)..(846): n is a, c, g, or t
aaaataattaggaaagaatattnagcatgtttcaaaacatttaaaataggagcagaacattttacaaaaagttgtacaggaaattaaattcttaaactatcagtacaaanatgacattaaagagtatcnaanaaaanacaaagacaaatataaaaggnctatgatgctttangtctganaactattggccaaatatttangnttaaatttncngttcctgggtatgnnantcntattactatatacatcncccaanccngtngcgnngtatttnccaattacccatgtgtngnatcancttctaccangnctttgggnatctctgnngtggtcgcgtcaatatggctgggcttatttnngngctttgcgccatagggttggtgagcggggtcgggcggttcagggctaagagtaattgtaataaactgagcatgtacagcaagttccataatcatatctgacacagcctttctgtgctgagcatccagagcctggtcaatttcatcaaacaagtaaaatggngccgggtcacatttctnaatggcaaaaatcagagcaagggctaccaaggatttctgtccacctgaaagctgttgcatttctctcatttcaccttgttttcctgtaaatgacaccctaattccaactccagtaaactggtcaactgatgggacactgctttgtgagccanaacncctctcactctcaccacnccctnctccntcancttgagactgactnaaaancaaanatnnttnnttcatcacnaaaaaaaaaangncancaggnaaaaanannnggtntacttcactgaagttcttagatacctgtttgaaagttcactgnatagcttcatatttccgaggttcaagaaaa

SEQ ID NO: 715634 - DNA, 212 bp, Homo sapiens
  misc_feature (201)..(201): n is a, c, g, or t
tcctcagcgctacttcactagttagggccaaataactatttaagtcctaacaacttaatacaatttgaaaaaataatacacatcataagatttccatttcatcttttaatcttttctttttttatttaagcctacgcttggtaagtctcgaggcctctgtggtttttagatggaaatgagaattgcttaagccttgcattngttttgttcaa

SEQ ID NO: 715635 - DNA, 364 bp, Homo sapiens
tatctggaaaaccctgattgactggcagacctggatactgtactgaaagacactgattgactggaagatctagattttctggaaagaactagatatactggaagacttggatttggtggaagacacagatattactggaagacatggattagctggaagatctgtatttgctggaagaccttgaaattattggaagacatggatttcctggaagacgtggattttcctggaagatctggatttggtggaagaccagtaattgctggaagactggatttgcaggaagacttgatttacatggaagacttggagcttcttggaagacatggattgtccggaagacatggattgtctggaagatgtg

SEQ ID NO: 715636 - DNA, 479 bp, Homo sapiens
tgtgcaggaggaggatactcacaggtatggagatcctggggtcgggcagctgagttgcagggaggcagatccaggtcctggaaaggagacagaggagaggctctgagcctggaaggagggagaggagaggctctgagcctggaaggagggagaggagagggtctgagcctggaaggagggagaggagagggtctgagcctggaaggagggagaggagagggtctgagcctggaaggaggaagaggagagggtctgagcctgggaagggggcagaggagaggctctgagcctggaaggagcgagaaggagaggctctgagcctggaaggcaggggcgagggagaagggtctgagcctgggaaggcagggagaccgcgaggctctgagccaggctgtgacaaggccccgaggtgtcagtgcccatttgcacacccgggactcagggaaggagaagaggcctgattctgaccatgcgaggtt

SEQ ID NO: 715637 - DNA, 175 bp, Homo sapiens
  misc_feature (6)..(6): n is a, c, g, or t
  misc_feature (107)..(107): n is a, c, g, or t
  misc_feature (149)..(149): n is a, c, g, or t
ccatgncggcccccaggtcctcgatcttttcgagctgacttctcatggctcgatttcctggtgcttggtttggtagcttcaagctgggattcgagggtccccgactnttccaccatacaggacccatcgaggaggcatgttctggtctnttggatccactggtggaagggttgcg

SEQ ID NO: 715638 - DNA, 314 bp, Homo sapiens
  misc_feature (6)..(6): n is a, c, g, or t
  misc_feature (36)..(36): n is a, c, g, or t
  misc_feature (38)..(38): n is a, c, g, or t
  misc_feature (60)..(62): n is a, c, g, or t
  misc_feature (66)..(66): n is a, c, g, or t
  misc_feature (81)..(81): n is a, c, g, or t
  misc_feature (120)..(120): n is a, c, g, or t
  misc_feature (144)..(144): n is a, c, g, or t
  misc_feature (155)..(155): n is a, c, g, or t
  misc_feature (160)..(161): n is a, c, g, or t
  misc_feature (163)..(165): n is a, c, g, or t
  misc_feature (182)..(182): n is a, c, g, or t
  misc_feature (205)..(205): n is a, c, g, or t
  misc_feature (238)..(238): n is a, c, g, or t
  misc_feature (263)..(263): n is a, c, g, or t
  misc_feature (302)..(302): n is a, c, g, or t
tttttntttttaattattacctgatttaaaaatctntntaaaaacgtgtagtgtttcatnnntctntaactcgcattttantgatcagctattataagcttttaatagcatgaaaattgntaggctatataacattgccacttnaactctaaggnatatnncnnngatatccctttggaagnaccttgccttggtagagcctggncactaacaattctacaccaaattgtctcttcantacgtatggtactggataactctgngaaacacatctagtataactgaataagcagagcatcaanttaaacagacag

SEQ ID NO: 715639 - DNA, 714 bp, Homo sapiens
agggcaaaaaggccggggtcccttaagcgacgaacacaatttaagacgcgaccaaagggacacagcaaaagggggacaaccccaacccccagaagcactaacaaacaaaaaaccacacgacaacaaaacacacaaactaaaacacaaacacaaacaacaacccaacgacaaacacacccaaaaaaaagaagacggcccaacgaggcaaacaacagacaacaccaaaaccgagccacaccagcacaccgggccaacaaggcgaaacaaaccacccgaagcgaactgaacgagaccccgacgcagcagactaacgccgcaacccaacaacacgagcagaacacacaccaactgaaggaggaacaacagacccaaacacggcaagccgagaacaacaagaaggcagacaaccaaagagcaccaaccggacaccaacaaggaacgaacccgacaaccaccaaaaggccgcaagaagcacgaacccctcgaacaacaagcctgacacccagtaccgaatcgccaaccacacaacgccactacctgccccccacaacaacccagacaaaagacccaaaacacccacaaccaagcaaacagcccaaacaagcacaagataacacaaagagcaccgaagcaaaacccacaccacacaaatcgaaacacccaaaggcagaaccagccgcaaaccaaacacaaacacaccccacacatcggcgt

SEQ ID NO: 715640 - DNA, 206 bp, Homo sapiens
gtcccccttttttttcaggggggggaaccccaaattcctgggaatgcattaaagggattccccagactgaaaggtttccctcccagtttttcccccctttgttgggtcaagccagggggggtgctttttaaagaagggaattttggaaaattttaacctatactggcccggaagactgtcccaattaaaaaattgccattctccca

SEQ ID NO: 715641 - DNA, 232 bp, Homo sapiens
cctgagactattgcaggactctgaatttttgcagtgctatttttggatactgtaaaaaataaaaaagaaaaacaacacacacacacacacacactcatagcagagtggtttgcccggtcatatggcctctttgaggaaaggacagtcccaaaaggcattgacgggtgacatggttgggccttgcccttcttaaggaagccagttcagcattgtccttgccaagggggcccac

SEQ ID NO: 715642 - DNA, 812 bp, Homo sapiens
ggcgacactaggctggagtgagaccctgtctcaaaacgaaaaaaaaaacaaaaaacgaaaggagagagaaatgggagagcgagagcgagagagagagagagacagcgagacagacacagagagagagaaagataaagagaatggacgcgcccaatgcccactcctgcagccctgccgcatgctcctggcctgtgccctggagggtgctgaccattcgcctttctgcccgtgctacatccttggtgcctcattgtacctgtgtgccatactgcctgccgtgtgtgtgcctgcttgtgcctcctggatctgctactgtgccttccttggccattctggccctcatacgtggtgccttccttttccagcgcaccttgtgtggctgcaagacgccgtcttcgctgtaccttggatgcacctggctggtgtgtgcggcggccggccgctgggggcccgctggatgcagccacctgctgctgcatgtgtgtgctgctgacacatctccggccctaccaggggaggacccctgcgttaccttgcagccatgtgccatggcgtcctgccctgcgccctgcgtgtaccctgcgctgctgcgtgcttgcgcgtccgtcatggtggtgcgatggcaaccggcgcgcgaggacgctctacattggtccgacagtgttccggcgagggctcttcagctgacggaggaccccgaccacgtacagttgtgggaccggcaagctaccaccagcccctggtgaacccgctggcggccgggcagcggtgggcgcccggagcctatcgggagggtggagtgcggaggatcc

SEQ ID NO: 715643 - DNA, 331 bp, Homo sapiens
agcatatgtggagtgtatgacgtatactgcttacagaggtctgaagactgcctcatcacgatggctagcacgtgatcggaagtgccaagcttagacagcgcaagccatcttgtgtgcttgctcccactgtgatgagctattatgtcagtggtgaggccttgtgctgaacaccaatcaactattaggttgtgacacagaaactaggagaatggtaggctttgtaaatgacagagaggggaaccccgtaagtgttggttgcagttgggtgacggccgcactgtacgggggggacgagctcgaatcgaatctggctagtgtcctggtaatgtat

SEQ ID NO: 715644 - DNA, 974 bp, Homo sapiens
atctctaaggaggaaacaagacgcaacagcatcctcttctatacaactgtaatgtattgtcaatatttataattatgtatttgtctgactctggtcatggctggaatgtctagtccttgaacaaggacatatttaaagttcatcacagaaaagggtccctaaagccaggtatctctatatagataggtaggtatagatatataaatagatctcttttccttgtttctctgccaactttgtctcgagtaaaataaccacagcctgcactgaatcaaagggggatgggtacacagaaaagcttctagaacatcctcgtttggagacagactttgtgtatgtgtatctgacaggttggcaggaggaagatgggggctccgaggcccccagcaggacaacagaacactctagccttgggcgtttcctaacctattattgtttatatgacaacccccaaatactttcatgtctctaggccaggccgcccaaagcagcccaggccacacctggaaagaagacttacctctgcatttcctgttgccatttttctggccctagaagcatctatatcctaggacgtccacacatctcagagtagtctattttttgttcagataaaatatatacatatatgtatttaagtatatttatactacggcaatgagtcttaatctctttgttaacagaggatatctggggattatggtgcccattgcatagcctggcccttcctgcggcatcccttcccatgtccctgggcagaatacggggtagcaagacggaggaacacgtgtctggaaatggcaaagatgcggtcacaccgggaaagcgctctctccaggggtgaaggggctgggaacaccgtgctttccataggattgcccggggaccaaaccagctaggaacagataggatagaacggcgcacaaaccggcgtcccacagaggcggcataacaccgacacagcaacacttgaa

SEQ ID NO: 715645 - DNA, 185 bp, Homo sapiens
  misc_feature (24)..(24): n is a, c, g, or t
gcacgagggatggggatgactggngcaccaccttagaagctgcctttcacagggtgtcttcataggcttttgaaatggaccccagaaagggaatttgaggataaaattatttttgttactattagaaactcaatcagaaattgaatccttcctgatctgaatgcttaccggttctaagcttactg

SEQ ID NO: 715646 - DNA, 443 bp, Homo sapiens
aagtagtgtgtttaacaagacagactttggttgctgtattcaagtatttggattatgactgtggaggagggcttgcttaaaatatgtggttgtgtttttttgtggaaaagtgaggagttaggtggctttataataggcagggaaaccaaattgttggggctatgacctttttttccagtatgctacctgatttgtttgggtggccactaggtggcagcattggttttacttttttgctttttaaaaaaaatttcaggaaggatgatcattccagttagtttggcattttttgttgtttgggcacaaaaattggggttatccttatgttatcaaattcctcctaggggaaagtttttgttttaattacaaaattaaattttacattgtttccaaaaaatttgtggtgataaaaatggaaaaataaaaatttggggagttagtta

SEQ ID NO: 715647 - DNA, 184 bp, Homo sapiens
aatcgaagagttataaataggcaagacaggacttggtagtacttgtatcatttttacttctaggtactgatctattcactatcttcaacaatcgattataagtgctgcagaatgaaacttgggaaaacacaactttgcaaattcaacagtaataaattcagccatacaaaaattacggccctgg

SEQ ID NO: 715648 - DNA, 209 bp, Homo sapiens
  misc_feature (5)..(5): n is a, c, g, or t
  misc_feature (91)..(91): n is a, c, g, or t
  misc_feature (98)..(98): n is a, c, g, or t
  misc_feature (152)..(152): n is a, c, g, or t
  misc_feature (155)..(155): n is a, c, g, or t
  misc_feature (170)..(170): n is a, c, g, or t
ctggntcctcaaaaaacctccaatctaacaattccaagtcaggggacactccctgcttcagctcacaaaatttgcaactggggaggaccanaaggaangttcagccaaccaggttaattcaggaagcatcaacccaccacctgccaaagcangtnaccttgaaataatanagtacgtactctatgtcagacaccaaggaggcacagata

SEQ ID NO: 715649 - DNA, 567 bp, Homo sapiens
  misc_feature (4)..(4): n is a, c, g, or t
  misc_feature (21)..(21): n is a, c, g, or t
  misc_feature (112)..(112): n is a, c, g, or t
  misc_feature (212)..(212): n is a, c, g, or t
  misc_feature (214)..(214): n is a, c, g, or t
  misc_feature (407)..(407): n is a, c, g, or t
  misc_feature (478)..(478): n is a, c, g, or t
  misc_feature (501)..(501): n is a, c, g, or t
  misc_feature (521)..(521): n is a, c, g, or t
  misc_feature (562)..(562): n is a, c, g, or t
cggngcccgccccgcgcgcanccatgtacgcctttgtgcggttcctggaggacaacgtctgctacgcgctgcccgtgtcgtgcgtgcgcgacttcagcccccgctcgcgctnggattttgacaaccagaaggtgtacgccgtgtaccggggcccgaggaattgggcgccgggccagaggagccccccgcgcgccccccgcgactggggcctngntttgctccacaaggcccagatcctggcgctggcatgaagacaaatctgaccttgaaaacagtgtgattgcagaagaaaataaaaatccccaagctttctcttaatcatgttagaagaagatgggagaggttaaagattatgggggaagaagatttacagcttagacacatcaagagacctgaggggcggaacngaggcgaaagtggcgcacaagagcatcgaggcagttgtggctcgctagagaagcagaacggcctgagcctngggccatagcacgtgtccggaanaggtctttcgtgaagcttcncaggcacagaaggacatggacagtttagaagattctgttgntcccc

SEQ ID NO: 715650 - DNA, 331 bp, Homo sapiens
gttatttgcttggggattccccccttgctcttttttagtttgaaaaaacaaaaacggggccctggaattttccttttgacgccgaaattttgaaattgaaaatgggcctgttttggggcccaaaaacccttttgggggcaaaactttgtttttgttttgccccgtaaaaacccataggccagcgttatgtttttgggaagttaactatgaaagcttttttttttttttttttaaaaatggacccattttcccccccggaaaaaaaaaattcctttggatgcttgtttgacccccatgggtttgtttttttaataaaatttttcccctaata

SEQ ID NO: 715651 - DNA, 188 bp, Homo sapiens
tatttcgcacacgcacggagaagggaatggaggatggaggctccagcccagcagcacagatggtgcgaccagtgaggcatggaagtcctcatgtgttgccgaggctcatcgtccagcatagatgcaggcaaagcccagtgaagatttcaaagtcaagaggatagtgtacccttctccggtggcgtggt

SEQ ID NO: 715652 - DNA, 117 bp, Homo sapiens
ttggaggacaggtataggagggcaggctgagcatgcttgcatgatgtgcatgatgaagatggtaaggccaggcgaagatgtaggctgcaaaggcgtgtgtagaagtagcgtgtgggt

SEQ ID NO: 715653 - DNA, 294 bp, Homo sapiens
aggtgaaggttttgagggaaaaacccggggtccgttttgaaccataaaagtttggatattccccctttgaaggatatttttttttggggggctcttgtttccaaggggattccaggggggtttttgaaaaaaaaaaaagaaattttttttttgttttgggttttgggggtttttttacccaaattttaaaggccggataaaagggtttttgtttggaagggataaaacctcttttttttccttccccactacgggatgaagaaattttccttcccttttttttatttttggcca

SEQ ID NO: 715654 - DNA, 966 bp, Homo sapiens
  misc_feature (717)..(717): n is a, c, g, or t
  misc_feature (748)..(748): n is a, c, g, or t
cagataaccacctttaactgtaactttccacagcctaccccagaccctataaagctgcctctctcctatctcccttcgctgactctcttttcagactcagcccacttgcacccaagtgaattaacagccttgttgctcacacaaagcctgtttaggtggtcttctatatggacatgcgtgacacttggtgccaaaatctgggccagggggactcctttgtgagaccggccccctgtcctggccctcactccgtgaagagatccacctgcgacctcgggtcctcagaccagcccaaggaacatctcaccaatttcaaatcggatctcctcggcttagtggctgaagactgatgctgcccgatcgcctcagaagccccctggaccatcacagatgccgagcttcgggtaactcttacggtggaggattcccagccatatgaagacaccctagctggacgatcagtccttgtcaaaagtctgacccctcaaactctacagcctcaatggaccagaccctacccggtcatttatagcacaccaactgccgtccatctgcaggaccctctccattgggttcaccattccagaataaagccatgcccatcagacagccagcttgatctctcctcttcctcctggaagccacaagattaggccgagagccgatcagacaaacaagctacaacccttaagctcctggcagcgcccaggcaaggcnatgcttccatgcaacactccttccaaatggncatcccagcatgcttccaaagcaggcttcatccgttcctctggaacctcatctcttaagacctggcgcctataaaaggattatatcttgagacctatctctaaaatttttcaccaccaaacaaaaatttgggtcaagttacacgctagctggaacacgaatctggcaggggccaagccaactagacaggcacccacggcatgggggcccttttggccc

SEQ ID NO: 715655 - DNA, 108 bp, Homo sapiens
agcgggaaccaatcacttctagtagcagttaataattttagagagagagtaaacaaccacctgaccatcacttgatgtgtcaccttgccattcgttggttttgggcag

SEQ ID NO: 715656 - DNA, 119 bp, Homo sapiens
cgtagctgatactacaggcgtgtgcacacacatagctgattttgtatttttctgtagagacatggttccccatgttgcccaggctggtcttgaacccctgggctcaagggatctgcccg

SEQ ID NO: 715657 - DNA, 121 bp, Homo sapiens
cgcgattaatgtgtccccctcgatccttcacatatccgcacaccacggaaattcggggatactccccagaggtcacatccggccacgctcgctccccccattacaccgatccccgaaacca

SEQ ID NO: 715658 - DNA, 305 bp, Homo sapiens
  misc_feature (81)..(81): n is a, c, g, or t
actctagaggatcgccttagagtcttaaccctcagcaggcatcagtgctttgtcagtggcagtctgtctatctagagcccntcctcgcggctagactggagctggctccctcttcgttccttccctggcttccggaggagaccccactacccatgcctgctggggtctgaccactaacactcttgtgcatggacagcctgcacaggacctgctccctgctcttgggcacttgtgctcccgatttctgtccttgggccttgggatgtagcttgagggggcagatctaggggagtaggggctggcag

SEQ ID NO: 715659 - DNA, 995 bp, Homo sapiens
  misc_feature (11)..(11): n is a, c, g, or t
  misc_feature (46)..(46): n is a, c, g, or t
  misc_feature (60)..(60): n is a, c, g, or t
  misc_feature (66)..(66): n is a, c, g, or t
  misc_feature (71)..(71): n is a, c, g, or t
  misc_feature (76)..(76): n is a, c, g, or t
  misc_feature (81)..(81): n is a, c, g, or t
  misc_feature (86)..(86): n is a, c, g, or t
  misc_feature (91)..(91): n is a, c, g, or t
  misc_feature (96)..(96): n is a, c, g, or t
  misc_feature (117)..(118): n is a, c, g, or t
  misc_feature (134)..(134): n is a, c, g, or t
  misc_feature (141)..(141): n is a, c, g, or t
  misc_feature (152)..(152): n is a, c, g, or t
  misc_feature (156)..(156): n is a, c, g, or t
  misc_feature (160)..(160): n is a, c, g, or t
  misc_feature (164)..(164): n is a, c, g, or t
  misc_feature (168)..(169): n is a, c, g, or t
  misc_feature (172)..(172): n is a, c, g, or t
  misc_feature (186)..(186): n is a, c, g, or t
  misc_feature (191)..(191): n is a, c, g, or t
  misc_feature (197)..(198): n is a, c, g, or t
  misc_feature (201)..(201): n is a, c, g, or t
  misc_feature (206)..(206): n is a, c, g, or t
  misc_feature (216)..(216): n is a, c, g, or t
  misc_feature (227)..(227): n is a, c, g, or t
  misc_feature (230)..(230): n is a, c, g, or t
  misc_feature (232)..(232): n is a, c, g, or t
  misc_feature (234)..(234): n is a, c, g, or t
  misc_feature (238)..(238): n is a, c, g, or t
  misc_feature (240)..(240): n is a, c, g, or t
  misc_feature (244)..(244): n is a, c, g, or t
  misc_feature (270)..(270): n is a, c, g, or t
  misc_feature (278)..(278): n is a, c, g, or t
  misc_feature (296)..(296): n is a, c, g, or t
  misc_feature (304)..(304): n is a, c, g, or t
  misc_feature (313)..(313): n is a, c, g, or t
  misc_feature (358)..(358): n is a, c, g, or t
  misc_feature (373)..(373): n is a, c, g, or t
  misc_feature (414)..(414): n is a, c, g, or t
  misc_feature (450)..(450): n is a, c, g, or t
  misc_feature (464)..(464): n is a, c, g, or t
  misc_feature (468)..(468): n is a, c, g, or t
  misc_feature (480)..(480): n is a, c, g, or t
  misc_feature (540)..(540): n is a, c, g, or t
  misc_feature (547)..(547): n is a, c, g, or t
  misc_feature (563)..(563): n is a, c, g, or t
  misc_feature (593)..(593): n is a, c, g, or t
  misc_feature (729)..(729): n is a, c, g, or t
  misc_feature (968)..(968): n is a, c, g, or t
ggccgcgaaangccaggccggtgccctgcggggacgcccagcgcanccagccccgcgcanccagcnctgcnctgcnctgcnctgcnctgcnctgcnctgcgcccggggcgcgcccanngcgccgcatccatgtncgatgtnacatgagtgcntacnctgnatcntgtnncgnattgtgctgggganagagnagtganncanagaancgtgaagganttggacctgtnatnananagtnanggcncagagtagtccaggatgggagcagcncaggggantgtggggtcacgcatgancaaaagtnctgaagganaaataaggatttgctaggcaaagaagaactacgatctggacaganagaatggcatatgtnaaggcttggagcaccacaccccactctggccggagcacgcnaagcagctccccatcgctccggaaacggctgcagcncctgcccccaagcnggcncccacctgagcnagaaccaggcaccatggtggagaagggatcagatagctcctcagagaagggtggggtgcntgggacncccagcacccagagantaggcagaaggaacttcatccgcaacagcnagaagatgcagagctggtacagtatgctgagccccacttataagcagcgtaatgaggacttccggaaactgttcagcaaactccccgaagcagaacgcctcattgtggattactcctgcgccctgcagcgtgagancctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgctctggcagaatgnctgcttgaaaaacgctgagtcccgcga

SEQ ID NO: 715660 - DNA, 483 bp, Homo sapiens
  misc_feature (201)..(201): n is a, c, g, or t
aggcggaggttgcagtgagctgagattgcaccactgccctccagcctgggtgacagagcaagaagacattgtctcaaaaacaaacaaacaatcaaacaaacaaacaaaaaacagtgactaaactgagagcaaagaaatggaagggagggagcaggaggatcatcagtttccatccttttactgtgtgctcaaatgtaattnggctgcaggtgaggtctgtgcagaccctgggtgaggggcgagttggctatggcctgtttaactccacctgtgcatactgcagctcagcctcgtccatgcttcgtgactcagccttgtcctcagggaagctggggctggtgcaactttcagaagtggtcccaggtaagcctggccctcctgagtccatgggtggggaatgctggtacaggcctagcagctggctttccggggctgggtggaggtacagatcggtgatgtgtggtgttcgccatcctccatgag

SEQ ID NO: 715661 - DNA, 159 bp, Homo sapiens
atcttgtactggcgtggattctgcataaaggggagcacacgtttcacctcatactcagtgagttctcccgccctcttggggaggggaatgtgtgcttttctcaacaccacatgagcatatattctgcccacacccttaatggcagtgatggcgaaagcc

SEQ ID NO: 715662 - DNA, 188 bp, Homo sapiens
accatcgcccaacaacgtggtgaaagcaaggctttgagcctccctcctttgtgggctggtaccttggcttgggatgatgattactggtctgtggaaccctatggacaagggccatggctagaggctggatgccatgaggaggggcagggcccacccaatgtacaccaggtcacgtgcctatatggcaa

SEQ ID NO: 715663 - DNA, 442 bp, Homo sapiens
  misc_feature (26)..(26): n is a, c, g, or t
ccccggtttaatccctcacgacagcnatcgagattgtaagtgcctgtggttatcctgcaattcctacagaagtcattcaataaatacccaaaaaaggacctaagttcctggacacttccctcctaacacttaaatctttaacaaagaatataaagggcccaagtgtggtggctcacacctgtaatccccaacaatttaggaggctgaggtgggaggatcgcttgagaccctggagttcgagaccagcctgggcaacacagcaaaactcccatctctacaaaaaaaaataaaaaattatcccagggccagccttggtgcctcacgcctgtaatcccagaactatgggaggctgaggtagaaggatcacttgagcccaggagtttgtttgagaccagcctgggtaacatagtgagatcccatctgtataaaaaattaaaaataa

SEQ ID NO: 715664 - DNA, 655 bp, Homo sapiens
  misc_feature (655)..(655): n is a, c, g, or t
agcggatgggggacctaaatttagaatgtattccatgaactgttcctccctgttctctgcgttttctcctctctgtaaccgtctgataataccacacgtctgtttgcttgcatttagtttgtcttcttccttcagctgtgtatcccagacgtgttaatacaggaagaagagacgatttcagcttgtgattatgaccatcgtgatcatattccaggtctaaagaagaacgaacagcagactaggtacttaaggtggggatttccataggttccaaagaagaattgagcacgcattaagacgtgagttccaccacttggtcaggtggccactgtaagggttctctcagcctgggaaactatcgaactctttctttaacacaccgaacagagggttgacagatcctctggacgaacagaagtcacttgtggtctgttcagtaaggccgaatgttgagatgacacgtgtagagcgaggaaatagtgcagagctcaagttaaatggttatgacttattctgcgtactcattagaagaagcgccagagatagcatttcgtctattatatgggacatttcttagtggatgggaatgagttgaatgtgggaatgacactttatgtggcaaaagtaacatgagaattagggaagaagaaagatn

SEQ ID NO: 715665 - DNA, 293 bp, Homo sapiens
atataacctgccgaagatcttgtacgaatgtatacatgaagtgacctgtactaggagacctgacttagtcctaagattccttgttgttcctaggattaagatggctacatattgacatatattactgtttcagttatggtgtattgcaggccggatgctgatttgtggtacggattaactggtaaggaaaggaccttatagaatatatagtactatacgatgaccgcgtttatgcctatgagatcctggtcatgcactgggtctactcagctgtcagcatgtctactgacgag

SEQ ID NO: 715666 - DNA, 847 bp, Homo sapiens
  misc_feature (51)..(51): n is a, c, g, or t
  misc_feature (77)..(78): n is a, c, g, or t
  misc_feature (80)..(80): n is a, c, g, or t
  misc_feature (99)..(99): n is a, c, g, or t
gaaaactatgacattccttctgcagaccggcacaagagcaagctgattgcngggaagatcatcccagccattgccannancacagcagccgtggttggncttgttgtgtctggagctgtacaaggttgtgcaggggcaccgagagcttgactcctacaagaatggttatcctcaaccttggccctgactttctttggattactcgtgagacgcccttgcacgcaccaacgatcagccagatacatataaacacaacaagatggtacattggtgtggtatcgcgtgtgagtgtaccaaggcgcggtggagtcctaatgggtgagagaggatgaccctcagaatcgaggtgtcgctcgactatttataagacaggaggcacgaaagttaggaagactcgacccaatgcagatcccagggcggtgtccagttctctaattccgtttcttcgattgccaggttgccaggctgcaaggaatcgggttggagtcagccgatgacaggagattgttgagccgtgtgtccgaagcagaaacgcttgaggcctggcacgtgcgggcgcttggtgctttgacgctgtgcttgtgaacgaccgaggagcgggcgacggatgtccgacggttccctatgtccgatacgaccatccgctgagcccgtctgtcctctaggcgggacccttgtcaggccctcttcacagcgccgtttcagccagagtttcgcagtatagggttctggcagtggccaactagccaagtcttggtgttccctcataaatacccgctactgaaccctctggcatggcttctaccttgttttgaaactggatcctaataaagaattaataattgcc

SEQ ID NO: 715667 - DNA, 263 bp, Homo sapiens
  misc_feature (18)..(18): n is a, c, g, or t
  misc_feature (87)..(87): n is a, c, g, or t
  misc_feature (89)..(89): n is a, c, g, or t
  misc_feature (97)..(97): n is a, c, g, or t
  misc_feature (118)..(119): n is a, c, g, or t
  misc_feature (121)..(121): n is a, c, g, or t
  misc_feature (137)..(138): n is a, c, g, or t
  misc_feature (167)..(167): n is a, c, g, or t
  misc_feature (169)..(171): n is a, c, g, or t
  misc_feature (173)..(173): n is a, c, g, or t
  misc_feature (194)..(194): n is a, c, g, or t
  misc_feature (203)..(203): n is a, c, g, or t
  misc_feature (206)..(206): n is a, c, g, or t
  misc_feature (212)..(212): n is a, c, g, or t
  misc_feature (216)..(216): n is a, c, g, or t
  misc_feature (221)..(221): n is a, c, g, or t
  misc_feature (224)..(224): n is a, c, g, or t
  misc_feature (227)..(227): n is a, c, g, or t
gatatgtaaataacaganttatcaacattaaaatcttattcacaatggctaacaagaacaggatgacagtcaagtcagtagcttttnantaaaatgngccgactcccatcgtaacacnncnttgtcacatgacttcnnatacacagcagaccactcatgttccctgncnnncnaccctcaatcatacttaatanaggcctgtnagngctgtncctnaagantcnaantcgaaggggggggggggggggggggggggggggggg

SEQ ID NO: 715668 - DNA, 499 bp, Homo sapiens
taccacgcgaggccattagctatcgatcagtacgccctggccacactgggcattgatgagcccgactgaccaaactcgaacacttcatcggcccgcccttgctgcaggcgttcatgcagttttacgccttcgacgaggccaaggcatgggaggcggtgaatttctaccgtgagcgcttcaaggtcaccggcctgtacgaaaaccgcgtgttcgacggcgtcatgccgttattggaagagctgaacattcaagggcgtcagctttacgtagccacctccaaaccgtgggaatttgcccgcgagattgcgcggcatttcgactttgccaagtacttcaaggtgatctacggcagcgaactggacggcacgcgtaccaacaaggtcgagttgatcgcgcatttgatgcgtgaggaacggctggacccggccaccaccttgatgatcggtgatcgcaagcatgacctgatcggcgcacgcagtaatgggctggattcgggcga

SEQ ID NO: 715669 - DNA, 144 bp, Homo sapiens
ggtcacatcataactccacctgggaaggcctgggtgagcataggggctaacgacaggactgtgcctggtgtcctgctgcggaacgcgcccgacatacctcttctccaacagtctgccacctgctgtcgttggcttgccctccaa

SEQ ID NO: 715670 - DNA, 262 bp, Homo sapiens
tcggaacgaggtaaggacggggctgggaagaggggaaaggaggagggggggtggggtcttctcatcaaatagctaggccatttcctcaagagaggggcctgggggcactggcctgggtggggggggcaagtttgggggcagccgggggctggtggctttccttgccaagggaaggaagggcatggctggagagggctaggatggaagggcctgtggccttctgagtggcagggggctgtgctcttgtcccaccagtggactg

SEQ ID NO: 715671 - DNA, 246 bp, Homo sapiens
gttttcattagtaagttaacaaggattccgttgtttgttgttcatttgttgttggcttgtttgagacggagtctcactcttcagctcaggctggagtacagtggcgtgttctcggctcactgcggcctccagttcccgggttcaagcgattctgtgtgcctcagccgtcctgtagtagctgggattacaggtgtgcgccacctatgcccagctaattttgtatttttagtggagacggggttttgc

SEQ ID NO: 715672 - DNA, 929 bp, Homo sapiens
tatacacgtaaacactcctcgttctacacatataatctctaatatgaaccacccgcgttaaaacattctacatttcacaaacgagggacatcatattcccctgacgatttccactgtaaataccccttcccccacctcgcaaaaattacacagagactggtgcccgccccttatagattttcccaccgcaccctgtctctattaccaccacgcactgccatttcttcatttctccagcaggagtattcgcgctaaaccacaccctaagcgcccattaggtccaattagagccaaaagataataccctgccccctcagctatacgggagtcctgttcccactgacaccgccttccccggtaagcacgtggttaaaaagctggtgcgtccccacgcagccccccggaattgtttccatctgtagttaaagagaggacggcgggcttcccccacatgggttcaggggtattatttcagggtctcctgacgccccacgggggttgtaccccccgctggcgcggctccacacaaaccggggtcataacacgggccggtcccaccgccaacagaggcgcgaacatatcttcagataccactacatagacgctttgaaggaaagtactccacatccatcaaggaattaacaggaggttcccccaaacaatagaataaaaagcattctttccgttcacacaccccgtcttgtcattcttacagagactagataccctgtttaacaacggtcctctccacctatcaaaggaagtactcattccatgacaaacaagttgtttcattgaacccactcctagtactcgtcaacgaagacacactcatatcctcacttgcactatccccttccgatgatggtcggccaacatttccccatctttccaaaaaaaaatttctttcaaaactgcccaacatagac

SEQ ID NO: 715673 - DNA, 209 bp, Homo sapiens
gtatgtaattataggtaaaaaaatttaaatttggcctctcaaaatctactagtgccgttgtgactgcagcttgttaacttgctgccgtgttgcatgcgatcgggctactttcattttttacttctctgtgcatcggatgatatatcctgtgccctgagttatgtctttggcacattctgtgtgcctgtctaatcgtccgtcgcgtacag

SEQ ID NO: 715674 - DNA, 130 bp, Homo sapiens
ctctcttctccctttgttttctcttcatatatgtgaattttattaaaatctgtgctttgcttaggtatggaagctattatttgaatttttaagggtttcaacatatcttttcctttaatggacctcctcc

SEQ ID NO: 715675 - DNA, 508 bp, Homo sapiens
tcctggacataatgattgagagtctcttcatgtccagtggccgttgtaacaggtccttagcgatcgatttcgtattcatgcataggacaacattagtcagtaagatttccatgttgccttaccttattcttcactcaaaaattgtccctaactcgggtaatggcagtgatcaagtcacatgctctcactttggtcaccactgtattctgggtttcaaagacttgtaattcatttcattaagactctccaaaccatccccttaaacatttgttgaaatgtctctgttcttcattagcgttttattacgttacattctctaggctccagaaaaacgaggcaagaaataggaggatttgttttgttgggccttattagctttgttggggtggaagttggggtcaaacaagccaaaataacattatcattaaacagatcgagcggtactttgaagtggagggaataaggatataaaaggaagtgaggggtgtaagtaccctcttggatttgt

SEQ ID NO: 715676 - DNA, 191 bp, Homo sapiens
attttccaaaggatgaggtacacagaccactatgcagccttatctgagaagtggagatgattagcaagtcatcataatgccttctttgttttagacacagtgaacagaccacgcacaaccttagttttttaagtcatcatgcttgctgccttagagaaataaggttgtgggtggtctgttcattgtgtcta

SEQ ID NO: 715677 - DNA, 157 bp, Homo sapiens
ttacacgcctcaatcatggttggctcccttctagctgcagtaagtttatcctaagaaagtccaggtctggttcttcagccttgctccttcgcgaaatgatcctgtgtgggttagttctcctctctggggggttcctaatctccgtggggtaggaggt

SEQ ID NO: 715678 - DNA, 1269 bp, Homo sapiens
  misc_feature (1107)..(1107): n is a, c, g, or t
cccaaccactacaacgcggctagacgcgaactccgctgtccgacagcggctcggtgaccgcgacgtaccgtagcgcggttctacgctccccaggcaacatctgcatgctaacactcgagtcaacacggcccgtggcgtctgatgcctacaccattggcctagtctcttggcgcatccgtctttcgtcgctcgtcggctccgacccttccgtcgttcgccctctcggtcccattggcacccgtaggagctcgccgactcgcactacgaatcagagcactgctcggcgcctcgacgcactgcgggagtctggacgatcccgggacggaggggtgtgtatcgctctggtcatccctgggagagcgtccgagacgtgtggggacgtcacccattgtgacatgcaagtgcgtaacgagctttgtgccttcagcgggcgcgcgcgagggggacagacgagcacgggccttaaccatgcgcattagcgcgagtcgtcagtgacggtcccgacccttccaagagttcgtatcctacggctagacccacgttggaagggatgggacataccctatgttttgttgacccaatcccttgaatgacaggtcctcgggcgtcgacaacgcgaacgcacggctcttgcgcccgcacgaagtcggccgggccgtcgcgtgcttccctactgcacttgccaccattggaggcagccgcttggcttggaaatgcctacgttatgctcacgatttgcgttgagaaggcccacgcggtgggaggcctacccatttacagcataagcatgggcttgcccattgggtcgcctttaccagaggtcgtgagtcccggaagtgcccggtggctgccattgtccgcggaggggtgtccttgtcgttgcttctgtgggaacagatttcatatggccgcgctggggaggtcagagagggcgggtagggggagcgcttggccccacatgggggtcttgaggtgcgctgcaacggggcttggtggacaaacggtgcgatagtacccccgaggggacacctgtggtgtggttaccccaaccgccttgtgccactaggagacttgtaatgcccgccttcgaggtagttcttgggacgncccgttgcgtgaagtcttggcgagggggacacatgtcatgggcccccccaagaaggagacttttgcaggggggcgtaaccttgtgtttcatgtagggaactttcctctcgcggcaaacaacttatcattacgcacaattttacgctctatccccccttgtgg

SEQ ID NO: 715679 - DNA, 925 bp, Homo sapiens
  misc_feature (373)..(373): n is a, c, g, or t
cttcaggtgacacagggtgaaaaggttggaaacagacatcggagaatgagaaagtgagtgaaggggctgaaaccaaagaagaagaaacaggagaagcggtggacctttcatcattcacatccatacaccagtgacccttgaacaccctcgctatcctacacccacaccaacccgtgaaccaacctccacgttacgcctccacttctcttcccaatcacctcgaccctacgtcgtataaactgtatacatcacacttttattaccctcctcatcccacctccctatctcctctcctctacctcccttttctcccctctatcctcccctccctcttctccttcccccttccctcctccccctcccctatcccctntatttctccctttctcattactccatcccctccatactcattccaactctccctcccatgtttcactacacttccaccctctccccctctacccaccacccattcatcaccttcccccactcccctacctatttcaattataaaactactattcctacccctcccctcccctactacccctcttccacccccatcttacatccaattccccttatccactaccaccctcctccttctatcacctcactcccctctcttcctctatactcgctctcccatcacatcacttctcaacacccccaccaccatccctttacttaccatcctcaccctccccccaactaccttcaccccaaccactctccactctcacccctactctcttcctcctttcttcccacccatatatatatttgcctccctaccccccctcccgtcatacacctcatatcttctcattcctccaccacccacacgctaactttcttcttatcccctaccgtattccttttctacacacacatttccacgccccccttcatcacatccacg

SEQ ID NO: 715680 - DNA, 187 bp, Homo sapiens
cagctttagctcttaaagaggacagagggtagctgcctgtcgccgtcggagtcaagcagttctgcaaattctcagcagggtcagtgggatgacaggctcccccccaaccaagcggcagcggggcgggacctcgggggccggccccagtgggcggtgccacagaacggccggcgggagaagggggccc

SEQ ID NO: 715681 - DNA, 163 bp, Homo sapiens
acgcaactaccacgtgctgcacgcttcagaggcttctggtccctgctgtggctggggcaagagctgcactgggcgatccccctctggctagaccacatctccgtgtggcacggggcacccaaatccattcagctcattcatttcaatgcctcttcttccttgt

SEQ ID NO: 715682 - DNA, 239 bp, Homo sapiens
  misc_feature (21)..(21): n is a, c, g, or t
  misc_feature (40)..(40): n is a, c, g, or t
  misc_feature (56)..(56): n is a, c, g, or t
  misc_feature (62)..(62): n is a, c, g, or t
  misc_feature (68)..(70): n is a, c, g, or t
  misc_feature (82)..(83): n is a, c, g, or t
  misc_feature (118)..(118): n is a, c, g, or t
  misc_feature (132)..(132): n is a, c, g, or t
  misc_feature (138)..(138): n is a, c, g, or t
  misc_feature (154)..(154): n is a, c, g, or t
  misc_feature (166)..(166): n is a, c, g, or t
  misc_feature (173)..(174): n is a, c, g, or t
  misc_feature (208)..(208): n is a, c, g, or t
  misc_feature (230)..(231): n is a, c, g, or t
  misc_feature (236)..(236): n is a, c, g, or t
  misc_feature (238)..(238): n is a, c, g, or t
aggtagtgtgtgaatgtctgncctggcctactcttcctgnccaccctgcataaggnagttgntggttnnntcccaattcttnnaagtaggtttgtttacctactcccaaatcctgagncagaagtggggtgnttatantccaaaccttgagtgnccagccttcccntgttctnntagtctcttgtgctgtgcctagtggcacctgggntggggaggacactccccccgtnntaggntnt

SEQ ID NO: 715683 - DNA, 305 bp, Homo sapiens
tcatgcctggctaatttttgtgattttagtaaagatggagttttgccatgttggccaggctggttttgaacactgacctcaagtgatccggccccctcagcctcccaaagtgttaggattacaggggtgagcccctgccccagccagttttatttatttttaatgcaggaatttaagggtttaccattttcatgtgggattttagctggatcccttaagtttcgacctgtgggattttccttgttcccttttaactattttgtcatttaccttttggctttttttggcctgcggctccttggcga

SEQ ID NO: 715684 - DNA, 929 bp, Homo sapiens
aagctgcatatacgatgcgttaggatcgcggtcatatgaaggtctatgagcatggtcataccagtttgctactatatcttggtctggaatagtgctcgggtactcgccatgtaaaacctgcgctggaggaagacctgagaagtacttgtaaagatagtccagatggcagtatactagtggcgcgcattaggtggaagtgcgtactcagaactagagaggttctagacgcgtaggtctcgattaatacacttatttcgtcacccaaacttgatagtctccgttggaaaacctgggtgaatcttggacccctctttggcatcttctcaaattcgcttggacttacctaaggtatcctaaaggaaatcccggtaacccaataaggaagctattaccagatttgtatcgtgattttattaaagttccgcaacgtagagtacgtggatttcccagaaagtgaaacttaaaagagctgtcaggaagcagagaaaatgttcaagggcaaacggggtgcacaagtgtgcaaagggatatggcaggagaagcaaaacttttaatccaggttgcttggttttgcaattgacaaaaagaacggtgggccatctccagggatgtagaagcaatcaagaatgccatagcaaatgttcaaactctggtgaagtgcagaggttgaaggtgttgtgcagtctgtcagatccttggagagaagcagattagggcccatgatgatggtgaagcagaattggtataagacacggtcccaacggtcctgagcagtgaggcgatgtttataattaggcctttggaaagtttgtttcgacatggttaaaagctggttggttcaagtggatttacgttggaatggaaaaagggggaattgagaaactggaacaaggcggtccattaaaaactcttgaaaaaaataaaaatag

SEQ ID NO: 715685 - DNA, 897 bp, Homo sapiens
  misc_feature (365)..(365): n is a, c, g, or t
  misc_feature (396)..(396): n is a, c, g, or t
ggcaactgaaagccagactccaaatgctgaacaaggggcccaggccaagatagcctcggatcagaccaactgtaggtgcccttgtagaactcacgtgtgctgctgcatgtccaggcccatggcagatgactatctggctcagctgagcctggagcccacaaccaggacccggggcacaagataacgaaagtccacgtcgatctgaactggggactgagagcatgttggcatgtatctgaccaggcgggattcccattgcgtgcgctcggatggttctggactcagcgaagatgatgtgtgccaattctgtacatcgacaagggcctatctatagattgcgtcgactactaccgtgcttggttacngcgaacctcgcacaatagatccccatcagancgactcagaacatgcggacgggactgtcactccacacgatatactgactgaattatttatcctagcaagagtcaagatgatactgcagcagacgtcatatcaactcatggtagcaacgcatggttctacgatgatcaactcttgacatagaaaatctgagaatgcaaaaagtaagtcatgggtatagttctcatacagcactcatggatattttctgacaaggcatacgtgggaatcgacccaaggcacacacactaagctggtgtctcctcatggttgcattctgagagtcatcctcattgattggcaacaagggccagtgaggctgtcatctgggaggtgctgcgcaagtaggggctggcccctgggtgtgactgggtctctcagcgcgtgctgtcgggtggccttggccagaggggtggcctaggattgggtccggcgggggctggggcaccggggggggtgtgctctgggctagggcccggtctctgccgggtggtg

SEQ ID NO: 715686 - DNA, 358 bp, Homo sapiens
ggctggggattacaagcgtgagacacggggcctggtccctatacacattcttaaactaccacttataaatgagaacaggcagtattggtcttccggggtcggagtggtttcacttaagatcagggcctcccattccatccatatggtggcaaaagacacaatttcataatttgaaaggtctggaatagtattccagggtgtgaatataccacattttcattatccaatcttctggtggatgggacacttaggctaatttggtatgttggctatggtgaatagtctgcaataaacacttgagtgcagggaacttttggatgtaatgatttccactcctttgggtagacaccttgtagta

SEQ ID NO: 715687 - DNA, 431 bp, Homo sapiens
acttatgatgacggacggaggatgtgaagctcttaagtatatctggaaaccggctgcctctggaggtggtagcaaggttccacagaaaaaagtaaacttgctgctgatgaagatgatgacgatgatgatgaagaggatgatgatgaagatgatgatgatgatgattttgatgatgaggaagctgccgaccccgcgccagtgaagaaatctatacgagatactccagccattttatgcacaaaagtcaaatcagactggacaagactcaaaaccatcatcaacaccaagatcaaaaggaccacgaatccttcaagaaacaggaaaaaactcctaaaacagcaacaggacctagttctgtagaagcacattacagccacaatgcaagcaagtatagaaacaaggtggttctcttcccaaagtggaaagcccaa

SEQ ID NO: 715688 - DNA, 943 bp, Homo sapiens
ggacgcgtgggccagaacacaggtgtcgtgaaaatcgtacccctaagaagccaaaatgggagaaggaaaagactcatatcaacattagtctgtcaattggacgactgtagattcgggcaaaggtccaccgactactggccatctgatctatcaaatgcggtggcatcgaccagaagatgaacccattgacaacagatttgagaaggcaggctgctgcaccatgggaaagcggctccttccacagtatgcctgggatctctgcattaaactgaatagcctgagcgtagaactgctggtatcaccagtattgactatactcctctgtgggaaatttcgagacacagtcaacgtactatgatgcactattcaattgatcgacccacaggaacaacaaagcaacttagatacaagaagatcatggattgaccagggcactatctccagcgctcgacctgtgcatgctccgttgatatgttgggctgtcgcgcgatgtatggtggaaatcttcgtaagccgggtaactcttcccagatggacactggggccaggaccccgtacgagcccattgcagcctttcctgggcattaccacacctggggttgttgagacatcgaacctaagattggtgcgcgtagtatccactgatagctcgcgatttcccactttgaaggtggcaatacgcccatgaacaaatggtctccaattaacaagccagaaagttacttcggaggctgctaaagcgttcgggtctgacacgcggggaacatgtttcaatggcacaacctctatagcaacgtatagcagccacacagatatttgtgcgccctaactcaacgccaccccggcaaccgaacaatgtgtagagccaattatcaagacggctccacaacattttcccacgcgggatcagagggacacgtgttctggtttgtaaccaacacga

SEQ ID NO: 715689 - DNA, 465 bp, Homo sapiens
accctcatttcttgttactgctgaataagattccatgtatgaatatttattcacttactgaaggacatttggttgcttccaagttatggcagttatgaataaacctgctgtagacgtctggtttttgtgtggacctaagttttcaactcatttgggtacgtacaaaggagtgcagttgctagattgtatggtaagattatgtttagttttataagcgactgccaaactgtcttccaaagtggctgcaccagttggcatttttaccagcaatgaatgagagtttctgttgttccacatccttactagcatttggtattgtcagtgttttggttttttaccattctaataagtgtgtagtggtatctcgttttaatttgcaatttcctagtgagcatcttgatgttgagcatcttttcatatgcttcttggccatcttctttggtgaggtacctgttcagatccttt

SEQ ID NO: 715690 - DNA, 152 bp, Homo sapiens
gtacctgagcaggggtgggagcagtacacaagaggtctagccgggagattgtgtcacgattgcctttgtactactggaagtttgtatgtatgccatgaaaaagtgtatggcattttcagtttttgttttttatttattagagacaggagtct

SEQ ID NO: 715691 - DNA, 434 bp, Homo sapiens
ccgggcatggtggctcatgcctattattccagcactttgtgaggccaaggcaggaggatcacctgaggtcaggagttcgagaccagcctggccaacctggtgaaacctcgtctctactaaaaatacaaaaattagctgggtgtggtggtgcacacctgtagtcccagctacttgggaggctgaggcaggagaatcacttgaacccaggaggcagaggttgcagtgagccgagattgtgccactgcactccagtgtgggcaacagagagaggttctcgctcaaacaaactaaccgaattaaacatcataaccaagtgagattagttcttagaacataaggatgtaaggatgcttcattcaacattaaacaattaattaggagtgcaaaaggcttattgctatacttatgcgcaatgcatcacattaatagcaggg

SEQ ID NO: 715692 - DNA, 152 bp, Homo sapiens
ccctagagacagggttttgccatgttgccaaggctggtcttgaactcctgggctcaagccatctgcttgccttggcctcccaaacggtagggattataggtgtgagccaccacgtctggcctccaacttgattattgaatacagtctttctc

SEQ ID NO: 715693 - DNA, 494 bp, Homo sapiens
cccatcgccaagaaaccctcgtaacaaagaccaacaagacttaaaggaacaattttgtccagcaccccaaaaaataacattaacaaaggagaaatcttagagggtgtagcctccactcaaaatcaccaggcatgcaaataagcaggaaaatacctcccacaggtggaggaaaaatcaatggaaacaaaaccaaaaatgcacagccgatagaattaagagacaggaattttaaaacagctattataaatgtactccatgtgcttaagaatacaagcggaatacaagcggaggggccaaaagaaagaaaaagacactttcatctagagatgaaacatataatatatgaaaaaaatacagtggatgagattagcaacaggttaaacactaaacagaagaaaagatcagttaaggacataaaaaaactgtccaacatgaaacaaaaaaattgaataaaaaaactaacaaaacatcagtgaattgtgggacaatattaa

SEQ ID NO: 715694 - DNA, 122 bp, Homo sapiens
ccttcctgaggggcgggcccgggaacgccccctggaggggagggggtgacaacctcaatctagctcgcggtccagtcctccacctcgtcgagggcgacagctgccgaattccggatttctga

SEQ ID NO: 715695 - DNA, 255 bp, Homo sapiens
gatggcagaaggcaaagagagagtttgtgcagagaaactccaatttttaaaaccatcggatctcatgggaccattcactatcacgagacagcacaggaagaccaccatatgattcaatcatctccatcgggtctctccacaacacgtggaattatggagctacaagatgagatttggtgggcacagagccagtcatatcatatttgaggtagctgtatatttaagcatactgacacactcagcaccactaaaaaa

SEQ ID NO: 715696 - DNA, 318 bp, Homo sapiens
  misc_feature (80)..(80): n is a, c, g, or t
  misc_feature (202)..(202): n is a, c, g, or t
  misc_feature (233)..(233): n is a, c, g, or t
  misc_feature (246)..(246): n is a, c, g, or t
  misc_feature (252)..(252): n is a, c, g, or t
  misc_feature (260)..(260): n is a, c, g, or t
  misc_feature (264)..(264): n is a, c, g, or t
  misc_feature (302)..(302): n is a, c, g, or t
atcgggtagctgcggccgaagaggaactgcgagatctgggtgctgtcgacgcggaggggccggattacggtgagggggcngtcaccttgccacgtttccccttgacccacgtctggcaagggctttgaccgacggtgccgcatcgtcggatcccgccgctgtgctgagatcgccgcatgcttgcctggaagacggcaggtcngaccttcgtgggcaaatgggcgtcaatttgngatcggggccganacccanagcttgtnaatntgccgccgctaaacttgaacggcttggcccggttaatnaccaaggttcccctta

SEQ ID NO: 715697 - DNA, 399 bp, Homo sapiens
  misc_feature (149)..(149): n is a, c, g, or t
  misc_feature (240)..(240): n is a, c, g, or t
  misc_feature (380)..(380): n is a, c, g, or t
  misc_feature (385)..(385): n is a, c, g, or t
aaagagacagggtctcactctgttgcccaggctgaagtgcactgaagtgatcacagctcaccgtaacctctaagtcttggcctcaagaggtcctcccacttcagcttcctgagtaggtgggactacaggtgtgcactgccacacccagnctaatgtttaaaatttttttgtagacaaggagtcttgctatgttgcccaggttggtcttgaactcctggcctcaagcaatcctcccacctntgcctcccaaagtgttgggattacaggtgtgagccactacaagcaggctgccttgcttctcttcgtagtttcaccacatagggatgtattcccaaacaataacgctattcaagttgaggtttttttgttttttgtttttntttgnagacagagatttca

SEQ ID NO: 715698 - DNA, 334 bp, Homo sapiens
  misc_feature (37)..(38): n is a, c, g, or t
ggtctggtttatatactgagcgattagactccgggtnntgttggtttggtttagctttttgatgggttttaagggccccaatagcacgagaaggaggtaaaacgataaacgaaactggaatttaggtcagaaaaatagaaataaaattaacacaaaattgattagcaacactagatagaactttagaaaggtcttataaagatatggcgatagagaaaatggttaacgatgcagataagaatgtattaaacagagttatgagaacaaggtagtagggttcaacatttatatattaaaagtaaattaagaaatattaagtaaaatgatgtagctc

SEQ ID NO: 715699 - DNA, 111 bp, Homo sapiens
atctagaggatcttctaggtttcgatcgttacgcattttggctacagctattaatgccaatcaacttaaggccatacggggttaatgaaaatctagagtctcgggattgga

SEQ ID NO: 715700 - DNA, 123 bp, Homo sapiens
cgttgtgctgggaaaacctggtgtacaattgcacttatgttaatctaattttatctactttatgaccttgagcagcatggacaaagagcaaggatattacatgtgactttacaaacgtatgtt

SEQ ID NO: 715701 - DNA, 103 bp, Homo sapiens
  misc_feature (79)..(79): n is a, c, g, or t
ggctgtggggtcaggatgctctcgggcactagaagccagctgcctccacagagcggctgcacatgcgcaggatgtctcngacttgtccatgtccttcctgaag

SEQ ID NO: 715702 - DNA, 334 bp, Homo sapiens
ggtcgacgttctctgttgttttgttcagatctcagtctttggcagtcactgtgtccctgtatcttgggagtgtggccttatcagttatcctaccctacccccagtgatattctgaactctgcacgtctcaaccacaaaaaattacaaagtaaggtaaatacacccccctcctctccccagccgcagtgggctttaacaaatgtcctaagtgtgatggcatttttgctcttctccccacagattaaagctctcctccccccactccccataggtaagatgggagagaagggtctgggtaaatttcttacccttcctccagtgattgctggtcgac

SEQ ID NO: 715703 - DNA, 417 bp, Homo sapiens
gtaaaggaccctacaggggacacgttctgacttaaacaaagatgcgagaaggccaagaccaagcactatccctgtcagcagtgacctgttcttcagcatccccttggctccagtcatattttcacagatgtgttatcccatatggtcatccaatgctgagaggggatcatcgaagaggtaaatgtcagcgtgggagtacacggcccggcctaggttcacgcggtgcttctggcccccagacaggttcacgccctggggagagacacacacaggagtgggttacctgggaaatcttgagactcacaatacgtagaagcaggccgagtgtgctgtaatcccagaacttcgggaggccgaggcaggaggattgcttgaggccaggagtttgagaccaaggcttagcaacatggcaagatc

SEQ ID NO: 715704 - DNA, 917 bp, Homo sapiens
  misc_feature (199)..(199): n is a, c, g, or t
tctttttttttttgttttggtgatgagagagtaggagagaaaagaagagaaataaactaagtcagacgcctgcaggtgcccctatgttagagcttgctttcccagatccaagaacgccgaagagcccccccccctgggagaccgggctaagaggggaccccgtggaaaacctcaaattgcccatgacaggactccgccnagggcctccccgcttggaaagcccgcaaacaggttcacggcagagaccctctttataacgtctgtagtccctcctgcgattgaccagtcacccaggccctggcccccaaacagctactcagctgcttaagctggccccccagtaccgacccgagaccaagccagagaagaaccgagactgttggcccgggccgagaagaaggctgctggccaaggggacgtccccacgaagagacccccgcgtccttcgagccggagttaacaccgtcacccccttggtggagaacccagaaagctcagctggtggtgattgcacacgacgtggatcccactcgaagctggttgtcttcttgcctgccctgtgtcgtaaaatgggggtcccctactgcattatcagggaaaggccagactgggacgttctagtccaccaccggagagacctgcacccacctgtcgccttcacaccacggtgaactcggagagacccaaggcgctttggctaagctggtggaagctatcacggacccattaccatgacacgatacgatgagatcccccgtcaactggggtggcacaatgtcctgggtcctaagatctgtggctcgtatcccccagctcgaaaaggccaaggctaaaggacttgcccctaaactgggttaaaagtaccctgttgagttttctgtacataaaaataattgaaataataccaattttccctt

SEQ ID NO: 715705 - DNA, 563 bp, Homo sapiens
ggccagaatcacactcaaagacgtattattcaacaagttaaaacctagttcacaaatataccattccctgagttatagaaccatttttctgcccttttatctttccactagaaagtggtccggtttcttcaaatctggcaggttactattgtgccagccatttttcaatggggctgcttccctggttccccaacacaaaggttccctcaagttcatagaactcaaatcctaaagaaaatattgatcccagcccaaattttactgaaaactctcaccccatttatgcttgtctgtaaactgcagagcatgatgcaaagataaagcaaaactggaaagtgaagaaagcaagaatttggactattttctcaagaggcacatgcagagttcggtcaaaaagatgtcagaaaaaaagttaatttccaaaaacagcaggtgatcctacctgctacaaaaagcacatggtactgaattttccatgagaggttcacatctgagtccccaaggaggttttgttttttattggtaaatccaggcgggtaagtgttagagtgtgattctggccg

SEQ ID NO: 715706 - DNA, 206 bp, Homo sapiens
tggaagacggcaccaccaaagtcactcgcgccctggaggcaaccacagaacacatacggcaggagctggcggctttctgttccccagagccacctgccaagacctctactcccagaagacttcatccgaacgaccaacgtgatcctcaccatgaaccagacacagggcctgtgccccgagattccagatgcgaccactgtgtgtaa

SEQ ID NO: 715707 - DNA, 354 bp, Homo sapiens
cgtcgacgcgcgatcgacatcgaaacaacttgtttttggcattgtgaaggctccccataagagcttaccttggcttacaacgttagactattgaacagtgctgacactgttttgaccatgaactggctgtgtttttcattaggagacagccacaagcctgccaggaacactggcgagatggtgtgatttgaaggtgaagtggcctccatagtgcatgcgttgaacacctggtaactagcaggtgctggtgtttcgggaggttgaggatccctgagaattgtggctttgcttccaaaagtgcgaagtgggaggtgcatcgtgaaagtgataaccatctctacactgagtcgacgc

SEQ ID NO: 715708 - DNA, 435 bp, Homo sapiens
  misc_feature (13)..(13): n is a, c, g, or t
  misc_feature (133)..(133): n is a, c, g, or t
  misc_feature (167)..(167): n is a, c, g, or t
  misc_feature (208)..(208): n is a, c, g, or t
  misc_feature (225)..(225): n is a, c, g, or t
  misc_feature (290)..(290): n is a, c, g, or t
  misc_feature (316)..(316): n is a, c, g, or t
  misc_feature (382)..(382): n is a, c, g, or t
  misc_feature (402)..(402): n is a, c, g, or t
aagtgccctcggncattggcactgatgagaagtgcctcattgagatcttggcttcccggaccaatgagcagatgcaccagctggtgaagagaatcacaaagatgcctacgagcgggacctgggggttgaaatnatcggggaaacctctggccacttccagaagatgnttgtggtcctgctccagggaaccagggaggaggatgacgtngtgagcgaggacctggnacaaaaggatgtccaggacctatacgaggaaggggaactgaaatggggaacagatgaagcccagntcatttacatcttgggaaatcgcagnaagcagcatcttcggttggtgttcgatgagtttcttgaagacacagggaagccgattgaagccagnatccgaggttctgtcaattncaatgaaggggtttgggaaagggaaaaaggagg

SEQ ID NO: 715709 - DNA, 488 bp, Homo sapiens
gtattgcctctagaatggtgtactaccaaacaagtacagcagcctgtgtacacacacagcacagctacctgacatagaaggaggaccatcaccttcagtgttgatttatatccatacttccagtctccatgttgtagatccatagttcttctctaggcagatacccgtcatataatactctgactatgataacacttttagacgccccagacgaacatgtggcgcccgtcgctgacggctacgtggccgctgcgctcagcggggcaggcaagctccatggactcatagctctcgaaggctggaccaggcaagtcgtcagcccgccgctcctcgtagccatcagccatcttgaggctgcacttttgctaaccaacaatgcccacacccgcgaggggagccaacaaaaacccaaggaaaaggagaagaactgcacagcggctcccggccgggagcacgatgtctgctagtcttgtacctgcattatcaga

SEQ ID NO: 715710 - DNA, 787 bp, Homo sapiens
  misc_feature (325)..(325): n is a, c, g, or t
ggagatgaaagagatagagacacgaaaacccttcaaaaaaatcaaggagtccaggagctggttttttgaaaagatcaacaaaattgatagactgctagcaagactaataaagaagaagagagaagaatcaaatagatgcaataaaaaatgataaaggggatatcaccaccaatcccacagaaatacaaactaccatcagagaatactataaacacttctttgcaaataaactagaaaatctagaagaaatggataaattcctggaaacatacacccacccaaagactaaaccaggaagaagttgaacctctgaattaagaccaantaacaggctctgaaattggaggcaataattaatagcctaccaacaaaaaaaaaaaaaaaaaaacaaaaaacttttttggggcgcgctcgggcccgaaaaaagtttttaaacctctctgtgttggggcgcgggggcccattgttagggaccccgggccatacgggggtctccccaagaaaaccccggcgctagacaagtgcgggtgggtttctcaccccataaaaaaaaggcgccggggggcaacccggggtgttctggaacaaattccatcgaggcgggctcccggggggcatacgggggtctatcaacaggggagcccagcggaccgaaataaaaattacccccccccgcggtagaggaacacaagaaaatacacaaaacaaagacagagcaaagaagaagatacgacagacaacacgagacataggtaagaccaatagaaggcacaacaagagagaaggc

SEQ ID NO: 715711 - DNA, 415 bp, Homo sapiens
ccggtgcacagttctcacagtcattccagaagctttctccaggctacaaaaaagttattgaaatagtgcagcggttagggcattatttcataaccgagttaaccgtctatcccaaggcgtgaacatttagtaagctgatcgtcagtgagtcagtactttcgtttccattcttttcctttttatctattttcttcttgtttggtaagttaccctttccattttagcctatgactagtgggcatacaaacaaagtttgggtctgcttcttgtctgttctgaatagctgtctgcttttgtagaaggcagaattgaaaacagcagtcacgtgatgttctttcactgttaaggttacatcatgacacaaagctgagttgcgcacacgcgcaaaatacgcagcagtgctacttcctgccat

SEQ ID NO: 715712 - DNA, 313 bp, Homo sapiens
gaaattatgtggggtgagctgggaggctgatgagtggattattttgagtgtcaggagttcacagaccacgcctggccatcatggtaaaatccctgccactactaaaaatacaaaaatcatccatgtgtagtgacgggtacctgtagtcccagcatactcgggatgctgaagcatgagaatcacttgaatctgcgaggcggcggttgcagtgagccgagactgagccactgcattccagcctggtcgaccgtacgcgataatctctgcctcagagaaacaacaagagagccaagaacaaacgggggggggcgaa

SEQ ID NO: 715713 - DNA, 328 bp, Homo sapiens
agtctcactctgtctcccaggctggaatgcaatggtgcaattttagctcactgcaacagcggcctcctgggttcaagcaattctctcatttcagcctcctgagtagctgggattacaagcgcgtgctgccacatctggctagcttttgtatttttagtagagataggtttcatcatattggccaggctaatcttgaactcctgacctcaggtgatttgccccccttggcctctcaaagtgctgggattacaggcgttggcttcaaatttttaatatgtcccagggttaatcagacagaaagttttggagataagggctttttagagga

SEQ ID NO: 715714 - DNA, 275 bp, Homo sapiens
gcaccgcgggcctccgaattgccaggtgttgggaagtccggacaccctcctgatcttctctgtaacatgcacacttaggcctgtgtcagtgtgctggaaccacatcaggccgggcctcttcctgggacaaaatgctttctttttctttctttcttgttctttctctttcttgcttttgcttgctctttctttctcttttcccttccttccttccttccttccttacttccttccttccttccttcccttttcctttcttttctttctactgtgac

SEQ ID NO: 715715 - DNA, 1130 bp, Homo sapiens
gtgctatgtgttaatgggaagcgttgggacatgagttggtacgtttgggggttagctagggatgggatggtggtttgtcaagggttcgtgcagagtgggcatgggggtgcaattggggtggaagcgtaaattagactttctttcacctggtaacatgatgctgggttgtcttgcgcctggggagctgtttgtttacataggggctccttaggagggggtccccctttcggccgggagggtggttacaccgtgtcttgacccggggccaaggatccagggacgccgagcccttggggcccaggccttatggtccgccaaggaacagtcaacggcagacccgttgctctagcgtctcgtagcggctgaaatgtgggacaagcagagtcccaaggaaacgctaggcatccgtgttgtgagggtctcaccgtgtgattgcagcggtttctctgggacatttggctttatgccgcaagcatgtcagtcgtcgcgcatactcaggacagtctcgaagatgcgttgtatcgtacggattacgggcatgactgccagttcttgcagtctcgttgactgtcgtggtgatacgtgccccggagagagcactcagccgagtgcaggtgggggctctcgaggggaaaggacgactggggcacgaccgcagtcagggcactgcgagctggaatcgtcggagaggggggccggacaccccggtcagcctggctatcaggctgcgctgacggtgtctgttacccgccatcgctccgctcccgccgagccatccaccctcgagggtgcctccgaatctggtgccttcgagccctaggccccgtgctgggtgaaacaggtactttcgggggtacagtgaagcggctcggaaaagcagacgtgacacccatgggcccttgtgctccccttgcttggtgataaggtgcagacatgccattgagtgccggtaaacactcgtacacggactagaggtgcctagctcaggtgatatgtcccaagagccataagggggtggcaataggggagggagaaagggtagttcaaagagtctagtcttgagatctggattttgttccccctttacctagctgtgccccctctggttatacatctccgggagtgccagg

SEQ ID NO: 715716 - DNA, 712 bp, Homo sapiens
cggggggcgccggggcaagaggggcggggctccgcgccccccggtcggccggggcccgaagggcgcagcggggagaagagcgccgggggtacgggccctatgccccgtagggagcaggcggggaaagggggccagggagagcggggcgcacttgcgcccgggcggtgcccgcaggtgcgccccagtcggggggggtgaggcccgggcgcccccgggccttggtgggccgccctccacaaaggcgcgtaggtgggggccggggccgccccccccgggggggcgggggttccgattccgcccgcagagggcccttcggcccgtggagggccccgaggcgagagtaggcaatgtgggttgttcccccccgtgggcccctggcgggggccgggggcgcccggggaagcgcccaacgcggcatgccataggcttgggctgcgccgcccagggcagaatggggcggagttgaacagtccccaaagggccgaaggggggcacgacccgccggcgggcggagggagcagggtgacccgatgccctcaggggtagggcacgaggaaggggatggcctgcggggtgtcccccgggccggcggacccgcgtgtggtgccgccccggtcccaaattcgccccggggaggaacccgctcggggaagaggctcttttttaaaaggaccccgaggccgggtccccccccccccccctcgtgccgaat

SEQ ID NO: 715717 - DNA, 830 bp, Homo sapiens
tctcccaggcgacggtccgagaagatggggagagaaggacagggaagagataatagtagcagaatttcaaaaaaaatcaaagaggcatttgaagtcttggaccatgagtcgaataatacagtggatgtgagagagatgggaacaattatcaggtcataaggatgctgtcctacggaaggagagctgcatgatctgatggcagaggtagaggaagaagaacctactgatacatcgattcgaaaaatttcttccggtgatgaccagaaatactacttagaaagaaaatacagcccaatcccagaagatgtccttcttcgagcttggaggtttaagatcagctaaagtgggtttcttactaaggacgagctgatcaagtatatgatgaagaaggtgagccttttcctcacgaggaactggaagaaatgtgtgtctgctgcaatggatccagaatcaaattcacttaattacaaggcctattataacaatgatggtgatagatgacacttacttgtctaaagatacttctgatggaaagacacacttttacgaaattgttgtcttcggtaaattccccatcttaatcttaggatccctattatgtggcatatcaatacctgtgtggacataactattttcagacacttgtgttttaaagaatgatcgtaaccttaaacaaattagttatgtctaccttacgaatggttaattactaatttttaaacctatttctaacctttaacatagcatggtggggtattcacaaaaaatcagggcctcgttaatacgggcaagaaagcactccacgggcgccatacagggcacactcaagg

SEQ ID NO: 715718 - DNA, 153 bp, Homo sapiens
tcgtcgcagccaatgatgcatgaccttctctgggcctggcgaccccagtgcctcactgctgagccccaacgacgtgtctccagctgccttgggcagcaggcgggacctgtgccttccccacatgacacagagctgcccccattccattgcaca

SEQ ID NO: 715719 - DNA, 776 bp, Homo sapiens
accttggggtgagaaatcttaaagtgttttggggggtctgttccctaaagaaggccaggccagtgcccccaagtttttggtttcctttaagaaaaagtgtgtgttctgtgtgtgtttcgggaatgggggtgtctaagttttggttcttgaaaccgtagagaagccaaggccttccctccccatcagcctttcttccaagaagcagcagatcagcctccaagactccttggtagcagggccagccttgccttggcaaaccaggagttctgcttggtagaccctgcaccccgttagaaagccattggggtggtatgttcatttgcccccccccatccttagtaggacacctgcaccactttttaccacattttctgggaccatcagagtacagatataccctcccattcagacaaatccaatctatgggaacttggggctgctaaacaagacatatttgggggataattattcaacttccctcaaagataatagaaaaagtggtgggtgtgttggctcacatctgtaatcccagcactttcaaaggccgtggcaggtggatcacctgaagtcaggagttcgagaccaacctgaccaacatggtgaaaccccgtctctactaaaaatacaaaaattagttgggtgtgatggtgagcactggtaatgccagctactcgggaggctgaggcaggaaaatcgcttgaacccaggaggcggaggttgcagtgagccgatattgcgccattgcactccagcccaggccaacaacagcaagactc

SEQ ID NO: 715720 - DNA, 227 bp, Homo sapiens
gcagcacggccaggcgctcgtaggtaggcatcgagcgctccttacgcgttgttgtaatacaatgaatccccttagctcatggtgtataggcgtacgctcagctccgttttgctcattatattgctcggtcaagtctgctcacgcgagcctgaaggatctatcggacattctttggaccagtgcccctctttcccgcaccgatttcgaggcgctctggtctcccatcc

SEQ ID NO: 715721 - DNA, 725 bp, Homo sapiens
  misc_feature (313)..(313): n is a, c, g, or t
ttaggccacctgtgacatagtcaacgttgatagtcctccgcgagagtacatatgtgatagagtggccacgcggtgttcacagagaggccacgacgaagtgaccatatatatgtcgcgatacatattgtgtgagatatagtgatgacaagagctatatatacactcaccccgtatacacgtggattacaatgtgtgtgttcacacacgctgtgcgtccaccggcgcgcttgttgcgcgctcgcggcgcggccatcgacaggatgtttatctttttcacgatagtgtccacacaggtcaccccccgtgtgttgtncccacgagacagccgtcttgttttgcacagacacggggcttctgtatactccgtcagcgccgcgacgtgatgtgaatgtctccagaccacacctgtccgaagctgcctgcgttgtatgtccccgtgtccacccccgtcacgcgcgagtgagtaattgctccagaccaccctgcccgcaggtggtcttgcgtcaacgtccccgtgtccaccccgtctacgcgtccaaaccctcacgccggagtgatgtaagtgcgtccaaacacccctcctgaggtgtgtcgtgctctcctcccccttccccccgtccaccaccggtatgatacatttctcagaaacttacaggacagaaaattacatataagtgaaatatgtataacaaatctaaactgttatacaacaataaagaaaaaaa

SEQ ID NO: 715722 - DNA, 262 bp, Homo sapiens
agcctggtttctgcagtaagaccaactccatcggaagggaaaggtttacagtcaacatctgccactccctcctctatccctcctcccgcttgacgtgaccgaggagaagctgcttcaggatgctagaggaggaccaagctgggttacgcatccccagtgcagtctgggagagcctcatgcagaactggatgccggtggacaaggatgtaccgtctacgacgtacctgtctacagcgacttctaccggaggatagcagaacag

SEQ ID NO: 715723 - DNA, 1039 bp, Homo sapiens
  misc_feature (3)..(3): n is a, c, g, or t
  misc_feature (71)..(71): n is a, c, g, or t
  misc_feature (220)..(220): n is a, c, g, or t
  misc_feature (486)..(486): n is a, c, g, or t
  misc_feature (1001)..(1003): n is a, c, g, or t
  misc_feature (1007)..(1008): n is a, c, g, or t
ctncacagtctcgctcccacaaatgaagccttccgagccctgccaccaagagaacggagcagactcttggnagatgccaaggaacttgccaacatcctgaaataccacattggtgatgaaatcctggttagcggaggcatcggggccctggtgcggctaaagtctctcccaaggtgacaagctggaagtcagcttaaaaaacaatgtggtgagtgtcaanaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaacagttatttagagaggatgaagcattccgcttgaagcacttacaggaggaatgcaccacggcagctcncccgccaatttctctcagatttccacagagactgtttgaatgttttcaaaaccaagtatcacactttaatgtacatgggccgcaccataatgagatgtgagccttgtgacatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggctaggaggcttttatggggccctgtccaggtagaaaagaaatggtatgtagagcttagatttccctatttgacannncctnntgtgtttgtaataataaaaccaaagaaacat

SEQ ID NO: 715724 - DNA, 815 bp, Homo sapiens
  misc_feature (28)..(28): n is a, c, g, or t
  misc_feature (181)..(181): n is a, c, g, or t
  misc_feature (226)..(226): n is a, c, g, or t
  misc_feature (251)..(251): n is a, c, g, or t
  misc_feature (255)..(255): n is a, c, g, or t
  misc_feature (265)..(265): n is a, c, g, or t
  misc_feature (269)..(269): n is a, c, g, or t
  misc_feature (272)..(272): n is a, c, g, or t
  misc_feature (275)..(275): n is a, c, g, or t
  misc_feature (280)..(280): n is a, c, g, or t
  misc_feature (286)..(286): n is a, c, g, or t
  misc_feature (288)..(288): n is a, c, g, or t
  misc_feature (293)..(294): n is a, c, g, or t
  misc_feature (296)..(296): n is a, c, g, or t
  misc_feature (299)..(299): n is a, c, g, or t
  misc_feature (304)..(304): n is a, c, g, or t
  misc_feature (309)..(309): n is a, c, g, or t
  misc_feature (311)..(311): n is a, c, g, or t
  misc_feature (313)..(314): n is a, c, g, or t
  misc_feature (521)..(521): n is a, c, g, or t
  misc_feature (630)..(630): n is a, c, g, or t
  misc_feature (651)..(651): n is a, c, g, or t
  misc_feature (659)..(659): n is a, c, g, or t
  misc_feature (681)..(681): n is a, c, g, or t
  misc_feature (709)..(709): n is a, c, g, or t
  misc_feature (715)..(715): n is a, c, g, or t
  misc_feature (718)..(718): n is a, c, g, or t
  misc_feature (732)..(732): n is a, c, g, or t
  misc_feature (739)..(739): n is a, c, g, or t
  misc_feature (748)..(748): n is a, c, g, or t
  misc_feature (751)..(751): n is a, c, g, or t
  misc_feature (782)..(782): n is a, c, g, or t
tatactattctcaaggcacatctgatgnatatattttataacacagtaggtgtcaaagtatgtttaacatatgatttcttcaggatccctcccctttttgaattccaaatggaggaactgaaagtgcgatgtaaagactggcgatccatattctatctttggcagcttgtacaagcactantgtaaatgtaatgtaaaagaactgtaaactaggaacttcttcagnttatgaaacaccattcaggactgcngctncttgagtgtnttcntcnttnaaggnattaancntttcnncnccnggagnacgcngnannctagaaagggcaccgccagaagcaccagtggggccgggtatggcccttccggaaggaccaggccccccaaccacacccttggcccagcccatctccatcaacggaagcgggaccagacccaggcaatccacccaccagaacagcatccccaacagcccctcggcgacgagaccgcccacgacggggagtactgtgatgagattcgcnggcatcagtgtctgcagtctgatctgattctgtattatcaagtaagctgtatggattgctgtctggatctttgagcacagaactgatggaggatttgccaccacggggnccaccacgacctcgacccccngaaacacntctgcctcttccccctgggcgnctcctgcggtcacgctgatgtcggcggnctcgancancctctcctgccaangaccaancactcagcncgnctttacgcccagattccgtttcagagggggnagacagctcagaatttgtaccataaccgggggg

SEQ ID NO: 715725 - DNA, 94 bp, Homo sapiens
  misc_feature (66)..(66): n is a, c, g, or t
ctaaagcaagcagcaaaccagctacaagtggaccttctagtgcagttgttcctaatacctcatctnggaaaaagaatataactagcaaaacaga

SEQ ID NO: 715726 - DNA, 291 bp, Homo sapiens
aggttcctggaggggggggcctgggggaggggttggaaaccctgggccccccctcccccccctgaattgttttttttttttcccctcaagaaaattttccccggcccctgggatgggcccccaaagtcattaaaaaattttatgaaaatttttaaatgtttccccgctcctaaggcccttccccagggtttagcatgtcaaagggggggattgggaaaaagctgaaaaaaaaaacaaattaaactatcccccctgggaattttttaaaaaaaggtttggtcttttcatgca

SEQ ID NO: 715727 - DNA, 294 bp, Homo sapiens
tcaaccagaggtctcgggaatccacaacccttattgtcctgggtgtgaccaactccaaaggctaagtgatagtgactcatcaatgttgggtccctggtggggtaccagtttatggttcctaagtaatagtgaccctttcacgtcctggagtcccgagtggaccaatcggaagcctaagtgacgatcaccctcgcatgtcctaggtccctggggtggaccctatcatggacccccatgtgatggttacccagtggtcttttagatcctcagtagaacagtccagaattgccccga

SEQ ID NO: 715728 - DNA, 899 bp, Homo sapiens
gctgctggtgctgctggctgcggccctatgccacggtccagcggctgcgtgggcgcagccactcagtgagggcgcccgcagtgtgcctgacaagaacgtcaaccgcagccagtcctttgcctgtgcggccccgaaagaaggggcccccggttgctcccacccaatgctgctccagctcgtgcctggctagtgccaacctggcgtgatgagcctgtgtgcctgacgccgagcctgagtgatggcctgctgggtggtacctgggcacagtgccggcgggccattgacctggcctggcagcttggacacgggtagttgccggcagtgtgaatgagcatcgccggccatgctggagctgtcctccatatgggtagtgggagcgcctggtgctagctccaggcagtgcctccgtgagtggccagctccaaatcactcctgctcacttgtacaatgccccagatgcccggggcccgtgcgttgactcccacactgatgtttgacacctcaggtggaaacaccaaactgaatagccattcgatagcacttgtgctggtggatggttggcttgaacccacgtgcctgcaatgcatcattggggctatagtcaagctgtactttcatgcacccagcttgccaaagcatcaagcgggacatggagtattctagagaatgatcccaagagccaccgtttgtaggaaaggactatggaactagaccaagtcaataagtgcctcattgggctcccttcatcaggggcggagttcgcaatatactaaatagtgcccaggcatatgagcactcggctgaaaactagatctctacagctcacacaccgtcacgtacaagtacaaatacagcaacgccacttgagagtagccatacaagatacggactaggagcgg

SEQ ID NO: 715729 - DNA, 141 bp, Homo sapiens
tgttcgctttgtctaaatgtgaagtcttgaggcggcggtagttgcagtgagccaataccacaccactgcattccagcctggatgacagagcgagactctgtctcaaaagaaaagaaaaagaaagaaagacaaagggaaaca

SEQ ID NO: 715730 - DNA, 401 bp, Homo sapiens
gagaggagattctagcaaatggaacagaaaacaagtagtcgatcctagtttctgacaaaagccaaaaagagcaaaaaaaaaaagggaaagggcatcacataagggtaaagggtccaattcaatccaccaagaagatctacctatcctaaatatatatgtccccaacacaggagcacgcagattggtaaggcaggttttaagagaccttcaaagagacttagattcccatacaatagtagggaaggtcttaaacaccacagggaaaatataagaccattcatcaggagagaaattcaccaaagatattcaggaccggaacccaagaggggctcaaaggaaccggagagaaatctatataactctccatccaaaaacaagagaatatacattcttctcatcct

SEQ ID NO: 715731 - DNA, 122 bp, Homo sapiens
gtcttctcaccagcatcagctctctgcatcatacctcatatatctcatgtcatcagatattaccaacgaggagcatgtatgaagtggatcactactaggctgtagaacgaggcggtcatcta

SEQ ID NO: 715732 - DNA, 211 bp, Homo sapiens
  misc_feature (30)..(30): n is a, c, g, or t
  misc_feature (39)..(39): n is a, c, g, or t
  misc_feature (47)..(47): n is a, c, g, or t
  misc_feature (115)..(116): n is a, c, g, or t
  misc_feature (119)..(119): n is a, c, g, or t
  misc_feature (141)..(141): n is a, c, g, or t
  misc_feature (145)..(145): n is a, c, g, or t
  misc_feature (150)..(150): n is a, c, g, or t
  misc_feature (166)..(166): n is a, c, g, or t
  misc_feature (168)..(168): n is a, c, g, or t
  misc_feature (173)..(174): n is a, c, g, or t
  misc_feature (178)..(178): n is a, c, g, or t
  misc_feature (183)..(183): n is a, c, g, or t
  misc_feature (185)..(185): n is a, c, g, or t
  misc_feature (196)..(198): n is a, c, g, or t
  misc_feature (204)..(204): n is a, c, g, or t
gccagcaccgacctagcctaagccgtctanaaccacctnagcccctnaggaaacctgtggtcacactgggccctcctcaggaactctccctgcgcagaggcgtgtcttagcactnnccncctccctagccccttatttggnggcngaagnggcctccaccccttcncngtttnnaaanactcngnggagaaaagannncttcanggagtag

SEQ ID NO: 715733 - DNA, 396 bp, Homo sapiens
  misc_feature (303)..(303): n is a, c, g, or t
  misc_feature (396)..(396): n is a, c, g, or t
aaagagtgtaacctttgataaagagattaggatgagtaggtgaaatcccaatgctatttattcatcaagacaatggaagaatgaccctgaaggcatttggagatttaaggctgccagggccttgggaacagaacaatttaatgactctgctctgtgccttgtgttatgttgatccttggctgccccagttgtggctcaagtggccccaggcatggcttaggctgccctctggaaggcacaggtagtcagtgaggacatggctatctccacctagatttcaaaggacgccgtgtggggccttgnggcccagaaagagaacagaggtgggaccaccgagaaccctcactagggctgtccactagggctgtgaggccagcatcatcacagaggccctcn

SEQ ID NO: 715734 - DNA, 337 bp, Homo sapiens
tttttttttttggagacgctccgtcacccagttcagtggcatgatctcggctcactgcaacctccaccttctcggttcaagtattctcctgcctcagcctcccaagtagctgggactacaggtgcacgccgccctgcctggataattttttgtattttcagtaggggacagggtttcaccttgttgcccagactggtttcgatctcctgagctcaggcaatccacccgcctcagcctcccaaagtggtaggattataggcatgagcactgcgcctggccaaccattttttatattatttggtatctcttctgaatgatcatatatagttgacagtct

SEQ ID NO: 715735 - DNA, 923 bp, Homo sapiens
acccggtctcctgtgggggaagcaaaaaaaatttttagtagaaaaggttccagccacctgtttggggcaaaagtatccaagcagctggtttttccccgccaaaatgtatcaacagtaaccagagggttgcacccccacctgtgattggtcacgagagacttgtctttttttttcctactaggagaacaaaagtggttccacccttctgactgctccaccggttgtgtgggagccaaccagctcccaagaatttgtgtgggtaggcataacaaagtcccacaacgcctcccggggggttcaaacacagcatgtattggcacgaagcataccgactgttcccacaattaagctcgggggacccacacacaggcccccgccccccacccgcccgcggcatataatcttcattgtccacattctccctatagaacgcggggggttccaccgcctggctaatacacaggggaagtggttttatagatcattcccccacccctatgggggactcgcccaccaacacggggagacgacaccaaacagatacggtcgcgggatcgaacacaaggcggcagaacagctcctcgcagactcctcgcggcctccacccaagagagggcagagacatgggtttaaagataggcagcaccttcttattatagacagaattatggcacccttattaagacaatatttgttctcactcaacaatgcctcccggcgcccacgttgtggttccagcccgggggaatttatcctccagaccctcgcaacaagcgaagcgagagcacgccctaaacgtatgtagaacacgtatgccgagggaacgtccccatcaatgagagcgaaagcactcccggttgaataattcaaaaaggagcaccatattttaaaataaaaaataaaaaaaccaggcggacataaca

SEQ ID NO: 715736 - DNA, 816 bp, Homo sapiens
tggaaacggagtctcactctgtcgccaggttgggcgatctgggtcactgaacctctgcctcaggggttcaagcgatttccctgttcagcctcctgagtagctgggactacgggcacacgccaccatgcccagctcattttggtatttggggtagagagggggttcaccatgtgggccaggagggcctccatctctggacctggtgatccgcccgactcggcctcccaagatgcggggataacaggcgtgagccactcaagtcgggcgagagagatggtccataaatagagggtgggggcgggtgtcctatagcccaaagctgtggtgtcccaggttctcgtaattgcgcaaaaataatgtggccccccccaaaaaccctccaaaaaagaagaaaagcaaagaacagcagaagacaaaggaaacaaccgatgaaacgaagttagcaaaaacagaaaaacgaggcggcggcacgaccgccacaaagcaacatctcccccgacggagggggacaccgaagaagagaggcacaaccaccccttgtgttttcatacaagaggggccgcccaccaatcagaggacgcaggccctatcaacaccgaaccacacgcagcgcgtcaaaacaccaaaccaaacatgatgcacaacacctcacctcaccgtcaccgctgacacaaaacaccccttcacgcggggtgaccactggcgccaaccaccacacacaacacatacacctgcagcacaacacatccggagccaaagggacaaccccacgactgagccatgacaaaacgacacagactctcaaacaccatacgg

SEQ ID NO: 715737 - DNA, 187 bp, Homo sapiens
tcagtcggaccaatcttcatgctacagtcgcagacctaatacaatgtaatgctatataaatagttgctgcggcacacggaaacttactggaattttttttccaaatatttttgatccacagttagttgaattcaaaggcatggaacccagggccagagggctagccgtactttgaactcagtaggat

SEQ ID NO: 715738 - DNA, 724 bp, Homo sapiens
  misc_feature (10)..(10): n is a, c, g, or t
  misc_feature (77)..(77): n is a, c, g, or t
  misc_feature (88)..(88): n is a, c, g, or t
  misc_feature (103)..(103): n is a, c, g, or t
  misc_feature (121)..(121): n is a, c, g, or t
  misc_feature (138)..(138): n is a, c, g, or t
  misc_feature (145)..(146): n is a, c, g, or t
  misc_feature (183)..(183): n is a, c, g, or t
  misc_feature (206)..(206): n is a, c, g, or t
  misc_feature (238)..(238): n is a, c, g, or t
  misc_feature (277)..(277): n is a, c, g, or t
  misc_feature (309)..(309): n is a, c, g, or t
  misc_feature (316)..(316): n is a, c, g, or t
  misc_feature (327)..(327): n is a, c, g, or t
  misc_feature (330)..(331): n is a, c, g, or t
  misc_feature (333)..(333): n is a, c, g, or t
  misc_feature (363)..(363): n is a, c, g, or t
  misc_feature (386)..(386): n is a, c, g, or t
  misc_feature (418)..(418): n is a, c, g, or t
  misc_feature (515)..(515): n is a, c, g, or t
  misc_feature (578)..(578): n is a, c, g, or t
  misc_feature (609)..(609): n is a, c, g, or t
tctttgagcnccttttcccagtaatctcaggaatgtatagagccccgccccacacttcatacccgccctaggccttnggtgatgaggnccctcacagcttgtncaatggcatccctgtcgntaccaaacatcttcagnagctcanncggcttcccacttcttggtacccggttaactgccagntgggtgacagtgatgccaggttngcccactactgcactggacacagcctcaccantgccaccttcataataatggtcctccacggtgaggatcntgcccttggtggcacgagcgctgtcgagaatnatttttntgtccaggggnttnntngtgaaggggtccagcacgcggatgttgatnttttctttcttcagcagttcggnagcggccaaggcctcgtgcagggtcaccccanccccgataacggtcacctggtcatccttgctcttcaggaccaccttggctttttcgacctggaagtcctcattgttgttatagatgatggcattttntgggcggttggtccggttgaagcagataccctttgtattggcggctagttccactgctttttntgtagcaacgccatcacttgggtataaaganagttgatgtggggattgaccgaaacatagccagatcttctagggccatctgggagggcccgtcttccccgatggaaacgccgcaatgggagccgcagaggttgatgttgctctcg

SEQ ID NO: 715739 - DNA, 741 bp, Homo sapiens
aaaggaaaagtcgaaaaagcccagcgcccgggtagttggtgttttcccctttccctttctcgtgggtcattgcgtgtgtgtattttttttctctcaacacacgccgtgtactttcctgcaccgcgccgcaacgttgggctccaacctttgttcttaaagaaaaggaaacgccttcaaatgacggcccagacgtcgcccgaactttcagtcggctggagggggaagtggcgacttcttgcaactgggtggcaggagtgtctctactctctccttgcagggagcccgagaggagcaagtgggaggtttttcctcctggaccgaatcagctggagaccagcaggtccctaagagaggaagaaatggtcttcaggcgatcctggatttcatccctacctcatcacccttcaagagcccgcgtttggtttggaatacgtaactgggctttgagaacgtttgtactgtgtctggtacccgcatttatactcgggatgtcaagatataggacttaaaacttcaaaaattttgacctcaacaacattctccccctgccctccactcccatctccaggacatattcctggagcatatgggacttcggtcgttttaatttttggttttgtcgcttctctcttttctcccggaccctgccacaaggggaacattttcctggagcagccatttgattttgggggatggaaaggaacaaatagatctaaagcctggcaagtttatcctaaaaaa

SEQ ID NO: 715740 - DNA, 1481 bp, Homo sapiens
gctgatttggtgctcagtgggagtgccgcagtgtctaggctgactcagtctgtcccggctgaaccttacgtgccccgtcctgttctggcccgatgttgccttgttggaagatctcttgtccccgaggtagggacttcttttgtcgaggaaggcggggattcgttagaattggagactgtttgggagagtctgcgttgcgtcctcgtgtactctgtaggtcgctacgtgtacaagacgatagccggcagcctggcagtcggcgtcgcttgtcatgatgggggacgaagctgggtgtctcttcatgagctgtcgtagtatggtcgcacgcactgtctggagatgactgtctggctctgaggtcgtggatcgaggaaggcataggacgtaccaaaagaatgcgcgactttcaagtacttggcgcactcaagaacttgtaccgtgacgcgaaaggaaggcgtggtaagagtatgccctgagggatttcgtcgcgaaaggaaatgacctcgaccaacgtggactgtgatcgcgggcgataccattgtaattgaagaacgaacaagcgtcgttttagttctacttggggcccctaggcatgagccgcacggtgacatgggtgccagccgttgtaccatcctttcgggcatttcacttgtgaggcgcagttaagcgactttctccgtgcggctaatcgcacgcgggacctacaacgattgcgtgctaggcacttcgccaggaaaatcaggggggcgaaggagcttactaagaaactcgatggaatggtgcgaccccggaagcggtcgtcctgtaatcacgggttgtttgttcacattctctctctactgtgatgatcgcgtaacgggggctcggtccttggtgcctcgtttttggccacggggcgccttggggcccttcctgagatccatcggcgtagcagcccgtgccccccttgggacttgcgtttcccttaggcacaatttggcccgcgttttctcccaggacggccgaggcattcgagttgactccgacttcggcgggtgggtccgtaggcctccagggtgggcggccctcgtgtgtgggtctaggtgagaagagttcccccgttacggacccggcccgggggaattccggttggggggtgtggaactcttaggagagcgaatccgcggagaaggcggccaaagctgctttgcgacggaccaccttaggtggtttgaaatcacgcgagccatcgatcgtgtgtggcgtgacctcaatgccttggccttcgcggggaccacctcgtacacaatccatccgcataaaggcaagtccccggtggaaaagcaacgccgttttagggagccctgcgcttcaaccaacttttttggtgggcatcgtttggaaaacgccaccatagtgtgctccattagaagcccagaagcactagtggagaaagccgcatttaccccctttgtgaagccgtataaggtgtgtgtggcaca

SEQ ID NO: 715741 - DNA, 330 bp, Homo sapiens
  misc_feature (108)..(108): n is a, c, g, or t
tttttaaaataaatgcgggagccggtaaagcattaaatgcaagttaaaatgtttcagtgaacaaggtttcagcggttcaacttttataataattataaataaccctgntaatttttttggacaatgccagcatttggatttttttaaaacaagtaaattttttattgatggcaactaaatggggtttgtagcatttttatcatacagtagattccatccattccctatacttttctaactgagttgtccaacatgcaagtacatgtttttaatgttgtctgttttttgggcggttccggtaagtttgctattaaaatcccttaaactata

SEQ ID NO: 715742 - DNA, 1276 bp, Homo sapiens
  misc_feature (672)..(674): n is a, c, g, or t
  misc_feature (677)..(677): n is a, c, g, or t
  misc_feature (679)..(681): n is a, c, g, or t
  misc_feature (690)..(690): n is a, c, g, or t
  misc_feature (696)..(696): n is a, c, g, or t
  misc_feature (702)..(702): n is a, c, g, or t
  misc_feature (706)..(706): n is a, c, g, or t
acccccacaaccggagccgaaaagagaacgagaatcatagcgcttaagtagaggctggtgttgaatcggccgagggcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtnnnacncnnnacacacacncacacncctacncacnacaccaccacccacggggggcggggagcgcactaacagaagaataacccccaagagggaggcgacaccaacaatgatatccgacgtccacaccccaacgcgtcttcctggattcaaacaaagggtggggccccacaaataagagggcagagcagcaacacacactcaccaccgcaaagagccgagggggcacgagcgtcatgctaataacaaaccacgcggcgtcgcgaagcacgcggcagaacaaacctaggtgaaccaacacgacggacacaccctgttgagcagaaacacacaccacccaacacaccagggggcggggcagcacccacacacggcgggagaccacaagaaaccaccgccgaacagcaacgatactaacgacgacgcaccaaaggagaccacaccaacaacaaccatccaccgcgaccaccaacaggcgagcccaaacacacccagcggacccatcaatcacgacggcgccccaagacagccgcggtgcgccacaagccgaatcaagccagcatgcacaaacagcacatacaccccaacaagagccgcgccctcagaa

SEQ ID NO: 715743 - DNA, 630 bp, Homo sapiens
atccttaattaaattaatccccccccccccgctctttccctaagcgcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaactgaagaacaaacttatggcacgtagcatgcggcataatatttc

SEQ ID NO: 715744 - DNA, 589 bp, Homo sapiens
  misc_feature (565)..(565): n is a, c, g, or t
  misc_feature (571)..(571): n is a, c, g, or t
  misc_feature (576)..(576): n is a, c, g, or t
cggacgcgtgggtcgacccacgcgtccgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgctgatncggccngactnctttctctatctc

SEQ ID NO: 715745 - DNA, 390 bp, Homo sapiens
  misc_feature (52)..(52): n is a, c, g, or t
  misc_feature (345)..(345): n is a, c, g, or t
gcggccgcgactactactactagtctactactactaaattcgcggccgtcantaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgcngagcggccgaatttcaacacaataaggacgagcacataatttgaa

SEQ ID NO: 715746 - DNA, 2035 bp, Homo sapiens
  misc_feature (31)..(31): n is a, c, g, or t
  misc_feature (39)..(39): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaacaacacaaaaaaaaacaaaaaaaaaaaaaagaaaaaaaaaaaaaaaaaaaaaaaaaaataagagaggcagagacacgagagagaagcgagtcagatgacacacacagaacgcgcctctcttctctctctctcttatatataagagaagagagagtaatctatctctcctctgtatcttgatagacacctcgacccccctatgagatatatctgatttctcgctatatttatggcggccctctcatcaatcggccgtagagacacacctctatcttgtttctaacagcgaccgacctacaagacataaaatagatactatatatctctgtttgactacattagtgctcttttgtacaatcacccgcaccgattcacagtaagacacgcacacaacgcgtagagagtagacctactcttcgcgcagccgcccccgacgcgacgactctcagtatgccttccactgatatagtcgttccatcctcacattgccaattttgttaataaacagtgactctcttgtaaatataaattaacaacacatagagagacagtgacaccaataaagggcccccacgcgcatgacatcaaaacaatcacaagcagctctacacgtcgcggggcgcccacccaaagccggtagggtacagagaaaaaactctccaaaggcaaaacaccatgcgcggtacatcatccgggggggggagcaaattgagacttatcataaaacgcacagatctactaaatatcttttcccccccctaactacaaaaatttatttcccaaaaaataacaaaggaggaagatccagcacgcgcaagaacttcctcctcgtggtataagcgacagaaaagtaaccaaccccagtgtgtaaaagttgcccccacacagcaacgatagtgagtgtcaccccctttcgagttatttgaaaaatatataacatcacacctctgaccacaaacaacactgcttatcccgttacacaaaacgggaagcactacgcacccccacccttattagggcagctcttaaccaaaacacgggggaaacacgacaaccccaccgaaggagagagtagaaacacgacaacaaaacaccagtattattcacacacgacaacactgcagacggggggagggaagataaaacaatcaacggcaacgacagggtacgccaaaaaacgtcccgtagggagggcgacaaaaccacccatgcggatacgaagaccccacgcagaggacccacagcaacagagtagccacccccccaaccaaaaaactgtacttgaaaaagaagagaacgggcgcaggataatccaccaccaagtagaagcccccactcatcacccccctatataagagaaaaacaaaat

SEQ ID NO: 715747 - DNA, 1075 bp, Homo sapiens
  misc_feature (31)..(31): n is a, c, g, or t
  misc_feature (39)..(39): n is a, c, g, or t
  misc_feature (766)..(766): n is a, c, g, or t
  misc_feature (772)..(772): n is a, c, g, or t
  misc_feature (775)..(775): n is a, c, g, or t
  misc_feature (780)..(780): n is a, c, g, or t
  misc_feature (782)..(782): n is a, c, g, or t
  misc_feature (805)..(806): n is a, c, g, or t
  misc_feature (820)..(820): n is a, c, g, or t
  misc_feature (824)..(824): n is a, c, g, or t
  misc_feature (833)..(834): n is a, c, g, or t
  misc_feature (836)..(836): n is a, c, g, or t
  misc_feature (1075)..(1075): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaacaacacaaaaaaaaacaaaaaaaaaaaaaagaaaaaaaaaaaaaaaaaaaaaaaaccggggggcaatataggggggggggggaaaaaaggtaaaaagggncgggtnatntttcngnacccttttttttaaggggggaanngggggcccaaaggngggnaaacaaaanntngtacccgttctctcttttatctttcgttcgaaaaacaggacaaccgcaaaaagaacatagctacaggggatcaatgtgtaacaacaacgcgctaggacaaaaattcatatagatacaaacttaacaacaatacgaatagtagaaatatacaacgtataaacgatcacatgtaatatcacagtaatagatagataatgaatattaaatctgagcgaggagaacgagggaaaatatccgtn

SEQ ID NO: 715748 - DNA, 461 bp, Homo sapiens
  misc_feature (15)..(15): n is a, c, g, or t
gccattctatatganataatatatatttataatttttaatatttatatgtggtatattttcccataatgaaagattaaaattaaagcagttggatctttaaaaagaaaagaaagaagtgaataatacacaccagctttctcctgattagaggaagagccccaaagcttctatggacactcacttttctcttcttcttcttgcattattatgaggaaatccttaaaggttggggaacttgggcgactttggctaatgaggagctctgtgccttgagccccccaggccatagaatagtaaatagtctgtgcctccagccctgcagtgtgaggttccagtcctgtgggctccacacccatcacctgtatcaggaggctcatgtctcaccctgtcttcttgccagccttgaggatggagtctgagcctccatcgtgcaccacgcagggaggacagtggacttgtt

SEQ ID NO: 715749 - DNA, 358 bp, Homo sapiens
ctgatattctgacatgtgttaccaccgagaagtcggctgtcatactatattttactctctgatgcctgtaatgtgtagtttttctctgctattaagatattctttatattattgatttataagcagtttggttatgagctggcttactgtagttttatacatgtatacttgtgcttgggtttattgagcttctttgtatttagttttaaatgagatggagtctcgctctgtcacccaggctggagtgaagtggtgcaaactcgagctcattacagcctctgcctcccatcttcaagtgattcttgtgcctcagcctcccaagtagctgggaccacaggcacacaccaccactcttggc

SEQ ID NO: 715750 - DNA, 1028 bp, Homo sapiens
  misc_feature (719)..(719): n is a, c, g, or t
  misc_feature (725)..(725): n is a, c, g, or t
  misc_feature (728)..(728): n is a, c, g, or t
  misc_feature (733)..(733): n is a, c, g, or t
  misc_feature (735)..(735): n is a, c, g, or t
  misc_feature (758)..(759): n is a, c, g, or t
  misc_feature (773)..(773): n is a, c, g, or t
  misc_feature (777)..(777): n is a, c, g, or t
  misc_feature (786)..(787): n is a, c, g, or t
  misc_feature (789)..(789): n is a, c, g, or t
  misc_feature (1028)..(1028): n is a, c, g, or t
gagttaggctagtacgaggcgggtgtgaatcggccgagggcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaaaaaaaaaaaaaaaaaaaaaaaaaaccggggggcaatataggggggggggggaaaaaaggtaaaaagggncgggtnatntttcngnacccttttttttaaggggggaanngggggcccaaaggngggnaaacaaaanntngtacccgttctctcttttatctttcgttcgaaaaacaggacaaccgcaaaaagaacatagctacaggggatcaatgtgtaacaacaacgcgctaggacaaaaattcatatagatacaaacttaacaacaatacgaatagtagaaatatacaacgtataaacgatcacatgtaatatcacagtaatagatagataatgaatattaaatctgagcgaggagaacgagggaaaatatccgtn

SEQ ID NO: 715751 - DNA, 290 bp, Homo sapiens
  misc_feature (7)..(7): n is a, c, g, or t
cctgtanccggtctgggtagctgggaccacaggtatgtgcaccacgccacctaatttttgtatttttagtagagatggggtttcaacatgttggccaggatggtctctatctcttaaccttgtgatctgcccgcctcggcctcccaaagttctgggattacaggcgtaagccaccgcgcctggactatttcaaggttttcagaaacaaaagcaatcgtagtagaatcaagaactagtacattataacaaaccaacaaaaatgtcacaagtgtaacgcgtcagcctgggcc

SEQ ID NO: 715752 - DNA, 755 bp, Homo sapiens
ggacaattcagaacatgtcttttcaagcaaaggactggtcttttctatctcgtgtgacgcaccagcgggattccccgccccttgggaaagatgaggtatgcctcgccgcggtggaccacgggacatttgtcaccgccccagaatagattaaatgggatcgagaccatgtttagccagccatcctggagagtttgtaagatacccccatttggattggatgaattcccgattctgcttgcttgccttttaataattgataatgcttatacacttaccccttaatgccccgaaatgtaggggtataaataaaggtaacacatggacctgatcttctttataatttctactttgaggtgctgtctcccaatgtttgaatgtatctgaggccgggtgctcccccggtagctctaggagggctggccacttagaggtggggagcagaggattctcttatcccacatccacatcttggtgcaagatattggactcttccatctcttgcactccaagcttggtaagatagttaagcgtgcataagtttaacttcccatttaccataactctgcttagaatttggggggaaattttagaaataataaattgacaggattattggaaatttgttataatggatgaaccttttgtcaaataagattcataatttactttttaaacctttgataaagataaggcactggttgtggtttatttgggttatttttgttcccccaggttaattaatcattaaacttgga

SEQ ID NO: 715753 - DNA, 1016 bp, Homo sapiens
  misc_feature (7)..(7): n is a, c, g, or t
  misc_feature (25)..(26): n is a, c, g, or t
  misc_feature (707)..(707): n is a, c, g, or t
  misc_feature (713)..(713): n is a, c, g, or t
  misc_feature (716)..(716): n is a, c, g, or t
  misc_feature (721)..(721): n is a, c, g, or t
  misc_feature (723)..(723): n is a, c, g, or t
  misc_feature (746)..(747): n is a, c, g, or t
  misc_feature (761)..(761): n is a, c, g, or t
  misc_feature (765)..(765): n is a, c, g, or t
  misc_feature (774)..(775): n is a, c, g, or t
  misc_feature (777)..(777): n is a, c, g, or t
  misc_feature (1016)..(1016): n is a, c, g, or t
aactagnctaggtcgaggcgggtgnnggcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaaaaaaaaaaaaaaaaaaaaaaaaaaccggggggcaatataggggggggggggaaaaaaggtaaaaagggncgggtnatntttcngnacccttttttttaaggggggaanngggggcccaaaggngggnaaacaaaanntngtacccgttctctcttttatctttcgttcgaaaaacaggacaaccgcaaaaagaacatagctacaggggatcaatgtgtaacaacaacgcgctaggacaaaaattcatatagatacaaacttaacaacaatacgaatagtagaaatatacaacgtataaacgatcacatgtaatatcacagtaatagatagataatgaatattaaatctgagcgaggagaacgagggaaaatatccgtn

SEQ ID NO: 715754 - DNA, 1017 bp, Homo sapiens
  misc_feature (708)..(708): n is a, c, g, or t
  misc_feature (714)..(714): n is a, c, g, or t
  misc_feature (717)..(717): n is a, c, g, or t
  misc_feature (722)..(722): n is a, c, g, or t
  misc_feature (724)..(724): n is a, c, g, or t
  misc_feature (747)..(748): n is a, c, g, or t
  misc_feature (762)..(762): n is a, c, g, or t
  misc_feature (766)..(766): n is a, c, g, or t
  misc_feature (775)..(776): n is a, c, g, or t
  misc_feature (778)..(778): n is a, c, g, or t
  misc_feature (1017)..(1017): n is a, c, g, or t
cggacgcgtgggtcgacccacgcgtccggcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaaaaaaaaaaaaaaaaaaaaaaaaaaccggggggcaatataggggggggggggaaaaaaggtaaaaagggncgggtnatntttcngnacccttttttttaaggggggaanngggggcccaaaggngggnaaacaaaanntngtacccgttctctcttttatctttcgttcgaaaaacaggacaaccgcaaaaagaacatagctacaggggatcaatgtgtaacaacaacgcgctaggacaaaaattcatatagatacaaacttaacaacaatacgaatagtagaaatatacaacgtataaacgatcacatgtaatatcacagtaatagatagataatgaatattaaatctgagcgaggagaacgagggaaaatatccgtn

SEQ ID NO: 715755 - DNA, 137 bp, Homo sapiens
cacggaagagagtgaactgggtagtacggatagtgtcatccggacactttgctgaagtatatcagctgaaggagctttgggctgagactatgggtttattagatatagaattaagtcatctgcaaagagacgtagtt

SEQ ID NO: 715756 - DNA, 1020 bp, Homo sapiens
  misc_feature (31)..(31): n is a, c, g, or t
  misc_feature (39)..(39): n is a, c, g, or t
  misc_feature (714)..(715): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaacaccaggaaacaaagaaaaaacacgcggggacaaagggggggggggannaggggtactgaatggggaatgctccttagtgtttttcgggaccagtttttttgttacacgggagattcggcggtaccccctatggggagtgcgtaatattcgataagcagttacggttagaacgcgtgaaaacgaaagaagagacaaaaaaagccaaaagcacagatgacaaagtagaccacacaagagggaagcagaagataaacacatagatgttatagataagagaatgataataagtgataaaaaatagagacaaaaaatcaagaactaaaaagcaaaacagagaagatcgtggaataaga

SEQ ID NO: 715757 - DNA, 1008 bp, Homo sapiens
tgccctcatgctgccagcttctactcagagctcttcacgctctacctgctgcttcatgagcgggaggacagcttctacagccaggcattgccaacttgagcctctttcctgatacccaactgctcgagttcctggatgtgcagaagcacttgtggcccctcaaggacctcacgctgacgagcaatcagaggtactccctggtcagggacaagtgtttcctgtcagccaccgagtgcctgcagaagatcatgaccacggtggacccacgggagaagctggaggtgctggagaggacatacggggaaattgagggcacggtgtcgagggtattgggccgggagtacaagctgcccatggacgacctgctgccacttctcatctacgtggtgtcgcgcgcccgaattcagcacctgggagccgagatccacctgatccgtgacatgatggaccccaaccacacaggaggcctgtatgacttcctgctcacagccctggagtcctgttacgagcacatccagaaagaagacatgaggctgcaccgcttacctggccactggcactccagggagctctggtagcctggcctttcctggacagactgaagagctgagcagggcactgccagcctgtccctcattacccaaggcaaggggcaggacaggccctcagaagcagctcttggaggagatgagcattttgttttgcacaggaagatgctgctgctgccctgactgggatgagggtgaggggtgacgggtgtggccctggatgtggtggttttcccttggccactagcccatcttcaatgaccccttaatctgcagcagctcacaggctgggggtgaggagtccctggcttctcttagcctgagcctttctcccaagttccagagcctctccgggcctcagtgctgccatctgtacaatggtggagtgagtacgctgtaaaggaccttccattcattttgctgaattccagagagtaccattatgtgataggctgaataa

SEQ ID NO: 715758 - DNA, 576 bp, Homo sapiens
  misc_feature (19)..(19): n is a, c, g, or t
agctgtggaggtgcactgnaaataggacatgtgaaaggactctgattaagctggggacactgagcttgtaaactctgatgaacttttcttgccataaaaaacaaaaacacaaacaaaaaaaacagcttctttattctagtagtggcaacatccccttcctgacccatgctgccatcagtctttccacctttgtctgaggagataaactctgcactgcctgaagcaacagtgatggcctcccctgaggcagttgccaggcaaaataaggttgattctcctcaggagctacccccaacacctctgtttgcttccagacctataactagactagagtctcagtgggcccctagaggtgaagatctgagtgtcacctatgaggaggtgcaccacacttgaaaagcactgcttgagtttactgatttacgtaaacagaagtctggagactaggcatgggaatggatattaagggtatggcataatggtggaaagaacatttagttggatcaggctgaatatattgattcaggcccacttagtatgaattccgaattcaatgttgcaactccaacagcctct

SEQ ID NO: 715759 - DNA, 207 bp, Homo sapiens
aaaccctaataacggagaccatctagacaagtctaaaatgttatatatccatccaagagattccagtaccgttgataaaatactgggaaactgctcagaatttatacggggtttgttgatggtggtattattctctcccaggaggaactagcaaattatagcagccttttgaaaaagtatccgtgaatagaaaaagcgtaattaggg

SEQ ID NO: 715760 - DNA, 921 bp, Homo sapiens
cgtcttacctgtggagacggggtctcaggccggccttgggaagaggggatgtcagagctggggggccatggcctcatccagccactccctccaccatgcagaggtactccctggtcagggacaagtgtttcctgtcagccaccgagtgcctgcagaagatcatgaccacggtggacccacgggagaagctggaggtgctggagaggacatacggggaaattgagggcacggtgtcgagggtattgggccgggagtacaagctgcccatggacgacctgctgccacttctcatctacgtggtgtcgcgcgcccgaattcagcacctgggagccgagatccacctgatccgtgacatgatggaccccaaccacacaggaggcctgtatgacttcctgctcacagccctggagtcctgttacgagcacatccagaaagaagacatgaggctgcaccgcttacctggccactggcactccagggagctctggtagcctggcctttcctggacagactgaagagctgagcagggcactgccagcctgtccctcattacccaaggcaaggggcaggacaggccctcagaagcagctcttggaggagatgagcattttgttttgcacaggaagatgctgctgctgccctgactgggatgagggtgaggggtgacgggtgtggccctggatgtggtggttttcccttggccactagcccatcttcaatgaccccttaatctgcagcagctcacaggctgggggtgaggagtccctggcttctcttagcctgagcctttctcccaagttccagagcctctccgggcctcagtgctgccatctgtacaatggtggagtgagtacgctgtaaaggaccttccattcattttgctgaattccagagagtaccattatgtgataggctgaataa

SEQ ID NO: 715761 - DNA, 1057 bp, Homo sapiens
gccgcgctcccctgctcgcctcagtggttcggccgcggcgacccactccggcggcgcgtccccgagcttggtacggctcagcccgtctcccccgaagcccggcgcccgcgcccggcccctcagtcggtggagcccgcagccccccttgtggccgcggagtccccgccgctcggctttgcccgcatggtccgtccggccgtgccaccagtaaccagctcccagagaaccaggagaagcacacccatcagagagtctccgaggaagaccatcacaacggaccactagtggatgcgcagccagtacatgatcagaactcatgagactagacaaaccccaccatatggcacagaagacctcactgctacgaattccgaagaaccagatcgaacaccataccaatgaaaaaggtgatcgaatacttaaaaagcaatgagtcacaattagatccacctaataaacatagggatacaacatcggggagtctggcccgttgagcagacacaacggaatcaccctaacaagtctgctgtcctcgtcagacggcgctcaaccaagtgtcaagcgaataacccagcaaaaacccttaactcattgactccccactgaaccccctgacagcggacccatgcccctgccaaaactcaccttgaaaccaacgagagaacctgacagacacgaccaagtggaccgctcacaaagatgatcatgcaactagatacctcaacatcgctgataaacctcatgtggacccacatgttacagagaatctccaaagtacggaaagttacccctacacccaccagctcacttgaaatcgataaaggggaccaacgaccgacaaactaggtcacagatgcaccaggcagaccgttgtatcaccacatctcacctaataagatcacctggcaaatgcccgtaacctcaaacagacaactcatgcgcaccccacaacaagactgaacgactcagcagatacaccgcgacccatcgcctgtcgtacagcacaacccacaatccacacgaaccgaacacaacatcccgatatattcaaagcatc

SEQ ID NO: 715762 - DNA, 396 bp, Homo sapiens
attcgatctgaagctgtgacaaactagtgaaataaacacaacctcaagaaaaggaagaaacgcccagataaaagtggtaatttgctctcttggtgtaaaaagcttgattgtccggaattgttgattttcttactctcgattcaactgtcagtcagtttgccttcgctgtgtttatgaatgaagagtcatatataccgtgttcactaccgagcgtgcgccacactgtggctcctgtctgcttggaaaatgtgggcgtggtgagcgacataagccaggttaaccccctcaaccagtttatagtgctgtggtaactgtatttaaattaatgcactctaaatggcattaaaaaacagataagcttaacggaaagcatctgtcgacacggccgccaattta

SEQ ID NO: 715763 - DNA, 1304 bp, Homo sapiens
  misc_feature (669)..(669): n is a, c, g, or t
tgccctcatgctgccagcttctactcagagctcttcacgctctacctgctgcttcatgagcgggaggacagcttctacagccaggcattgccaacttgagcctctttcctgatacccaactgctcgagttcctggatgtgcagaagcacttgtggcccctcaaggacctcacgctgacgagcaatcagaggtactccctggtcagggacaagtgtttcctgtcagccaccgagtgcctgcagaagatcatgaccacggtggacccacgggagaagctggaggtgctggagaggacatacggggaaattgagggcacggtgtcgagggtattgggccgggagtacaagctgcccatggacgacctgctgccacttctcatctacgtggtgtcgcgcgcccggtgaggcagtcaggagctgggggtgcaggcaggggcagggtcccacccccaaccacgatatcttctgatacctctgaaccccaggtttatggatgcagcttctctctgtacagatggggaagccaaggcccagaaaagggagggtcccagccaggtgctggggtgctagaggtagagtgaggaccacaccccaggtgtccagccatccaggccagcgctccttccccagctgcctgtccgcgacaggcctcttctccttgtctccctcnctctcttggtggggcggtgttctccagaattcagcacctgggagccgagatccacctgatccgtgacatgatggaccccaaccacacaggaggcctgtatgacttcctgctcacagccctggagtcctgttacgagcacatccagaaagaagacatgaggctgcaccgcttacctggccactggcactccagggagctctggtagcctggcctttcctggacagactgaagagctgagcagggcactgccagcctgtccctcattacccaaggcaaggggcaggacaggccctcagaagcagctcttggaggagatgagcattttgttttgcacaggaagatgctgctgctgccctgactgggatgagggtgaggggtgacgggtgtggccctggatgtggtggttttcccttggccactagcccatcttcaatgaccccttaatctgcagcagctcacaggctgggggtgaggagtccctggcttctcttagcctgagcctttctcccaagttccagagcctctccgggcctcagtgctgccatctgtacaatggtggagtgagtacgctgtaaaggaccttccattcattttgctgaattccagagagtaccattatgtgataggctgaataa

SEQ ID NO: 715764 - DNA, 556 bp, Homo sapiens
ctgcagagaccctcaaggatgtggttatgatggataactttcaccatatttttgcaactctttctcgattgaagatctcagtgtctacgaacgcagaataaaaagaagccaatcaaaaatagacagatcaccgttcagtcttatgtcactgtattcgtaaagaccatgctcgttgaaaaactaaatcatttctttgaaggtgttgaagctcgcgtggcacagggcataagggaggaggaagtaagttaccaacttgcatctaacaaacaagaacttcgtaaagtcattaaggagtaccctggaaaggaagtaaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaaaccttgtgaaagaagaaaagc

SEQ ID NO: 715765 - DNA, 283 bp, Homo sapiens
ggaaaattagccgaagtggtagggatcctgctagggtgtagaataggaaataaagtcctgcattgagtcgttctgtttggtttcctcagcgtgtgatgataattagtgtgggtactagtgttgcttcgaataggatatagaataggattagttcggtggcggtgcaggttataattaggaatcagttgtcagtaggattagtatggtaatcatatagtttcctctcgggttgtggtcccttcctgataggtgagcattggctagctcattcagtatacagggg

SEQ ID NO: 715766 - DNA, 1389 bp, Homo sapiens
gatatgaagccgccgcctcccgatcgccgactcccgtccaatcgatgccgccgccgcccgggccgatgcccccggcgccgcggcgcggcggaggtgtggtgcgtgggcggctggcgtgtcacggtgctgttggcggtcggtcgatcgcgaaccgtgtgactcctggcgatctgtggtgggcccggtcctgctgatgctttcgtcctacctgcctcaaggcccgctaccaggaccgccgggcgctcttcatcgctgggcgcttggtccgtgcctgactggtgcagtggcgggtccccggccacaacaggcttctccacctccttgcgaggggcccaggtggtcccggcggtcggtcccggctgacgcgctgggcgcagtggcgtcgggtgtgggtgccagtgggcgtggtggttgcggtgctggtgtggtgcccgcatcgctgtcggtaggtactagtaccagagccagggagtcagagcgtgaaaactcaggagacactcatccaaagcatacatcagaacagagcatagggatagacaggaatagaagaaatagcatgagacatagtacaccgaacaacgattagaagttgaagaaaaaggcatacaacggctcacacataacaacaatagcaggtaacaccaagataaaaccgtccactctgcgtttcacaatggtcattctagagcaattgcgaaccggcctacataggatgactcacattgctaccacacctttgcttcatgaaaccacagagcaaacaggaacatcccttgggcttctgtcgctcacaacactcgggtcggcacaaaacaagtgaaagaagagaaagagggccataccaaaaaatcagcaagcgacaaacgcaagcacaagcaaacgacgcaacaagaccatacattaccagcagcctcgcagcggaatgaaaccacagtgacagaacaacgagacaacacaaacgctcaaagtccaatctatacagaaactcgtaacgacacagaccccttaacacagtggagacctaaatattaatatcacccactcccgacaatcatcatagccacccaaaccaacagaaaggaaaagacaaccaaccaacacagcaaagacagaggacgaacaacgcacaggaacacaaccaagaacaaagcgacaccacaaaataaaaacaaaactattagatacaacagtatcaagcaccatcacatgaaaacaaactaaatcactaaccaaccaaccaaaccgcaaaaaaaagcaacaaacatacaacaccgaacacaacagagacacagacagaacagaaacagaaaaaacacaatacacataaaaaaatcaaagaatcgaaaacaattctattacattccttcttaaaaacaaaatatgcactaa

SEQ ID NO: 715767 - DNA, 298 bp, Homo sapiens
ggtaggctgtctgggtcatggacatcagtgtggaagtcacctaggctgccacagacctgggagaagaggagggcggccgtgcaggaatggagaaggctgtggctgggcctgagggaagactctgtgcctgagggtagaagtgtgaagtgagcaagcttcaggctagaagagggggaatgaagagagcagggtctcctttcagagaagagggtaaaaggagtgtgtagttcttgaaggactgaggatgttacaagaaaagagctatccggagcacagaaagactcaggagggccgatag

SEQ ID NO: 715768 - DNA, 679 bp, Homo sapiens
  misc_feature (509)..(509): n is a, c, g, or t
ggagggcaggaagccacggccacaggggtgtagcccgagacccacctgcattaatgaatcgtgaacagaaaacagcagcgcagccatggcggggatgacagacagctccggggactacatcgactcgtcatggagctgcgtgtctgtgggagagaggaccagaggccgagtcgtcacctctgcgggatcacgtggggacgtcgacacatcgggctggtggtgctcactgaagattcgtggagacagagtcaatcggcaagccaggacatggtcagaccgatgctcatttgcgtgggaaacagaacgaggcacgtggaatgcctgcaagacaccagataggacagctggaacaaggtaccgggactccttggcccgaacgacacgacactcttacttatgggcgccccaagcgataccaggagacccagtataagtccattcgagggttggacacaaagcacacgggcagccgacaacgttgcagcacatcacggtggcacagctttcantcacccaagacagcccacttcttaccaagaggcttgattgggcttgacaatcttgaccgcaacatccagtcaaaggaatcccgggacaacacccagaatgggaggacttgttaaccccattggcatccgggggcatccttgaagaacgaaagggagaaagaaagaaggaa

SEQ ID NO: 715769 - DNA, 144 bp, Homo sapiens
gggaacagcatacccacgattccgctacgaccagactctatacacctctctattaaaaaacttcctaccactcaccctagcattacttatatatatgtctccatacccattacaatctccagcattcccgctgcaaaccaattc

SEQ ID NO: 715770 - DNA, 281 bp, Homo sapiens
atgtgtaggtgcttgaggatctcccgactagcctgacaggggtgtggctgggggaagactataccccacgctggcctggtttcacctcaccctaatccccggtgggagctgctgatgcaaaaagctgagggggcctgtgggagtggctgtttttatgccccagccccgcaggttggggagtgtttgtgggggtccagagccctcccccagccagtgagagaacctccgggaggggtccttcgtgtggggccctgtgtcccctgctcggggagtaagggctg

SEQ ID NO: 715771 - DNA, 161 bp, Homo sapiens
gcgctgattcacgtgagtaagtttataattcaaagcagaattgagctcaaaagaatacacaatagtgttgcaaatatccattttctgtaaagaataaaagctacatagttttaggaaagcgaaggaaatcctgactcttggtttaactgattcattcactg

SEQ ID NO: 715772 - DNA, 86 bp, Homo sapiens
  misc_feature (10)..(10): n is a, c, g, or t
  misc_feature (35)..(35): n is a, c, g, or t
  misc_feature (44)..(44): n is a, c, g, or t
tttttttccntcttttttctgtttgtttttagatnaaaattttnagaaaaaaaatgaaaaaattctaataaaagaagaaaaatgga

SEQ ID NO: 715773 - DNA, 1536 bp, Homo sapiens
  misc_feature (484)..(484): n is a, c, g, or t
gctcccggaggcccattacgggaatctgcggagcttagctgtcgccacgctcgcgccgggtccgcgcggtccacggtgacccccctatctgatcgcccccggtgagcggtccatctatggacgtgcggggctcctgaaaggcccctcgagctgtggactgcagtcgctgcgagagatcgcggcatgaaaaatctattatcagagaacattcagcgcacacagttttcaacgcgtctgacgtgtgaacactttaacctcagaaatatgcttttctagctttcactcgaaatgcctgctgtaattctttccggacattgggtaagaattaatcagtggacgatacttcattgaccagtcgggtcctgtgataagatacgctacgtatgactcttgatgcgccactgagagcacgtgacgagatgatctctttgaagggcgcactctcctgtgactgctgcacttcggttgctgcgtcccatggcangcttgccattgtctctctaacgactgtaaggccgtgcgcatgtacaccatgcatggtagccttgggacacttagaacatggaggagtatactacgaacactatgacgcgtatgctttaaccaccgtaaacgcaccagtggttacatctcggactttttacacttgcgtgtggcacaaggcacctagtgacttctgttaaataattttctaactttactggggtacaccaaaagctcttgtcactcgaattggagacccattagacgcttttggtcgtggctagtcggttcgatggaaatctaacgcgagagactgagcttggggggggctctttcgataaccacggaaaccgatcaccctatatgacgtggctttgcacacttctgcgtttcacccctcgatccgggcctagggtgggggctcccaatctaagttcccttaggccatgtggaattttcccggtcggttttgctttcgcaggaatagggcatgagccgggctagatgggttcgccgatcagggcggcattggttttcatactcgccctcgccgcatgtcccggttcacaccccggttcaaggaaaaggcgaaagggccagactatcgggagagtaacacaggcgcattatggggtgtgaagtctcgcggtttgcgcccccacgagaacattatgttccgattttaccgggaaggctctagtgggcaaccttctttatgggcaatatcccttggagcggacacctttcccccccaagtatagaatgagcgctgggcaccactcctgcttgggaaagaacagccactggagggcctataacccttgggtacccgggtatagtaagagacccccggattctccgcaaatttcgcttgagaagggctacaatatatacgcggcgacaaatggcgcaccactgtgccctgtgaaggcgcccagagtgttgtacatatgcgcccagttgagtatgcgcaaagcacagctttttttggagcccccttgatattgttattttgcacaataaacaggcttgccctatgtgtgtctacacact

SEQ ID NO: 715774 - DNA, 108 bp, Homo sapiens
  misc_feature (4)..(4): n is a, c, g, or t
cgcnggaccccgatttccttcacttcgtcggtagcgttaccgatgatgcgggctttctcgtccgggataacgaagtcgttaacaccgatggaaaccgggaaatggtcg

SEQ ID NO: 715775 - DNA, 330 bp, Homo sapiens
gatcggtatactcgtctggtgcggtaccattggcgtgcaacttgatttgatggtgagggatggatcgttgagctcgatcagttatgtagaggatgcgtaaggatgggagggcgaagaggactaggatgatggcgggcaggatagttcagacaggatctatttcctgagcgtctgagatgttcgtattagttagttttgttgatgagtgttaggaaaatgggcatacttggactatggaagcagataaggaaaactgattattgagggcctgtctcaatcaggttgtcggggataccgagattcgagattcgaaaatcatggatcatagcg

SEQ ID NO: 715776 - DNA, 573 bp, Homo sapiens
agagcttggatctgctcaggagttggcatgggcccacgattcttcagagtatacaataagagagagcaacagcattgtaagagatcatttaagaactttaaggaagaaaaacaaaagaaagaaatacaaaaaacacaacctttcttggggccggctttccgccccctggaaaaaaggttcaagaagacacaatgctgttggcggcgccgcgggggccacataggacatgaaacactaggtccgaacgtctggttgctccagagagtcgcggggccaggcgacgatgggttggccattctcgcacaataaacaaccgccgggggagacagccggcatcgcgtttagagagaccaaactccaaatggggcatgacaggagggaccgaaaagtgggggctctgtcgagaactggggaggttcatatggtcatctggattcaaatattagccctccgctgggattgtaactatgtagccatttcatcatatctatcatatcagcactatacttacatatgtcacgccttcagtgcgccatgacagttcttactgggccctgcgcgaaggtatcctac

SEQ ID NO: 715777 - DNA, 817 bp, Homo sapiens
  misc_feature (31)..(31): n is a, c, g, or t
  misc_feature (39)..(39): n is a, c, g, or t
  misc_feature (724)..(724): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaacaacaaaaaaaaaaacaaaaaaacccggggtttttttgcgggggggggaaaaaggggntgaagggatggcaattggtttcggacccatttttttgtaaaagggggaaatgggggggcccaaaggggggggtaaatgaagccggtacgtagc

SEQ ID NO: 715778 - DNA, 350 bp, Homo sapiens
  misc_feature (14)..(14): n is a, c, g, or t
  misc_feature (35)..(35): n is a, c, g, or t
  misc_feature (290)..(291): n is a, c, g, or t
  misc_feature (293)..(293): n is a, c, g, or t
  misc_feature (335)..(335): n is a, c, g, or t
gctcgtggggggcncaagtccttctgatcgaggcncagcccgcacaacggatctgcaggcgcggagcaaaatgcacccgccgcgccgcgcggtcctgcagccccgccacggccccgcggcccgcacccccccggggcgacagtgagcctctcccgccaccaccgggggccgagcggagggctctcgggtgggagagcgggaccagatctcgacagctgttcatttccaggaagccaccgcagccagagcgaaaggggaccttctgccaccagcggggcatcagccagcgnngngcatggatttatgaagacactcatgcaagaagtgggcagganttggacaaacttttc

SEQ ID NO: 715779 - DNA, 439 bp, Homo sapiens
cctgactagcccgacagacggactagcccggacagtccgcgactagcgagacagtccccgactagcccgacagtcccggactagcccgacagtcgcgcgactagcccgagagtccccgactagcccgacagtccccgactagcccgacagtccgtgactagcccgacagctccgagtagcccgaaagggtttggaatgtccttatggacgtacttacttccctgatggggcatttcctggggctcgtggtctgagaccgtctggtcccccaggaccgtgcccacgtctcccaggtcagcagcagtcccgcaaacagcagcggagtcttgatcatgcctccaattctggagtctttgcacgcctcggtcagcggcaccctgtgcccgcgcgctcctcctggcgatgccgccctgtcgggctagtcgggggggtaccgagc

SEQ ID NO: 715780 - DNA, 1055 bp, Homo sapiens
  misc_feature (31)..(31): n is a, c, g, or t
  misc_feature (39)..(39): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaaccaaaaaaaaaaaaaaaaaaaaaaaaaaaaaaaaaaaaaaaaaaaaaaaaaaaaaaaaaaaaaaaaaaaaaaaaaaaaaaaaaggggggggggggataaaaaatatccggggggggacaaattgaagcagacaacacggttttttgtttgttaaaaaagaagggcccaccataagaaggagtttatataaaaaaaagagagagagcgacgcggattaacaagtgggtgaggggggaagaacaatcttgtgggagtatagttgggagaaacaccctcttgggggggtgggaaaatctgcgaaacatcatggaaattataggtgcggggaaaaaaatgtgggtggtgtgtgtaacggttattggcgtggaaacatgcggggttttggaata

SEQ ID NO: 715781 - DNA, 1251 bp, Homo sapiens
  misc_feature (31)..(31): n is a, c, g, or t
  misc_feature (39)..(39): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaaccaaaaaaaaaaaaaaaaaaaaaaaaccccgggggcccctttccgcgcgggggcgcgggaaaagggggcacggcaagggcgcaacaggggcgcaacaaggggttcccgggacccaagttttcttgtgtgtcacaaggggggagaaatctcgcgcggggaccccctatatataggggagagcgggaatataaatttgagaaaaacccggggttacccgggttttagggaccgcgcgcgacaaaaagaaacaaacacaccagaaccacaacagcaacagacaaccaacaaaaacagggagaccaaacacaaaggcaaacaaaaaaccgcaacacacaaaacacataaacaaattaaacaaaaaaacaaaataaaacaaacaaacaacaaaacaaaaaccatatataattaaatacaaccacactactaaaaaaataaacaactaaccaaataataaaaaaagcataaagaaaaaaagaagcaaataaaggaagggggaggggagagggagaggaggagagaggaaacgagggggagggagggggcgagaaaggagaagggagaggaggcagaaagggacagcggaga

SEQ ID NO: 715782 - DNA, 141 bp, Homo sapiens
catgtatcagtgtcatgtatacgtgtcatgtactcgtaaattaaacccataattctatttatttaataagaattaaataaacgcccaaatgcttatttacatttcacaaaacataaagtattttaaatcacaacttcaggg

SEQ ID NO: 715783 - DNA, 144 bp, Homo sapiens
tccgccctgcgcaccgcctcaatcacatgctccttgttctgcagcttggtgcggactggacatgataaccttggccaattgtgaaccctggtccacatgttgccctggggctttccataggcacctcgcatgcctgtatggagc

SEQ ID NO: 715784 - DNA, 1290 bp, Homo sapiens
  misc_feature (31)..(31): n is a, c, g, or t
  misc_feature (39)..(39): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaaccaaaaaaaaaaaaaaaaaaaaaaaaaaaagggggggccccccaaagatttctccccggggggccccaatcttatcagcgcgcttccacccagttttttcttgttcacaagggggtcccctatatgaggggagctgcgtatattatataaggcctaagagcatggggggccgctgcgttttaaacagactgctgggagacagcgggggaacaaagcggcctacagctggggggagaatcctgtggggagaaaaggaggaagcacttttaaatatctgtgtgagggggggggggacacaatatatagtgtggggcacacaaaactttatacctctatactagaggagatattatataagggcactctctaaagggggagaaaaatatatttataaacacttttttacagacaccgtgtgtatataataaggcgtgggtgtataaacaccgaatagtacgctgtcgggaatatatgtgtgtgatgcgagggtgtgtatgagagaaaaaaggttttgtgggcgacttacacgggggagatactatgtaaatcttatgtgagaacacaattatttttttatatcaccacgagggcgagcattgagtggtagtaataaaaaaaagctga

SEQ ID NO: 715785 - DNA, 836 bp, Homo sapiens
  misc_feature (31)..(31): n is a, c, g, or t
  misc_feature (39)..(39): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaatattaccaggaacacaacaaaaacagaaaaacaacaaaacacacaaggacaccccaaaccggcagggaacagaaaggccccaaaagacccaggggggccaggaaccataggccaatagagaagccttacagggccgagctaacctgcccccggccccgggagccaccttc

SEQ ID NO: 715786 - DNA, 345 bp, Homo sapiens
  misc_feature (69)..(69): n is a, c, g, or t
  misc_feature (101)..(101): n is a, c, g, or t
  misc_feature (106)..(106): n is a, c, g, or t
  misc_feature (158)..(158): n is a, c, g, or t
  misc_feature (173)..(173): n is a, c, g, or t
  misc_feature (189)..(189): n is a, c, g, or t
  misc_feature (193)..(193): n is a, c, g, or t
  misc_feature (203)..(203): n is a, c, g, or t
  misc_feature (247)..(247): n is a, c, g, or t
cttcacgttgaggattcaactggccaatcacaggacaggtgccctggcctttcttcctgaggtctctangggaggggcatgggtaagggtgtttcctcagnacccncctggggtggggattatgtctgcttgtcatgtctgggtctttagggtagganaggttgtggtatganaggcaggagtctccanaagntttcatgtgnccctttaatagcagcccttgcctctgggaaggccctttcatgcntggaggcacacagcttttaaggaagtaggttgaagtaggactccttcgtcctctcacgtggttttggctcccttaaataaactgtgtgggaaccttga

SEQ ID NO: 715787 - DNA, 234 bp, Homo sapiens
tactgggacacaggtgtgggccacatgcctggctaattaaaaaaaacattttttagagatagggtctcaccgtgtggttcaggctgttcttgaactctgggctcaagcgatccccccaccttggccttccaaagtgctgggattacaggtgtgagccaccatgtctggcccttttttttttttttttttttggggaagggagccttgcttttttcacccgaggtgggtgtgcag

SEQ ID NO: 715788 - DNA, 665 bp, Homo sapiens
gtacctgtctataaggagtcctgcttatcacaatggggctcccaaacttggctgtgcagtggaaactccggggaatttggaagaacatgacacccatcttccacccggaactctgatttaatggggctgcagtgagaccagagcatcaatttaaaaggctgcccagaaggtctcctgggcagcgtggtgatcttgtgccaccttcgtgactttatgcaagtgattcatggctatttacatacctaatgagggagtcccaggagatcaaccaggacactgcatggatctcaaaggaaacaaaacccaataaactcggagtggcagactggacaatgtgtgagacatgcactgtgtacgaaacagaactttcatggtttgcacccttgtttcttacacctggtgggtttatgacaaacgacaatggccaaagaatcttcaagaaggaggactggcagttaatatccgtggggcacgacagaggccccaaaaaagacctggtctgtcagtgcactggatactctactgtggttctagtaaggcacaggctctcccaggccaggcctcaattctcctttgggctcaaatagtccatgcttggttgtgccattgcctataagtacaacgacatttgagcaacccaaaaaaacacaacacacaaacacaac

SEQ ID NO: 715789 - DNA, 712 bp, Homo sapiens
  misc_feature (31)..(31): n is a, c, g, or t
  misc_feature (39)..(39): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaactttaaggaaacaacacaaaaaccgggtttttgggggggaaagata

SEQ ID NO: 715790 - DNA, 380 bp, Homo sapiens
  misc_feature (328)..(328): n is a, c, g, or t
  misc_feature (378)..(378): n is a, c, g, or t
tcagtgggaaaagcagggagctcccttgttcaaaaattataaagaatgtcaaggacggcgtggtggctcatgcctgtaatcccagcagtttgggaagctgaggtgggtggatcacttgaggtcaggagttcaagaccagcctggccaacatggcaaaacccagtctctactggaaatacaaaaattagccgggcatggtggcacgagcctgttaatcccagcttactttggggaagctgaggcagggagaatcgctttgaacccgggaggcgggaggttgcagttgagccgagattcgcaccatttggagccaagatcatttccagcntggggttgacagagcgagtttccctttttcaaaaaaaagatttttttttnaa

SEQ ID NO: 715791 - DNA, 2019 bp, Homo sapiens
gagttaggctagtacgaggcgggtgtgaatcggccgagggcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaacaacacaaaaaaaaacaaaaaaaaaaaaaagaaaaaaaaaaaaaaaaaaaaaaaaaaataagagaggcagagacacgagagagaagcgagtcagatgacacacacagaacgcgcctctcttctctctctctcttatatataagagaagagagagtaatctatctctcctctgtatcttgatagacacctcgacccccctatgagatatatctgatttctcgctatatttatggcggccctctcatcaatcggccgtagagacacacctctatcttgtttctaacagcgaccgacctacaagacataaaatagatactatatatctctgtttgactacattagtgctcttttgtacaatcacccgcaccgattcacagtaagacacgcacacaacgcgtagagagtagacctactcttcgcgcagccgcccccgacgcgacgactctcagtatgccttccactgatatagtcgttccatcctcacattgccaattttgttaataaacagtgactctcttgtaaatataaattaacaacacatagagagacagtgacaccaataaagggcccccacgcgcatgacatcaaaacaatcacaagcagctctacacgtcgcggggcgcccacccaaagccggtagggtacagagaaaaaactctccaaaggcaaaacaccatgcgcggtacatcatccgggggggggagcaaattgagacttatcataaaacgcacagatctactaaatatcttttcccccccctaactacaaaaatttatttcccaaaaaataacaaaggaggaagatccagcacgcgcaagaacttcctcctcgtggtataagcgacagaaaagtaaccaaccccagtgtgtaaaagttgcccccacacagcaacgatagtgagtgtcaccccctttcgagttatttgaaaaatatataacatcacacctctgaccacaaacaacactgcttatcccgttacacaaaacgggaagcactacgcacccccacccttattagggcagctcttaaccaaaacacgggggaaacacgacaaccccaccgaaggagagagtagaaacacgacaacaaaacaccagtattattcacacacgacaacactgcagacggggggagggaagataaaacaatcaacggcaacgacagggtacgccaaaaaacgtcccgtagggagggcgacaaaaccacccatgcggatacgaagaccccacgcagaggacccacagcaacagagtagccacccccccaaccaaaaaactgtacttgaaaaagaagagaacgggcgcaggataatccaccaccaagtagaagcccccactcatcacccccctatataagagaaaaacaaaat

SEQ ID NO: 715792 - DNA, 175 bp, Homo sapiens
gcttctgggcaagatcagcaacattgtcattaaggaccgacgtggcatctgaggtgtacaaggctgtagctgcccgtcccaggaaggtcggcaggaggagtttggcgtcttgggcaaccttggcatcttgccctttggtcggccagccaaggaggtgttaccatctctgagactt

SEQ ID NO: 715793 - DNA, 359 bp, Homo sapiens
aaaataaaaaaagcccttttttgtgtaaacccctttgtcccaaaaaacttagtgtttttttttccctgtgcccaaccaatttaacttttttttccccccatggaggggccgtccaagtcccgtttttttaaaaagcccatgtttaaacccccattttccttttcttattttgggagccttttccccggattttttaaagttttgtttaaggcgcccaaaattttttttgtaaaaaccctttaatttttcttttttttaattttttttcccccccccttaatccattttttttttcaggccccaaggcttcccttagtttttttccaattttcccataaattttttttaattatagtcca

SEQ ID NO: 715794 - DNA, 696 bp, Homo sapiens
  misc_feature (96)..(97): n is a, c, g, or t
  misc_feature (133)..(133): n is a, c, g, or t
  misc_feature (155)..(155): n is a, c, g, or t
  misc_feature (162)..(162): n is a, c, g, or t
  misc_feature (168)..(168): n is a, c, g, or t
  misc_feature (171)..(171): n is a, c, g, or t
  misc_feature (213)..(213): n is a, c, g, or t
  misc_feature (256)..(256): n is a, c, g, or t
  misc_feature (319)..(319): n is a, c, g, or t
  misc_feature (332)..(332): n is a, c, g, or t
  misc_feature (341)..(341): n is a, c, g, or t
  misc_feature (353)..(353): n is a, c, g, or t
  misc_feature (360)..(360): n is a, c, g, or t
  misc_feature (370)..(370): n is a, c, g, or t
  misc_feature (401)..(401): n is a, c, g, or t
  misc_feature (409)..(409): n is a, c, g, or t
  misc_feature (414)..(414): n is a, c, g, or t
  misc_feature (537)..(537): n is a, c, g, or t
  misc_feature (573)..(573): n is a, c, g, or t
  misc_feature (578)..(578): n is a, c, g, or t
  misc_feature (592)..(592): n is a, c, g, or t
  misc_feature (596)..(596): n is a, c, g, or t
  misc_feature (608)..(608): n is a, c, g, or t
  misc_feature (614)..(614): n is a, c, g, or t
  misc_feature (621)..(621): n is a, c, g, or t
  misc_feature (631)..(631): n is a, c, g, or t
  misc_feature (634)..(634): n is a, c, g, or t
  misc_feature (645)..(646): n is a, c, g, or t
  misc_feature (649)..(649): n is a, c, g, or t
  misc_feature (651)..(651): n is a, c, g, or t
  misc_feature (670)..(670): n is a, c, g, or t
  misc_feature (689)..(689): n is a, c, g, or t
caagcaaaatcactgacccttaaggaaaggatgaaaaaaaaaaagcactgaaagtatgacctcctgctcagcatatatgtgcttgttgccccactnngcacatcttgttgtagatggagcatcttgacagaanatagatcaagacatagtaagtnggcagcnattttntcnaaagcactcaaaaaaaggcacatgaaagccttcaggtttggnaaaaaatccaggcacattggggtcaaatatacggttctgaaanaagatatcataggtgagaaaatccacaaaggtgagcatttccccggcaaaccatgagaatttncccagaaacatgnagaattgtntcagttgttcangtagctnttccaagttntgaggcttcagtttttcgtggtcagaactgnaacagagncttanaagttgtgtgcggaaatccattacatatgagtatctctataaatgtcactcgaaatattttcttcttcagtttcaccacacatgttgtgcttgcgagcaatgtagcgcaagatggcattgctntgggtgatattgttcttcccatccaggaggtagggnagatnaggaaatttcaggnatancttgaatttcanatccanccattgncttcgatcanagnaaggaacccannaananaccagtacccgagaaccanagacgactcgcacgacatngtgacgg

SEQ ID NO: 715795 - DNA, 1027 bp, Homo sapiens
  misc_feature (7)..(7): n is a, c, g, or t
  misc_feature (25)..(26): n is a, c, g, or t
aactagnctaggtcgaggcgggtgnnggcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaaccaaaaaaaaaaaaaaaaaaaaaaaaaaaaaaaaaaaaaaaaaaaaaaaaaaaaaaaaaaaaaaaaaaaaaaaaaaaaaaaaaggggggggggggataaaaaatatccggggggggacaaattgaagcagacaacacggttttttgtttgttaaaaaagaagggcccaccataagaaggagtttatataaaaaaaagagagagagcgacgcggattaacaagtgggtgaggggggaagaacaatcttgtgggagtatagttgggagaaacaccctcttgggggggtgggaaaatctgcgaaacatcatggaaattataggtgcggggaaaaaaatgtgggtggtgtgtgtaacggttattggcgtggaaacatgcggggttttggaata

SEQ ID NO: 715796 - DNA, 1256 bp, Homo sapiens
  misc_feature (31)..(31): n is a, c, g, or t
  misc_feature (39)..(39): n is a, c, g, or t
  misc_feature (652)..(654): n is a, c, g, or t
  misc_feature (657)..(657): n is a, c, g, or t
  misc_feature (659)..(661): n is a, c, g, or t
  misc_feature (670)..(670): n is a, c, g, or t
  misc_feature (676)..(676): n is a, c, g, or t
  misc_feature (682)..(682): n is a, c, g, or t
  misc_feature (686)..(686): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtnnnacncnnnacacacacncacacncctacncacnacaccaccacccacggggggcggggagcgcactaacagaagaataacccccaagagggaggcgacaccaacaatgatatccgacgtccacaccccaacgcgtcttcctggattcaaacaaagggtggggccccacaaataagagggcagagcagcaacacacactcaccaccgcaaagagccgagggggcacgagcgtcatgctaataacaaaccacgcggcgtcgcgaagcacgcggcagaacaaacctaggtgaaccaacacgacggacacaccctgttgagcagaaacacacaccacccaacacaccagggggcggggcagcacccacacacggcgggagaccacaagaaaccaccgccgaacagcaacgatactaacgacgacgcaccaaaggagaccacaccaacaacaaccatccaccgcgaccaccaacaggcgagcccaaacacacccagcggacccatcaatcacgacggcgccccaagacagccgcggtgcgccacaagccgaatcaagccagcatgcacaaacagcacatacaccccaacaagagccgcgccctcagaa

SEQ ID NO: 715797 - DNA, 1712 bp, Homo sapiens
  misc_feature (31)..(31): n is a, c, g, or t
  misc_feature (39)..(39): n is a, c, g, or t
  misc_feature (1403)..(1403): n is a, c, g, or t
  misc_feature (1409)..(1409): n is a, c, g, or t
  misc_feature (1412)..(1412): n is a, c, g, or t
  misc_feature (1417)..(1417): n is a, c, g, or t
  misc_feature (1419)..(1419): n is a, c, g, or t
  misc_feature (1442)..(1443): n is a, c, g, or t
  misc_feature (1457)..(1457): n is a, c, g, or t
  misc_feature (1461)..(1461): n is a, c, g, or t
  misc_feature (1470)..(1471): n is a, c, g, or t
  misc_feature (1473)..(1473): n is a, c, g, or t
  misc_feature (1712)..(1712): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaatttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaacaggaaaaaaaaacacacaaaacaaaaaacaaaaacaaaaaacacaacaaaaaaaaaaaaaaacaaacaccgcgcgcggctaatttggggggggggaaagaaggggaaacagaagggaggcgggggaaaaagagggtactgagaggccccaagatattgaaagaaaagagaggggaaaaacagcgggaggacaccaataaagaagaggagcaataaaagttgacaaggacacggggaaacacacgcaataaaaacagagcggcacaaccggaaagagaaaagagagagaaagagaaaagcacagaaagagaccgtgacagaggagaacgaagggaagacgaggaagacggaacaggaaaagtacaagacgaaagaaaaagaaagagacggaaaaaagacaaagaaaggaagaagaaaaaaaaaaaaaaaaaaaaaaaaaaaccggggggcaatataggggggggggggaaaaaaggtaaaaagggncgggtnatntttcngnacccttttttttaaggggggaanngggggcccaaaggngggnaaacaaaanntngtacccgttctctcttttatctttcgttcgaaaaacaggacaaccgcaaaaagaacatagctacaggggatcaatgtgtaacaacaacgcgctaggacaaaaattcatatagatacaaacttaacaacaatacgaatagtagaaatatacaacgtataaacgatcacatgtaatatcacagtaatagatagataatgaatattaaatctgagcgaggagaacgagggaaaatatccgtn

SEQ ID NO: 715798 - DNA, 768 bp, Homo sapiens
cgggtcctgcgcgctccggactgagtgtggctgtcctgtggcctggatcggcggtgtcccggcgtggcttgtggaagccggcactggagctgggatgctgcactggtgcgcggtgaccgtgtgatggctgcatgggacctggacggctcccgagtctgcccacctgactggtacctgatgatgtgtgctgtgctgccccatccgatgcatgatgcctgtccctgtgccactcctcctgtgtgatcttgactttgtgctctttgctgtgtctgctggtgcaccttgtgaactgcccttgtgtgtgttgttgcgttgtgctcctcctggtagtgcgccctttcccgggctgtcctggctttgtggtgttgtgttggttgtgctgtttgacttccgatgcccctgcctctcccatgtgaggatggagtggctccacctctgctccttctgtgcctcctcccctgtgtgtgcctgcgatgctgactcggtggcctgtgcttcctttgcttcccttgccttgcctggcgtgttccctgtcttggctatggaactgacatgtcttcgacttccccaggatgatgccaaagctgttgtcttggcccctagtgttggtggacaatcgagatcttggcttgttggaccgttcttgcccttgaccttggacatggggcccatggccttgggtgcttgcaatggcagcaccctacggcccggccctgtcacgggtgcttgacccagctttgcttggttggctctctttctgggcctggg

SEQ ID NO: 715799 - DNA, 382 bp, Homo sapiens
cgtgctgcgggctggattccctgctgtcgcgctgggactgcaagcacaggttcaggtgccgggtccccggagcctcgatctctggcccgagcagggtaacccgagagcacgttactggcgaaactgccccgaaccactggcacgtggctctattaccaagtttaagcccattaagcaatattaatatttatgcttctctgccttataaaagtactactggcttggtgaagatgtcttaaaaaacaaaggaaaagatttttaaacatcactctttattccgcctaaatcgtataatttttttctgcctttgctctgcaattttaagaggtcttttttccaggtagaatctggagctcttgtaaataaaggatacttcatggag

SEQ ID NO: 715800 - DNA, 685 bp, Homo sapiens
cgcccacgcgttccggaagtgcagttcttcttccacctaagggaccgccacgcagacgctggggggatctgccctgcccccaccagttcccaccatcctttccaaaacaacagtcaatgatctggttggtgaggtgagcttccaacaacggaagatatttaaatgaaaaaagaattgataataaaatcaggagtcaaaattcatcgtctgcaagcccctcttttagccttttatactccctgttggtcaaggttgtgccccactacagaacagggctaaattagccaccaccactgaaaactcagccgaatttttttataccactctgatgtcagcattttttccatctgttggggctttttcctcttttttccattctccccaaatattttatctggcttcaaaattaagaggattatttttcagatgtttttattcagtgtggccgattcctcatctgattcaggctgtccagtcaggcccctcccattttaggagctggagccttcatttatgaagagattctcatctatgaaatggatcctcattgtaaatcttttttcttccattttcacaaagctgtaaagaaataatccatctcaaccttaaccttttctctggagtcagggggtctttcctcgctcatcttacacagaactgagctggagctcactggtttggtccc

SEQ ID NO: 715801 - DNA, 256 bp, Homo sapiens
gtcattcagcaggcatccctttggcgtccatttaggcacattgctcagtggggcacatggccatggccaccacttgcctttcagtgtccatgcagggcacatggcacctttcagtcaactgggcagggcacccatccatatcacaaccaccccaatcaccatccaccagcaagctgttgcttgagtagacatcatgcccccaggcagcacaaggcacagtgcatgttgcaacagcacagggccaggggcaccatcc

SEQ ID NO: 715802 - DNA, 429 bp, Homo sapiens
  misc_feature (65)..(65): n is a, c, g, or t
ttatccagctttcttttctgttgttggggaagagaaaccttcccttctaccctataggtttagcnaaatgagggcctgtgagttaaactgacaaaagacagattagcaagagaaaagagagagtatgtggggtgggggggcaccggtagtgggtgcttggtggctcacacctgtaatcccaggactttgggaggctgaggtgggcagatcacgaggtcaggagatcgagaccatcctggccgacatggtgaaaccctgtctctattaaaatacaaaaaattagctggctgtggtggcgtgcgcctgttttcccagctactctggaggctgaggctggggagtcgcttgaacctgggaggtggaggttgcagtgagctgagatcatgccactgcactccagcctggcgacagagcaagaatcagtctcaa

SEQ ID NO: 715803 - DNA, 127 bp, Homo sapiens
tagaggatccctcagtgcgatatgcagattcccaaaattttgtaatacagatgacacttatgaagagctcatttaatcgtttataaggccatgagtgcggctgtgtgctttatgatcgacgctctgt

SEQ ID NO: 715804 - DNA, 222 bp, Homo sapiens
gcgatttgtgtgtttgcaaccgggtgtggggcaagggaggggcccggccacccaggtgggccagcgggatgcctgggcaggccggtgggttatggctgaccacttcttcccattcctcagtgcaagaattgggcactcccggtcatccgagtctgtcccgaaggtttaactgcgcgcggagagagagaggccttgtaggtatccaaaagggacggagctcca

SEQ ID NO: 715805 - DNA, 834 bp, Homo sapiens
  misc_feature (244)..(244): n is a, c, g, or t
accgaggccaacctcatcgtctacattgcgtccgtcccgctatgacaggacgcctatgcgccagacatcgtggcagctgcatgtcgacttacagctcggtatgggcatgctcgctaccagacaccactatgctcctactactgaaaggcacaggagcgcactgcgtcgggcagcactcatgctccgccacatactggatgagagctacgagacttatccatagagtgagttgatctcatgcttncagcagctacacggtatcttctgtatgacatggtccgatatcaccggaagaaggttgtgtacgcagcccagaacagagccttttacagactctaagcgagagatgcctggaactgggactaagatgacactccaactgcctagaataagacctatgctgtcagagaacacgtctgagagccatcctgaagctctgcacgacagtatccaagacgcgcaaactacactgtagatcctggaatctgtctaacgaatggcacagattgcctgtggactgtcaccgtgtgagagtatgactccaaccatctaggtccttatgagatgacaacaaatatcattggctagagagaacattccttccccagatgaagcgaagtcgccttcacagaacactctgagagatctaacagttgatatgcgccgtcagagtatcaggaacaggatttgactgcacatgttacatctgctacacagagtggaacttaagctccttcaggacaagttctttgccctaagccatgccgaaacatgagagggagcacgcagaattatatgggaaccttgttgaatcagactctactgtcagttagg

SEQ ID NO: 715806 - DNA, 331 bp, Homo sapiens
agccagctactcaggaggctgaggtgggtggatcacttggacccaggaggtcgaggctgcagtgagccaagatcacaccactgcacttcagcctgggcgacagagtgagaccctgtcaaaaagaaaatgaagggtattttgttgtgaggaatcagtttatgcatagtctgggatgtggccagtgacctctggatactgccctgtttggtgccttcctgaaacatgttacaaattctgttttataaaatgcctgatctctctgtctaaaactttagaatcagctgggcacggtggctcatgcctgtaatcccagcacttttgggaggccgag

SEQ ID NO: 715807 - DNA, 334 bp, Homo sapiens
ctagaggataccctctgcatcgctaatcctttcctccgcttacagtactaaccagtggtttgtacgctcactgtcactcactgtatacagaaatgtgtgccctatacttcctgtgacgatcattttgctgacagaatgctggatgtagaaaatatagcaccaagtactttctagaaaggtctgttaggaccagaagcagagacaccaattttcacaggacgtcttggtttcagcattacctaaagaccagggaattgggagccatcatatgtcacagtgtgcagaattcaagcatatttgagggcatcactaatgatactcaaagttcagcatt

SEQ ID NO: 715808 - DNA, 926 bp, Homo sapiens
gctcctgaagatgggagtggtgtaagatggctgctaccgagcgtatgttgcccgacatgtgaatgccattaccttgggcgcattcctgccactgctgacctcaggcctgctgcgatgtggaagccaacagatgacttgatgaatactttacttgtggtactaggctccaagttcaaacgacgaacaattcatgtcgagcgaatcatgttcctcgatggccatggcaccctgactgtccaaccgcagtgatgcgacgcctattatctatgcggtacacgccgtcgtcagatggagagtacatcagacctaagcccttgatggactttgataggggaaatatttagatgcttttctactatccgttgggatttcagctttgtgttgtcctggcatgaaattggttgtctctctatagtgacaaagctaacgaatttcacgatgtgaaactgtgaagttgtcgcagtctcagtggattcccactttagccatcttgccctggataaatacaccaagaaagaatggtggtttgggccacatgaacatcgcgactcttgtcagacttaataagcagattcccgagactaccggtgtgctgttagaaaggttctggtcttgccctaaagaggtctcttcataattgacccaatggagtcatcaagcattgagcgtcaacgatctcccagtgcgccgaagcggggacgaaacctccggtggggaaggggtccagttgttcaaacctggaagttgcgccggatgggaccgattctcttaaacacgccggccgtgttccaagtcttcaaggaacgaaccacggttttgcttcacggaaacacgggaacgtttcttaaaggtttgcaagccccctgctctatccacgcggtctgtgcacacggggcagacagggggggccacaacacatatacact

SEQ ID NO: 715809 - DNA, 279 bp, Homo sapiens
cactctagagatccatcccggtctgggtatacgttagaaatacctgaattgatcagatgatcaggattgagtgtacaggaagttgatgacagatcactttgtatgtgattgagagtggctgagtgaaacaatgaaaaagtgggggaaagagattttgttaaaaaaagcagcccaactcagggatataaatattaccctaggcgcttacaacaattagttacacatctactggcatttaacccccacatttggtttacctctcatattccaattaaggtt

SEQ ID NO: 715810 - DNA, 810 bp, Homo sapiens
cggggagtgtgccccccccgttgcacaccgtctggtggggcacagaaatgtgggcccccaccggggacaccccgttccttctccgtggggggacagagcgggctgcgctggtggccggccgagatcacccccgcttggcgtgccccccctcgtcagaccccgcgttttgttttgggcccccaccctgccctccggcggccttcttcctctctgtggtggtgcacctggcccaaccttttgtggtttcagcaggagtttcaacggaggaatgtttggtcccccaagtgccccgtgggggttccatcccggagaagacactggtcccaggactgtgctcggtttgacagtggtctctatccctttatactgctcttgagggggccctcatgctttgtcatagtcctgtgcagactatccccccggggaatccactctctacaccccgcgagcgttgccggcccagtttttccccgctttggcgccgtggcaccctccagcgccgcagacgcctacaacattgtcccgaatgtttctgggcgcccgcccagagcaactccccaaggacgcccaaccccagcccctgatatgtataacccacgaaaaagagatttcaccagaggaagcgcagcccacgaggagttgatgtagctcctaagagagcaccagggagtgggcggcacccccgacccccgatcgtgagactgggggcaacccccccccccccccccccccgccggatgggggggggggtaaaaaggaaaaaaaggctccccccaatccccctaaattccgggttttcattcaaaagga

SEQ ID NO: 715811 - DNA, 154 bp, Homo sapiens
  misc_feature (7)..(7): n is a, c, g, or t
  misc_feature (122)..(122): n is a, c, g, or t
  misc_feature (140)..(140): n is a, c, g, or t
tccatgncacatatgggaagtggggatcaaatgaggtcttttctgactgatacagaattgttttcccctacaggtttttgggggcatagttccaagcacactggcaattttgctcattcctnaatgcagaggtggccttnaagatgtggccttc

SEQ ID NO: 715812 - DNA, 799 bp, Homo sapiens
tcccaacagattaccccttcaaatcacctaaggttgcatttgacacacaagaatttatcatccaaatattgaacagtaatggcatgcatttgtcttgatattctacgatcaacaggtggtctccagcactacactatttcaatacagtactcttgtgcatctgttctctgtctcgtgtgatcccatgtccagactgatcctttggtaggtgcctgatgattgctcggatctacaaaacaggatagagaaaaggtacaaccatgaatacgctcgggaatggactcagaagtatgcgatgtaattacaatgaacttagtggatagcctctagcaaataacagataggggaactctgaaacgagaaagtccttttgatttccattggacctgctttctatgagcccacggcctcatcttccccgtgtgcacatgtttacctgatacagcagtgctgcgtgtggtacatacttggaacaacaaatagaaatactgtacttctgtaccaacgattgctcctagcagagaagtgtgtgtgtgacaacgccagttctacaggcataacctaggtggtgagactaagagctttgcttattgatcttaaattgtggttaccagcaacgtgtgaggggcggtggtgggaatggtgtgtgctcggaatgggaaaaaaaaaggtcaatcagataataggagataattttaacgtggaattcatttaatcccaaccggtttgaccaagcaaggtgaaacatgaagtgggctgggtccatattacaaagaaaaaggttaaggaaagtttgcac

SEQ ID NO: 715813 - DNA, 324 bp, Homo sapiens
gcggccgcctactactactaaattcgcggcccgtcgaccggcgcgctgctgtcgcccgaaacataggccgccacttccacgccctcgccggcatggtgcaaggcgttgcgagtcaggttattcaacagccgcttcatcgacacccgccgcaacgggaacggctggatcggttgcaaccgcgtgcgtacccgctcttcgctctggttatagggcgccaccacttcgcgcaccagctcgctcaggtcgacctcttccaccgactcgtcgcgaccgtcgcggataaaggcgaggaactggtcgaggatcgcgtccatgtcgtcgacg

SEQ ID NO: 715814 - DNA, 80 bp, Homo sapiens
gttattccctggcctgaagatttggattgctgagattgacattatctaattggaattcatcctgaacccgaggttgtgcc

SEQ ID NO: 715815 - DNA, 161 bp, Homo sapiens
aaatcctaattacggagaatcacgctcacgcttcaggaccgagcttccctgactcccagatgacctcctgctctcctaacacgcatcctcacagcactccgagtcctgtgattgtgtgtgtgataacctgtctaacatcttgaatcagggctgagactggg

SEQ ID NO: 715816 - DNA, 131 bp, Homo sapiens
cccctcccccaaagggggggggggggggggaaatatggttggcctgccccagggggccttcccctttaagggccttttttggggttgagggccctggggtttttaaaattaaaaggaaagcccgcccccta

SEQ ID NO: 715817 - DNA, 152 bp, Homo sapiens
atcccacctcaatctgcctgctatgatggattagattgagagagtgaggagaaggcttacgtttagtgagggagagatttggtatatgattgccgctggtggctagttttagtcatgtgctatagctgcatagccggatgtcagcaggggtg

SEQ ID NO: 715818 - DNA, 680 bp, Homo sapiens
  misc_feature (31)..(31): n is a, c, g, or t
  misc_feature (39)..(39): n is a, c, g, or t
  misc_feature (656)..(656): n is a, c, g, or t
  misc_feature (662)..(662): n is a, c, g, or t
  misc_feature (667)..(667): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgctgatncggccngactnctttctctatctc

SEQ ID NO: 715819 - DNA, 259 bp, Homo sapiens
  misc_feature (2)..(2): n is a, c, g, or t
tnctttatttttccggcgtcaggaaagatgcaggctggcagtggtataacgagaaaataagtccaaaggaaaaagaaaataaacctgtacctgcagccccccgtcaggagccggatattatgcagaaactggccgcgctgcagacggcaacaaagcgggcgctgtacgaagccattctgtatcccggcgtggataattttgtgaaatatttccggctgcagaattactggactcagcaggccgggcttttcaccatgag

SEQ ID NO: 715820 - DNA, 326 bp, Homo sapiens
ccgacgtcgcgacgctcatccccggggacatagcgttgccgtcggtgcgtcatcttcggggaaagtgtctttcagcactgcagcgcgttttatgagtggcatgggttttgtgggcgtagagagttctgtatgtgagtgtgtgttcagctatgtggtgtccagtatgggcggcgggtctgaagcgttctcttcgtttctctcagagagaggtctttcacagagcaaaggtgtttcattttgatgaagtccggtttatcagtggtctcctgtggattgtgctgttggtgttgtgtgtgataactcttcacctagccctagatctcaat

SEQ ID NO: 715821 - DNA, 697 bp, Homo sapiens
  misc_feature (31)..(31): n is a, c, g, or t
  misc_feature (39)..(39): n is a, c, g, or t
  misc_feature (652)..(652): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgcngagcggccgaatttcaacacaataaggacgagcacataatttgaa

SEQ ID NO: 715822 - DNA, 352 bp, Homo sapiens
actgcatatgggtatgtcttatacattccctagggcatggattatatacataacaaattaacctctaagcctgtagcatgggactatttacctactgttctcagcaaagttcagaaaacactcaaattatttgctgtttttttgtttttgtttttgtttttctttttttgaggtggagtcttgctctgtcgcccagggtggagtgcagtggcgcgatcttgcctcactgcaacctccctctctggggttcaagtgattctcctgcctcagctttccgggtagctgggactacatgtgtgcactacaatgcctggctaattttatcatatttttggtagagatggagtttcgc

SEQ ID NO: 715823 - DNA, 1457 bp, Homo sapiens
  misc_feature (31)..(31): n is a, c, g, or t
  misc_feature (39)..(39): n is a, c, g, or t
  misc_feature (1148)..(1148): n is a, c, g, or t
  misc_feature (1154)..(1154): n is a, c, g, or t
  misc_feature (1157)..(1157): n is a, c, g, or t
  misc_feature (1162)..(1162): n is a, c, g, or t
  misc_feature (1164)..(1164): n is a, c, g, or t
  misc_feature (1187)..(1188): n is a, c, g, or t
  misc_feature (1202)..(1202): n is a, c, g, or t
  misc_feature (1206)..(1206): n is a, c, g, or t
  misc_feature (1215)..(1216): n is a, c, g, or t
  misc_feature (1218)..(1218): n is a, c, g, or t
  misc_feature (1457)..(1457): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaaataaatgtaattaacaggaaaaaaaaacacacaaaacaaaaaacaaaaacaaaaaacacaacaaaaaaaaaaaaaaacaaacaccgcgcgcggctaatttggggggggggaaagaaggggaaacagaagggaggcgggggaaaaagagggtactgagaggccccaagatattgaaagaaaagagaggggaaaaacagcgggaggacaccaataaagaagaggagcaataaaagttgacaaggacacggggaaacacacgcaataaaaacagagcggcacaaccggaaagagaaaagagagagaaagagaaaagcacagaaagagaccgtgacagaggagaacgaagggaagacgaggaagacggaacaggaaaagtacaagacgaaagaaaaagaaagagacggaaaaaagacaaagaaaggaagaagaaaaaaaaaaaaaaaaaaaaaaaaaaaccggggggcaatataggggggggggggaaaaaaggtaaaaagggncgggtnatntttcngnacccttttttttaaggggggaanngggggcccaaaggngggnaaacaaaanntngtacccgttctctcttttatctttcgttcgaaaaacaggacaaccgcaaaaagaacatagctacaggggatcaatgtgtaacaacaacgcgctaggacaaaaattcatatagatacaaacttaacaacaatacgaatagtagaaatatacaacgtataaacgatcacatgtaatatcacagtaatagatagataatgaatattaaatctgagcgaggagaacgagggaaaatatccgtn

SEQ ID NO: 715824 - DNA, 1287 bp, Homo sapiens
  misc_feature (31)..(31): n is a, c, g, or t
  misc_feature (39)..(39): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaatccaaaaaaaaaaaaaaaaaaaaaaaaaaaaaaaaaaaaaaaaaaaaaaaaaaaaaaaaaaaaaaaaaaaaaaaaaaaaaaaaagaaggggggggcgcccccaaaaccccccgcggggggccccatcccccccccttttaaggggcccccaggggggccgtaaataacacaacacgacgagcggcggggggggcggttattaaaacaacaccgccgggcggaacaggaaaaaacgacgctcgcggcggggcgaacattgtgaggaagagacacccccacagccgggcggggggaacaaagagggggacacacacacctccgagagagagaatataccgcgcgccggggggaagacaaaaaaactgggcgggatacgggcggggtccaccccacgacgatacaaaatttgcgcggcggcgaagaaaatttggggccccaagacggtacttgtctctccgatcacactcttcttccgcggcgcccctcctcgaacatacaacacctcgggacgcctgacagacaatcatccgcagaccagcacagcagcgatggatcagacgagagcacagagcacactgtctgccgacgacaacaagcggagagacagacatcaatcagtcaatgacacacaactaaacaagac

SEQ ID NO: 715825 - DNA, 1085 bp, Homo sapiens
  misc_feature (31)..(31): n is a, c, g, or t
  misc_feature (39)..(39): n is a, c, g, or t
  misc_feature (776)..(776): n is a, c, g, or t
  misc_feature (782)..(782): n is a, c, g, or t
  misc_feature (785)..(785): n is a, c, g, or t
  misc_feature (790)..(790): n is a, c, g, or t
  misc_feature (792)..(792): n is a, c, g, or t
  misc_feature (815)..(816): n is a, c, g, or t
  misc_feature (830)..(830): n is a, c, g, or t
  misc_feature (834)..(834): n is a, c, g, or t
  misc_feature (843)..(844): n is a, c, g, or t
  misc_feature (846)..(846): n is a, c, g, or t
  misc_feature (1085)..(1085): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaaaaaaaaaaaaaaaaaaaaaaaaaaaaagcaacacaaaaaaaaacaaaaaaaaaaaaaagaaaaaaaaaaaaaaaaaaaaaaaaccggggggcaatataggggggggggggaaaaaaggtaaaaagggncgggtnatntttcngnacccttttttttaaggggggaanngggggcccaaaggngggnaaacaaaanntngtacccgttctctcttttatctttcgttcgaaaaacaggacaaccgcaaaaagaacatagctacaggggatcaatgtgtaacaacaacgcgctaggacaaaaattcatatagatacaaacttaacaacaatacgaatagtagaaatatacaacgtataaacgatcacatgtaatatcacagtaatagatagataatgaatattaaatctgagcgaggagaacgagggaaaatatccgtn

SEQ ID NO: 715826 - DNA, 878 bp, Homo sapiens
  misc_feature (569)..(569): n is a, c, g, or t
  misc_feature (575)..(575): n is a, c, g, or t
  misc_feature (578)..(578): n is a, c, g, or t
  misc_feature (583)..(583): n is a, c, g, or t
  misc_feature (585)..(585): n is a, c, g, or t
  misc_feature (608)..(609): n is a, c, g, or t
  misc_feature (623)..(623): n is a, c, g, or t
  misc_feature (627)..(627): n is a, c, g, or t
  misc_feature (636)..(637): n is a, c, g, or t
  misc_feature (639)..(639): n is a, c, g, or t
  misc_feature (878)..(878): n is a, c, g, or t
actacactaattaaattcgcggccgcgtcgaccgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaaaaaaaaaaaaaaaaaaaaaaaaaaccggggggcaatataggggggggggggaaaaaaggtaaaaagggncgggtnatntttcngnacccttttttttaaggggggaanngggggcccaaaggngggnaaacaaaanntngtacccgttctctcttttatctttcgttcgaaaaacaggacaaccgcaaaaagaacatagctacaggggatcaatgtgtaacaacaacgcgctaggacaaaaattcatatagatacaaacttaacaacaatacgaatagtagaaatatacaacgtataaacgatcacatgtaatatcacagtaatagatagataatgaatattaaatctgagcgaggagaacgagggaaaatatccgtn

SEQ ID NO: 715827 - DNA, 640 bp, Homo sapiens
  misc_feature (31)..(31): n is a, c, g, or t
  misc_feature (39)..(39): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaactgaagaacaaacttatggcacgtagcatgcggcataatatttc

SEQ ID NO: 715828 - DNA, 568 bp, Homo sapiens
gggagagtgagattttttccaagccattcctgcttcagtatagggttgtggtagctgtcaaaagaaggctttgaaaccatcctctaaaataaataaaaaataaaagcagcttattttagtatctctattgaaatacaaattacaggccattgatcttttccacaattccttgcaattatttctgttgacgatttttttaaaataagacaatgcaatatattttaaaaagcaaataaataaacctcaaggataagaattgcaccaaatgggtttgtaaatggctgtgacacacatttagtaggagaaaagcatcataaaacctagctttgttgttatttactacaatccacaataaagtgtgtcagtcattaggttaacacaactctgaatcagtctaaaatctcaccatggagggactgtttaactctacaagtttagactgtcttattcttgtcaggtcaactagttttccaaaatatgcataaattttaaataatgtataatgataccagaaaacagaaatgcatccctgtttacctcccctcagccccttgccttcccttctttg

SEQ ID NO: 715829 - DNA, 113 bp, Homo sapiens
cccgagacgaaaacagctgggggctgctggagattgtaatgggtatggagacatatcatatgagattgttgggctactgctcgcagtgcgccgatcagggcgcggctttcgtc

SEQ ID NO: 715830 - DNA, 352 bp, Homo sapiens
cccccccccctaaccccgggggcccccttaattttaaaaaccggcttacaggtttcccccggggggaaaaggtattaaaaatggttgggaatttgaaaaacccgcccccgggattatggccaaaaattttgtttaaactaggggcccattttttttggcccgggggtttaaaaaaaaaaaaaaaaaaccctgttttcccggggggggaaatgggggggtgcccaaaaaaccaaacccgcaaattggctttccccctttgttgtttttttccccccccaaaattaagaaggtaggccttttgtaaaaggcccaattaaaaatttttgttgggttttttatttaaagcctggta

SEQ ID NO: 715831 - DNA, 713 bp, Homo sapiens
  misc_feature (31)..(31): n is a, c, g, or t
  misc_feature (39)..(39): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtcattaaccggctaaaagacctagaggaaggcattcaaacgctactcgagggggggcccggat

SEQ ID NO: 715832 - DNA, 442 bp, Homo sapiens
  misc_feature (15)..(15): n is a, c, g, or t
  misc_feature (37)..(37): n is a, c, g, or t
  misc_feature (97)..(97): n is a, c, g, or t
  misc_feature (156)..(156): n is a, c, g, or t
gggggcttaattcantgatttccccaattttcagggnacaccctaggccaaacctaggccaaaatccatttcactatcatattcatggggggaaatntaacttttttcccacaacactttttgggcctatccggaatgccccgaggttactgggantaccccgagggataccccacatgaaacatcctatcatttggagggtcattcatttttttaacagcaggaaaattaataattttcatgatttgagaagcctttggttcgaagggaaaagtcctaatagtagaagaaccctccataaacttggggggattatatggaggcccccccccctcccacacatttgaagaaccggtaaaaataaaatttagacaaaaaaggaaggaattgaaccccccaaagggggtttcaagccaaccccagggcctccatgattttttta

SEQ ID NO: 715833 - DNA, 749 bp, Homo sapiens
  misc_feature (438)..(438): n is a, c, g, or t
actgggtctacgggcccgtggtacacgcgcagctcaagatattttgtcttttggaggtagagaccgtgtttaagcatgatagcccagtgatgcgtaactcgcatctcttgatcgtcgtgatccggccgactcggattcgcaaatttctgggagttacaggcgtgatgcctcgggacccagagcgaacattttatctctctagaagtctgtgatccctaggtatttaaaacctgattgcttctatatacctccataattcactgtcgctaaattgaataagttatttataactctgtgacttgctagactctaaatatctctttgatcataggtatgagtgctcaggagaggtagctagcagatgtcctgtattaggtagcaactttctattatacgacttcacagtggttcctctgatatcttgccttatcatcgttnatacactgtagatatcattttactctatcttatctactatacgtacatttcttaaaataatggttcttagtcgctagttcacaattgtgtgtcatggacggtcgcccctatatctctttagatacctttgtgttctggtttagcctgtaacaatctcagtgtcctatttacaggtatgaagtagatcgaaattccaggttgctcccttttaagtcgtactgtgtgctaacacaagaggtaaatgtttttgcttagaccatagtgccttgggttaaccctctgccagctgtgggcgcccggattcggctcca

SEQ ID NO: 715834 - DNA, 564 bp, Homo sapiens
  misc_feature (31)..(31): n is a, c, g, or t
  misc_feature (39)..(39): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttctggtttaggaacaatctgttccttttccgtaaggtcga

SEQ ID NO: 715835 - DNA, 627 bp, Homo sapiens
  misc_feature (31)..(31): n is a, c, g, or t
  misc_feature (39)..(39): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggcctacagagctcatggtcggattaacccatacatgagctctccctgccacattgagatgatccttacggaaaaggaacagattgttcctaaaccagaagaggaggttgtttttgtttcttcagtttcttctgggatatctacttcttctgggcaacctcctcttccgg

SEQ ID NO: 715836 - DNA, 115 bp, Homo sapiens
ttttggggggggggcccccccccccctttttccccggggggtttttttcccccccctttttgggggcgggccaaaatttgggccccgttccaaatttaaggggggttttttttta

SEQ ID NO: 715837 - DNA, 423 bp, Homo sapiens
cagttacaacagtggaatgagatgacttccagaagttagaaattgacgtattatgccataactgttcaccagagttgataaatctctaggtttacaattgtaccccaaggtcatgggactggaccccatcccatgtgtcgtcatcagtttagcaatgattaagaacatcaccttctgaaaatttgtatagatcgataaataaagtattccttgtgcaagacctatttttaagtattgtaggtactatttcctttcttgaattcatattgcagatttacggtgtggattcattgttttatctcttcaaaccttaagagtataagattgctagggccaggtgtggtggatcacgcctgttatcccagcactttgggaggctgatgtatgcggatcacctgaggtcaggagtttgagaccagcctg

SEQ ID NO: 715838 - DNA, 193 bp, Homo sapiens
cttgtatcagccagcttcaggaactcctgcagcgtgtttgttccacagcctccacgaagagctcatagtccccacagtactggtccccgttgacaatctggggtggggtggccttggtggttgcctgccaaggctcgcatctcatcctcctctgctgtccagtcctccctgtgctgtccacctcctctgtgct

SEQ ID NO: 715839 - DNA, 240 bp, Homo sapiens
  misc_feature (21)..(21): n is a, c, g, or t
  misc_feature (45)..(45): n is a, c, g, or t
  misc_feature (108)..(108): n is a, c, g, or t
  misc_feature (165)..(165): n is a, c, g, or t
ttttttttgaaggtcggaaancatctttattgtggggagggagancatcaggaaaaatagctaatgcatgccgggcttaatacctaagtgatgggttgataggtgcancaaaccaccatggtacacgtttacctatgtaacaaacctgcacatcctgcacatgtnctctggaacttaaataaatttttttttaaaaaaagaaatgcagatggataggagaatgattggttctgcctgaaa

SEQ ID NO: 715840 - DNA, 124 bp, Homo sapiens
caaaatccatgcgaactgaagtaatggcacgagcctcaccccctaaatcttacatctcaattgcccatccataaagaagcactcatacttgatgcatccccgcagctacacacacacaacacag

SEQ ID NO: 715841 - DNA, 1402 bp, Homo sapiens
ggagagaactagtctcgagttttaattataatatataggggtttccagacttgcaaaacatctggaggagggccttaacctctgcttccgggacctccatctcagactttgatagaggctcaggctcgaagggaccacgtggtaatccgcagtggggccatagggcatgagcagaactgtaaattacaaactgggcaaaaaattcaaccaccttctcatagagaacactataaatggttgcagcagatcacatgtaatgacgcactccacacaaaccacaatcacgagcctatcgattcatcaatattacaaatgcctcttaagagtaaacggctgtggaatctcaaacagcgcctattaccacccctcaatgtgacagacagtgcaccgtgacagttatcacatttcacagtcccatacctgttaacaggggatccccgatttatgggtacaaacgtcgtgtgggattctacatcctgtggataccgtgaacaatccccattaggacgcttttaacaccaccacatttcctcgagacagacgttcacgaaagaaaccccattcaccaaaggacacataaatagcattagaatggatcaccctcaacatatctcacggatttatcgaccagtggggacaccatatcactacacatgcatgagaacattgaaagaaaaatctccatgagaacctctacctcgctcttactatatgaccatcccactccgacactacgaaccaattgtgaccagactataccaacactgtggagagtatagaaaccgaatacataacacttaaataaatatgggcacagagttccacaactacaaatagcagtctgcgaaccacactatggtacaacaaggaacacataccgccaccaacatggacacagaaacctagaagtttaaccacaagggataataacacaagagggaaaaagagcaaaacatatcacgacgcaaaacagggaagaagagttacacttcaaaaaacgcaatctttgcatatacgcatccaccagatcacactgacgcacccccagaagacaaagaaaacaaagcgacaaaatagattagtgacgcacacacttaagcgacaaataaacgcccatcacaatatggacaccccacaggcgaaacagttaaacccacagagaacacttacccgaagaaacactccaaccacccagcggcccacaacaaaaaaagggagaaaacagaagaaatgaaacagagacaatcaacccacgaacaagacggagaaaagacaacagaacaagcagacaactaccagaaccaacaacataatcagagaaaaaagtacgcacgcgtaaccacacacgaaccaaacgggatcaccactaactacaaccaggagaacagcaacaagcaccacg

SEQ ID NO: 715842 - DNA, 680 bp, Homo sapiens
  misc_feature (43)..(43): n is a, c, g, or t
agtcgagctcgtacccgtagaagagggtgcgggctgtggtaangttacatctccaattgctgtcttaacataggcaataatggagaagaggttctggaaatcgcttcaaacatcagaaaagtagcccgtgtaccagtccaaacctgggagggatgggacccagcaaaccttctaggagggtggttctctaatttaggaggatttaaaatgctggtggggacagtcattttcatcactggggtcctcctgtttctcccctgtggtatcccattaaaactcttgttgaaactacagttaacctcctgacaatccagatgatgctcctgctacagcggcacgatggataccaacccgtctctcaagaataccccaaaaattaagtttttctttttccaaggtgcccacgccacccctatgtcacgcctgaagtagttattgagaaagtcgtccctttccccttttctataaccaaatagacaggaatggaagattctcctcggggcctgaaagcttgcgggatgaataactcctcctcctcaggcccagtcccaaggtacaaacttgcacctgcagcaagatagcagaggcaggaagagaagcggttggaaaacacgttacccctgaagatcaagagggaggtcgccctggtactacataagcagtcaccgttacgccgggaa

SEQ ID NO: 715843 - DNA, 144 bp, Homo sapiens
ttgtcacctgggggaccgcaggttgcagtgcaggcaagattgcaccactgcgactcccagcctgggtgacagattgcgaccctgtctctaaaacaagaaaaaaaaaagaaacacaaaaactccaggtggtcgcacagattgaca

SEQ ID NO: 715844 - DNA, 177 bp, Homo sapiens
gttgtgttactgaggagtgcgtctggtggtgcataccgaggtctcagatgtgactgttgaagaccgtgagggaactacagtgaaatgcatccaggttagagacccattaatcttgatcgttctttttttctccatcctgctttcatttgactttctttatccactacactccgccaa

SEQ ID NO: 715845 - DNA, 371 bp, Homo sapiens
ggcgatctagaggatccctgatatgctggtctcagaacaataaataaataaaaaagagattacatacctaggaagatatgtaacaagaatatgaagagagcttaaaaacactagtggaaacaaaaaaaagacgtgggactatatagaggggcgtggtatgttctgaggaagatttaacatcatacccctgtcagtgctccttaatttaatctataatgtaaaggagtgactccccctaaaaaaaaccaagtaggacttggggcttagtgggcttatttgtggggaagagaaatgagttgtaaagctcatacagaagatatagtgtacgactaaaatacacccagaaatctcccgagaaagaaaagaaatag

SEQ ID NO: 715846 - DNA, 237 bp, Homo sapiens
gcgtcgactacggccgcgtcgacttcaaatattatccccttcccagtttctccttcacaagcctcctattcctactcttttcccttgcctctatgagggttctaccccacctgtctacccacccctgcctcaggaccatagcattaccctaccctgggtcatcaagcctccataggaacaaggggctaccctcccagagatgcccggtcgacgcggccgcgaatttagtagtagtag

SEQ ID NO: 715847 - DNA, 190 bp, Homo sapiens
  misc_feature (19)..(19): n is a, c, g, or t
  misc_feature (48)..(48): n is a, c, g, or t
  misc_feature (53)..(53): n is a, c, g, or t
  misc_feature (99)..(99): n is a, c, g, or t
cacattgcaggaggatatntggatagctttgaggatatcgttggaacnggatngtcttcatataaactctagacagaagcattccagaagcttcattgngatgttcaattgaagtcacagtgttgaaacagtccctttcatagagcatgtttgaaacatcctttttgtagtatctggaaagtgggtccat

SEQ ID NO: 715848 - DNA, 426 bp, Homo sapiens
cacagacccgagccgccgacgacccagcagccgccatggctatgctccgacgtgtgcctgtatatgctgctcatccaacgccctttggagcttacggaggccttctgaaagacttcactgctactgacttgtctgaatttgctgccacagctgccttggctgctgacaaagtgtgacctgaaacagatgaccgtgagattatggtcaatgacctgcaaagttcttcagatgctatatattaggccatgcatgaccgtttgcgtgtgggaatcccagatgagaccccagctctcacgattaataggatctgtggttctggttttcaggccattgtgaatggatgtcaggaacttcgtgttcatgatgctgacgttgttttatgtcgatgaaccgcatgcataagcccatgcttactgtgtcgtgtgg

SEQ ID NO: 715849 - DNA, 238 bp, Homo sapiens
tgactcgaagtgtgtaacctttgtgctggacgccagtgttattccatagcacgcccagaggcggagtctcgctctgtcgcccaggctggagtgcagtgtggcccgatctcggctcactgcaacccccacctcccgggctcaagagatccacccacctcagcttcccaagtagctgggactacacgcgcccgcaccacaaccggctaattttgtacttttagtagagaccaggtttcac

SEQ ID NO: 715850 - DNA, 421 bp, Homo sapiens
  misc_feature (14)..(14): n is a, c, g, or t
  misc_feature (73)..(73): n is a, c, g, or t
  misc_feature (418)..(419): n is a, c, g, or t
  misc_feature (421)..(421): n is a, c, g, or t
cctaattgcgattnatgacttgcctggaggccttagtatagacaaatcctgaaagttaaaaactcctaggganacctttttttggttttaccctccccggagctcctaccccggttcctcacagtaaagatcccaagcccagtgtggtggctcactcctgtaatccccagcactttgagaggccgaggcaggtggatcacttgaggtcaggagtttgagaccagctggaccaacatagtaaaaccccatcgctactaaaaatacaaaaattagctgggcatggtggaggacacctgtaatcccagctactcaggaggcagaagcaggagaatcgcttgaacccgggaggcagaggttgcactgagccgagatcacaccattgcactctaacctaggcgacagagaaagactgtgtatnngn

SEQ ID NO: 715851 - DNA, 375 bp, Homo sapiens
  misc_feature (47)..(47): n is a, c, g, or t
  misc_feature (55)..(55): n is a, c, g, or t
cgagtggatcacaaggtcaggagatcaaaatcatccctggttaaacnggtgaaanaccgtctccactaaaaaaaaaaaaaaaaacaactagctgggcatggtggcgggcacctgtagtcccagctactccagaggctgaggcaggacaatggcgtgaacccgggaggcagagcttgcagtgagtcaagatcgcgccactgcactccagcctgggcgatagagcaagactccatctaaaaaaaaaaaaaaaaattagccaggcatggtggtacgcacctgtaatctcagcttatcgggaggcttaagtgggaaaatcgcttgaacctgggaggtggaggttgcagtgagccgagatcacgccactgcactccagcc

SEQ ID NO: 715852 - DNA, 319 bp, Homo sapiens
agctcctatgagcataaacataacatgggatcagatccacatgaaactgaagtccaatatccatgcaaggcaccatgagggagccacaagcatatacacacagtactcgctgagaaatggtatacaatctcatggtgtggtgaaaacaccacatacagaaacttactataaacaggaacagagaaaacaaagtagtaaaaatctaaatagatcctgggtaaacacatggttcaacacaataccatcaactcaaagacctccctagcaatacacggtttccaattcatgaaccttctaaacagcatactcatctattcat

SEQ ID NO: 715853 - DNA, 827 bp, Homo sapiens
ggcaagaacctgggctgtaactgccacctgacaccgctgactggctaaatgctttgcagaaagtgatgaccttacaccacaaccagcttctccaggtcatatgtgccttacctccagagagtcttttttttttttttcctggaaatgggatgttccactcttgttggcccaggctgggagttgcaatagctatggatctcggctcactggaaacctccgcctccggggttcaaaaaattctcctggcctcaagcctcccaagtagctggggattacagggctctatggccaccatggcccagttaattttggataataatcaatgggttgtttttcagccagagacgggggtttcaccattgtgggccaggctatgtcacgaaatcttaacctcagggtgatccacccaccctttggcctcccaaagtggctggggatcacgggcttgagctaccacacctggtgttggcgagagtctaaataagggaaatttccctaattggtccattaattcttcctaaatccagaccggtggtttcagaaataatccttatctgtgagagtagaccatttttctgggcggtaactgtgtcagaaacctaggaggaaaatacgccaagactatgggcacacaaagattactctaacccttaaaagacttttaaatccctactagaggtgccccttttaacaaatacactccagtggtttaccttatttgaccctcctttagtgagtaaaagtgaattcctccgtgttcggtttttcaaaccagctaatttttggtccaccacaagtgctttttccactgtgggcaactttcaatt

SEQ ID NO: 715854 - DNA, 564 bp, Homo sapiens
  misc_feature (12)..(12): n is a, c, g, or t
  misc_feature (383)..(383): n is a, c, g, or t
taatgttctagnttggtttggttttgaaaagattaataattactccaaatgaaatgttttttctttggttactaatgtgaagggagggtagaaacttgaggctagatttctgataaaagaagaatctgtcgagagtatagttttttagttaataagaaggaaggagagagggggatgagtttgtacccttgagaagaacttttatgagccaatttctaaagtattaatttggtatggatactttgtatataaattagctgtgtttaatggacacacaaatgtgaataaaaatgtgagcacatgccgggaccacagacctttatccaaaatatgaaagcagcagttattggtcaatttaaggaattcattttgtaaaaaaaaanaaaatccttcagcctggatgagagaaaaaaaaaaaaccaaaaaaaccatcttgaagctcaacctgtaaaacttgaaattctcctggaacagggctgggtgtttttgttttgttttttctttcgaacttttgttccacaaacaggaagttttgtcttttatgctgaagctcagacaccagca

SEQ ID NO: 715855 - DNA, 370 bp, Homo sapiens
attagggctggctgggcctaaaggtttccccggctcacgttcacgttcacgttcatgtgcacgctcattgatctttgtcgatcccctagaagtggattttctggtgctcaatcagggcatgaactatgaatggaaggtttcctatacacaccctgtcactcgtatcaatttgtctttgtccacatattttctcgatgctcactagactggtggggctaaggcatgacggcttccttcacattcctgattcttacattccacaagataacctctagcatgaatcttccgatgttcagccaaggcggcactcttattgaaggtctctccacagtccttacgttcataacgtttccctccaacctgacttctc

SEQ ID NO: 715856 - DNA, 1324 bp, Homo sapiens
  misc_feature (39)..(39): n is a, c, g, or t
  misc_feature (1015)..(1015): n is a, c, g, or t
  misc_feature (1021)..(1021): n is a, c, g, or t
  misc_feature (1024)..(1024): n is a, c, g, or t
  misc_feature (1029)..(1029): n is a, c, g, or t
  misc_feature (1031)..(1031): n is a, c, g, or t
  misc_feature (1054)..(1055): n is a, c, g, or t
  misc_feature (1069)..(1069): n is a, c, g, or t
  misc_feature (1073)..(1073): n is a, c, g, or t
  misc_feature (1082)..(1083): n is a, c, g, or t
  misc_feature (1085)..(1085): n is a, c, g, or t
  misc_feature (1324)..(1324): n is a, c, g, or t
gaactgccatcagagccaatctctgttcacttagacccnctgaactgctcggcctcagggctttacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaaataaatgtaattaacaggaaaaaaaaacacacaaaacaaaaaacaaaaacaaaaaacacaacaaaaaaaaaaaaaaacaaacaccgcgcgcggctaatttggggggggggaaagaaggggaaacagaagggaggcgggggaaaaagagggtactgagaggccccaagatattgaaagaaaagagaggggaaaaacagcgggaggacaccaataaagaagaggagcaataaaagttgacaaggacacggggaaacacacgcaataaaaacagagcggcacaaccggaaagagaaaagagagagaaagagaaaagcacagaaagagaccgtgacagaggagaacgaagggaagacgaggaagacggaacaggaaaagtacaagacgaaagaaaaagaaagagacggaaaaaagacaaagaaaggaagaagaaaaaaaaaaaaaaaaaaaaaaaaaaaccggggggcaatataggggggggggggaaaaaaggtaaaaagggncgggtnatntttcngnacccttttttttaaggggggaanngggggcccaaaggngggnaaacaaaanntngtacccgttctctcttttatctttcgttcgaaaaacaggacaaccgcaaaaagaacatagctacaggggatcaatgtgtaacaacaacgcgctaggacaaaaattcatatagatacaaacttaacaacaatacgaatagtagaaatatacaacgtataaacgatcacatgtaatatcacagtaatagatagataatgaatattaaatctgagcgaggagaacgagggaaaatatccgtn

SEQ ID NO: 715857 - DNA, 206 bp, Homo sapiens
atggagctggaagtagagccggtagattggactaactgccaagaagagagaacttgtggtcaggcatgatggctcatgcctgtagtcccagcgctttgggaggccgaggcgggaggctcacctgaggtcaggagtttgaggaccagcctggaccaatatggtgaaaccccacttctactaaaaatacaaaatttagccagctgcgg

SEQ ID NO: 715858 - DNA, 627 bp, Homo sapiens
ctctggcggaacacaggtctcgtgtgacattgtacactgtagattacagcatgtccaccactactgagcatatgaactataaatgctgatgaattagcccgagacctattgatggattgggtaacgctgatgatgagatggtaaagggctcattcaagtatgcctgatgcttgcataaactgacagctgagcgttaacgatgtatcaccattgatatctccttgtggaaatatgagaccagcttgtactatgtgactatcattgacgtacgacgacacagtgactttatcaaagtcatgattacagtgacatctcaggctgactgtgctgtcctgattgatgctgttggcgttggtgaatatgaggctgatctattcaagaatgggcacgatccgcagcatgccccttaagattcacacgctgacatggaaacagctaatggtcggagtcataatgcattccactgagccaccctacagtcagattagatgtgaggtaattgataaggaagtcagtacttacattgcgaacattgtctacaaccccgatacagtagacattgagccaatacctggtagaatggtgacatcatgctgtgagcaagtgctcatgctttgttcacgggtg

SEQ ID NO: 715859 - DNA, 1014 bp, Homo sapiens
  misc_feature (31)..(31): n is a, c, g, or t
  misc_feature (39)..(39): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaattaaatgtcattacacaggacaacaacaaaaaaaaaaaaaaccgcgcatacatgcgcggccgaccaaaggtataaaaaaggacatggctaatctgtgtccccgacacaagctttgaacaaggtgtaactcgcgggctcataagagagtggatactcaaaccggtactgtatatcgttgcacaactagacgaccagatgtcagtaacggatcagggatcactgataaaactcatacagacatacaccaactctaactacgcaagttaattacatgtaacagaaccgcgagacatcaacaagcataaactaacagccaatgctactcatcatgactgtaa

SEQ ID NO: 715860 - DNA, 1452 bp, Homo sapiens
  misc_feature (31)..(31): n is a, c, g, or t
  misc_feature (39)..(39): n is a, c, g, or t
  misc_feature (1143)..(1143): n is a, c, g, or t
  misc_feature (1149)..(1149): n is a, c, g, or t
  misc_feature (1152)..(1152): n is a, c, g, or t
  misc_feature (1157)..(1157): n is a, c, g, or t
  misc_feature (1159)..(1159): n is a, c, g, or t
  misc_feature (1182)..(1183): n is a, c, g, or t
  misc_feature (1197)..(1197): n is a, c, g, or t
  misc_feature (1201)..(1201): n is a, c, g, or t
  misc_feature (1210)..(1211): n is a, c, g, or t
  misc_feature (1213)..(1213): n is a, c, g, or t
  misc_feature (1452)..(1452): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaacaggaaaaaaaaacacacaaaacaaaaaacaaaaacaaaaaacacaacaaaaaaaaaaaaaaacaaacaccgcgcgcggctaatttggggggggggaaagaaggggaaacagaagggaggcgggggaaaaagagggtactgagaggccccaagatattgaaagaaaagagaggggaaaaacagcgggaggacaccaataaagaagaggagcaataaaagttgacaaggacacggggaaacacacgcaataaaaacagagcggcacaaccggaaagagaaaagagagagaaagagaaaagcacagaaagagaccgtgacagaggagaacgaagggaagacgaggaagacggaacaggaaaagtacaagacgaaagaaaaagaaagagacggaaaaaagacaaagaaaggaagaagaaaaaaaaaaaaaaaaaaaaaaaaaaaccggggggcaatataggggggggggggaaaaaaggtaaaaagggncgggtnatntttcngnacccttttttttaaggggggaanngggggcccaaaggngggnaaacaaaanntngtacccgttctctcttttatctttcgttcgaaaaacaggacaaccgcaaaaagaacatagctacaggggatcaatgtgtaacaacaacgcgctaggacaaaaattcatatagatacaaacttaacaacaatacgaatagtagaaatatacaacgtataaacgatcacatgtaatatcacagtaatagatagataatgaatattaaatctgagcgaggagaacgagggaaaatatccgtn

SEQ ID NO: 715861 - DNA, 169 bp, Homo sapiens
agaggatcccgggtgcagcacatatgctccaacccctgacactgaatggactttgaaatatgcccacaggtatcctttatccacggacaatctctgagtgcttattattcactttactagtgtagaagctctttaatcattgtctctgcatttgctttaatctagaaac

SEQ ID NO: 715862 - DNA, 1672 bp, Homo sapiens
  misc_feature (1363)..(1363): n is a, c, g, or t
  misc_feature (1369)..(1369): n is a, c, g, or t
  misc_feature (1372)..(1372): n is a, c, g, or t
  misc_feature (1377)..(1377): n is a, c, g, or t
  misc_feature (1379)..(1379): n is a, c, g, or t
  misc_feature (1402)..(1403): n is a, c, g, or t
  misc_feature (1417)..(1417): n is a, c, g, or t
  misc_feature (1421)..(1421): n is a, c, g, or t
  misc_feature (1430)..(1431): n is a, c, g, or t
  misc_feature (1433)..(1433): n is a, c, g, or t
  misc_feature (1672)..(1672): n is a, c, g, or t
ggcaggcggagggttgactggattggtgaggcccgctggtggctacttctgtgtgcaagcagggctgtagtgactggaagggataggagggaaagcaatgcccttggagggggaacagtgtggctgggatgatggcatttcttagtgagaccttggattgataatgagaacaactactctctgagcaggatgtgcgaactcagtctgagtattgtagtactgaagtgagttgacgtgtaagtacgtatggacaagaatgagccctgtactgtatcgcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaacaggaaaaaaaaacacacaaaacaaaaaacaaaaacaaaaaacacaacaaaaaaaaaaaaaaacaaacaccgcgcgcggctaatttggggggggggaaagaaggggaaacagaagggaggcgggggaaaaagagggtactgagaggccccaagatattgaaagaaaagagaggggaaaaacagcgggaggacaccaataaagaagaggagcaataaaagttgacaaggacacggggaaacacacgcaataaaaacagagcggcacaaccggaaagagaaaagagagagaaagagaaaagcacagaaagagaccgtgacagaggagaacgaagggaagacgaggaagacggaacaggaaaagtacaagacgaaagaaaaagaaagagacggaaaaaagacaaagaaaggaagaagaaaaaaaaaaaaaaaaaaaaaaaaaaaccggggggcaatataggggggggggggaaaaaaggtaaaaagggncgggtnatntttcngnacccttttttttaaggggggaanngggggcccaaaggngggnaaacaaaanntngtacccgttctctcttttatctttcgttcgaaaaacaggacaaccgcaaaaagaacatagctacaggggatcaatgtgtaacaacaacgcgctaggacaaaaattcatatagatacaaacttaacaacaatacgaatagtagaaatatacaacgtataaacgatcacatgtaatatcacagtaatagatagataatgaatattaaatctgagcgaggagaacgagggaaaatatccgtn

SEQ ID NO: 715863 - DNA, 346 bp, Homo sapiens
gacagcagaatttcgtgagacttgtaagacctgtttgtgttttgttcttctctctggcaaaaatcttggtgttgggaggagattcttactaagtgcctggacaatcgtaccttggaagatggtcacatgcttagtattgcagaggctcagtggcagaagagactgcagctttgtctcagttgagactttgggcttcagacatttgagcaaatgctggaatgaggtgagaccttgagcgtctgatacaagacgaatgccaagactcactgactgcatgtcgaggctcgacttcgcagcgctaatttttagtgtgttcatgacaaaaggcggattaattggcttatgg

SEQ ID NO: 715864 - DNA, 1449 bp, Homo sapiens
  misc_feature (52)..(52): n is a, c, g, or t
  misc_feature (1140)..(1140): n is a, c, g, or t
  misc_feature (1146)..(1146): n is a, c, g, or t
  misc_feature (1149)..(1149): n is a, c, g, or t
  misc_feature (1154)..(1154): n is a, c, g, or t
  misc_feature (1156)..(1156): n is a, c, g, or t
  misc_feature (1179)..(1180): n is a, c, g, or t
  misc_feature (1194)..(1194): n is a, c, g, or t
  misc_feature (1198)..(1198): n is a, c, g, or t
  misc_feature (1207)..(1208): n is a, c, g, or t
  misc_feature (1210)..(1210): n is a, c, g, or t
  misc_feature (1449)..(1449): n is a, c, g, or t
gcggccgcgactactactactagtctactactactaaattcgcggccgtcangcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaacaggaaaaaaaaacacacaaaacaaaaaacaaaaacaaaaaacacaacaaaaaaaaaaaaaaacaaacaccgcgcgcggctaatttggggggggggaaagaaggggaaacagaagggaggcgggggaaaaagagggtactgagaggccccaagatattgaaagaaaagagaggggaaaaacagcgggaggacaccaataaagaagaggagcaataaaagttgacaaggacacggggaaacacacgcaataaaaacagagcggcacaaccggaaagagaaaagagagagaaagagaaaagcacagaaagagaccgtgacagaggagaacgaagggaagacgaggaagacggaacaggaaaagtacaagacgaaagaaaaagaaagagacggaaaaaagacaaagaaaggaagaagaaaaaaaaaaaaaaaaaaaaaaaaaaaccggggggcaatataggggggggggggaaaaaaggtaaaaagggncgggtnatntttcngnacccttttttttaaggggggaanngggggcccaaaggngggnaaacaaaanntngtacccgttctctcttttatctttcgttcgaaaaacaggacaaccgcaaaaagaacatagctacaggggatcaatgtgtaacaacaacgcgctaggacaaaaattcatatagatacaaacttaacaacaatacgaatagtagaaatatacaacgtataaacgatcacatgtaatatcacagtaatagatagataatgaatattaaatctgagcgaggagaacgagggaaaatatccgtn

SEQ ID NO: 715865 - DNA, 86 bp, Homo sapiens
  misc_feature (58)..(58): n is a, c, g, or t
ggcaggaaaagagaaaccagcagccaggtcaggacaggtttggacaatcctctctgtnccagctcagccactgcccgcaccaggaa

SEQ ID NO: 715866 - DNA, 737 bp, Homo sapiens
gtgccaaagtgttttctggagttgctaattatttgtaccaggagtttgctccgtgccacccctccctagtgtacactgggttagggccctgctggggaaagcgggccgcgtatttaccacccgcggccttaccccccgagtcggccccaggaggttgaactcctgtttccgttcgcgaagccttgactctcttacggaagtccccggtcattctgactagatgcgcccccttccggtcattatttcgtttgcatgagtgtattgcttcttcacggtttggctttttattgagcccgcgagtagaattcccgggctgccttgagcttcttccctgcatgctccctccccgtgacgtttccctccccttcacctgaggatctgccgtctcactggttgctttctcccgttgtcctcttggacttgagggcacttgtgaaaagctttgctgtgatttaaaaatgccacgccattgtttaatctagcacgtgttgaaagctgggaattttttggcgccatccactgtagccacgtgacccacggcttgggagcccgaaaccagtgtgaccctggggagttttattttaacaccactgttgcccaagagttggctttgtttatttggttttggcgcgggagaggagtggtatcttgatgctttctgtggaccatgtaacccttaacacctcatgtattttcaatgccacctacataaataaacataagcatattgaatacca

SEQ ID NO: 715867 - DNA, 713 bp, Homo sapiens
gggatgtcgcaagtgtcgtgcacttacgaaactcgctaaggatatgctcctggtgcgtcacccggggagatacacatgactgttggcatttgatatatagactcacggtaattacatcgaaacatcgttcctattttcaaggctcgtcgtgcccccatttagtaggtgcggcataccccatttatgagcgaacgcgtggcttgcatctcacgttggccagaaatagcggggaaagtatctgtttgcgttggggcactcacaacctcaggtaccagaacgtacgacatgctcgagcaactttggccaaaattttcctcgttcgccactctaaacgtgagatgctaggtagtcacggaggtcacacgcatgagattctaagaattctgcgttctgcgacacacaaaggagcaaattccgtctcctcatatttgctaaaggctccaggaagatgtaaccggactctgcgcctttcgaacaacacttgcttcactatcgcacgggcatgaatttgcactcgcaccagtctttctcatgcgctttctgccttgtgaatatacttggcgctgcagctcgcaaagtgcattcccatggcatggtcaaggctgcatgtaattatgccactcgtcgaggcttcaacggtcttgtacaggggcctagggtgacaaaggttgatcccccaactggattcatttcttactttaatcgggactgcc

SEQ ID NO: 715868 - DNA, 705 bp, Homo sapiens
  misc_feature (31)..(31): n is a, c, g, or t
  misc_feature (39)..(39): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggagcagtcggagcagttccacttaggcgcctaagtggaactgctccggcctaagtggaactgctccgcaggggaggaaaaaagaaccaaaacttccaaggccctgctttatttcttaaaagtactttaaaaaggaaatttgtgagtatatcatatttacattttatatttttgtacatattgtaagggtcagccatttttaatgatctcggatgaaccaaaccagccttcggagcaagtccacttag

SEQ ID NO: 715869 - DNA, 338 bp, Homo sapiens
  misc_feature (119)..(119): n is a, c, g, or t
  misc_feature (131)..(131): n is a, c, g, or t
gggggcccagagtaattctacaacgttccacagcgggagtaatttctctgggggggccccctcgtcgttgttgcacaagtgcgttgcacgctccctcacacggagtctgtcctccctanggttaagtagtntgtttcgccccagaagcgacccacgcccttggagagttttaccaccccacagtcttatcaaccctacatggtgacaacatatgagctatagaacccccccatcacttgccctcatcacatgaaccccccccccaattattctctttcactcttctctttacaccccaatacaaagtcaacccccgttctctctcccaacaaatagaa

SEQ ID NO: 715870 - DNA, 554 bp, Homo sapiens
  misc_feature (31)..(31): n is a, c, g, or t
  misc_feature (39)..(39): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttactcgaccattcctctgcgccccaagcctctccgtgctccgcctcggctgtatgtctgtactcttcgcccacaccctctccgcgcctcctcctccccacctcctcccctcccctccgccccggccacccgcctcccgccatcgcaccgccgcacgctccaccgcctctcgcgtcccctcccgccctccctccct

SEQ ID NO: 715871 - DNA, 290 bp, Homo sapiens
ttacgaggacccggaacaggacaagcaaggtaccataagatggctttgaactgaaagcaggtcagagtggactacagggggagtgtgtcggacgtgcctgactttgacttatcttccgaactctatgagcatgccatggctctgagcgaggatgaagatatgcgcgcctgctacgaacgctccaacgagtaccagctgatagactgtgcccaggacttcctggacaagactgacgcgctcaagcaggctgactatgtgccgagcgatcagcacctgcgtcgctaccgtgg

SEQ ID NO: 715872 - DNA, 582 bp, Homo sapiens
  misc_feature (31)..(31): n is a, c, g, or t
  misc_feature (39)..(39): n is a, c, g, or t
ggcatgacgaggccgggggtgaacttggcancgaggctngctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaataaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaat

SEQ ID NO: 715873 - DNA, 1406 bp, Homo sapiens
  misc_feature (1097)..(1097): n is a, c, g, or t
  misc_feature (1103)..(1103): n is a, c, g, or t
  misc_feature (1106)..(1106): n is a, c, g, or t
  misc_feature (1111)..(1111): n is a, c, g, or t
  misc_feature (1113)..(1113): n is a, c, g, or t
  misc_feature (1136)..(1137): n is a, c, g, or t
  misc_feature (1151)..(1151): n is a, c, g, or t
  misc_feature (1155)..(1155): n is a, c, g, or t
  misc_feature (1164)..(1165): n is a, c, g, or t
  misc_feature (1167)..(1167): n is a, c, g, or t
  misc_feature (1406)..(1406): n is a, c, g, or t
ttatcgcagtgacggggcgggggtttaggtgcgactatgactgggccgtgcgtcgtacacccagaaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaacaggaaaaaaaaacacacaaaacaaaaaacaaaaacaaaaaacacaacaaaaaaaaaaaaaaacaaacaccgcgcgcggctaatttggggggggggaaagaaggggaaacagaagggaggcgggggaaaaagagggtactgagaggccccaagatattgaaagaaaagagaggggaaaaacagcgggaggacaccaataaagaagaggagcaataaaagttgacaaggacacggggaaacacacgcaataaaaacagagcggcacaaccggaaagagaaaagagagagaaagagaaaagcacagaaagagaccgtgacagaggagaacgaagggaagacgaggaagacggaacaggaaaagtacaagacgaaagaaaaagaaagagacggaaaaaagacaaagaaaggaagaagaaaaaaaaaaaaaaaaaaaaaaaaaaaccggggggcaatataggggggggggggaaaaaaggtaaaaagggncgggtnatntttcngnacccttttttttaaggggggaanngggggcccaaaggngggnaaacaaaanntngtacccgttctctcttttatctttcgttcgaaaaacaggacaaccgcaaaaagaacatagctacaggggatcaatgtgtaacaacaacgcgctaggacaaaaattcatatagatacaaacttaacaacaatacgaatagtagaaatatacaacgtataaacgatcacatgtaatatcacagtaatagatagataatgaatattaaatctgagcgaggagaacgagggaaaatatccgtn

SEQ ID NO: 715874 - DNA, 209 bp, Homo sapiens
  misc_feature (37)..(37): n is a, c, g, or t
cccccccccctttttttttttcctccttatggccggnggggggggccccccccccgtcttttttttctgggcccggggggggattttttttttccccgggggcccccttcccccctgtgcccctttttgtggccccttttggcccctttttttcctccgccccggggggtggggggcgggttttttcgggtttttttccccccccgggt

SEQ ID NO: 715875 - DNA, 1572 bp, Homo sapiens
aattcaagcttctaacgatgtacggggacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaacaacacaaaaaaaaacaaaaaaaaaaaaaagaaaaaaaaaaaaaaaaaaaaaaaaaaataagagaggcagagacacgagagagaagcgagtcagatgacacacacagaacgcgcctctcttctctctctctcttatatataagagaagagagagtaatctatctctcctctgtatcttgatagacacctcgacccccctatgagatatatctgatttctcgctatatttatggcggccctctcatcaatcggccgtagagacacacctctatcttgtttctaacagcgaccgacctacaagacataaaatagatactatatatctctgtttgactacattagtgctcttttgtacaatcacccgcaccgattcacagtaagacacgcacacaacgcgtagagagtagacctactcttcgcgcagccgcccccgacgcgacgactctcagtatgccttccactgatatagtcgttccatcctcacattgccaattttgttaataaacagtgactctcttgtaaatataaattaacaacacatagagagacagtgacaccaataaagggcccccacgcgcatgacatcaaaacaatcacaagcagctctacacgtcgcggggcgcccacccaaagccggtagggtacagagaaaaaactctccaaaggcaaaacaccatgcgcggtacatcatccgggggggggagcaaattgagacttatcataaaacgcacagatctactaaatatcttttcccccccctaactacaaaaatttatttcccaaaaaataacaaaggaggaagatccagcacgcgcaagaacttcctcctcgtggtataagcgacagaaaagtaaccaaccccagtgtgtaaaagttgcccccacacagcaacgatagtgagtgtcaccccctttcgagttatttgaaaaatatataacatcacacctctgaccacaaacaacactgcttatcccgttacacaaaacgggaagcactacgcacccccacccttattagggcagctcttaaccaaaacacgggggaaacacgacaaccccaccgaaggagagagtagaaacacgacaacaaaacaccagtattattcacacacgacaacactgcagacggggggagggaagataaaacaatcaacggcaacgacagggtacgccaaaaaacgtcccgtagggagggcgacaaaaccacccatgcggatacgaagaccccacgcagaggacccacagcaacagagtagccacccccccaaccaaaaaactgtacttgaaaaagaagagaacgggcgcaggataatccaccaccaagtagaagcccccactcatcacccccctatataagagaaaaacaaaat

SEQ ID NO: 715876 - DNA, 223 bp, Homo sapiens
  misc_feature (22)..(22): n is a, c, g, or t
  misc_feature (35)..(35): n is a, c, g, or t
  misc_feature (69)..(69): n is a, c, g, or t
  misc_feature (153)..(155): n is a, c, g, or t
acatcgtgctttggctttagcntttctaacttagnttcggaattacgttagctactttggttccatagnacaagttttcaacttggggtctaaagttcctacagtgtgcacaatgtcccagtgaagatcctttggtttcaaagattcatggtnnnaaagtgtattttactgctatcaactaaaatgtatttataataaaatgcctttttaataataaacacag

SEQ ID NO: 715877 - DNA, 534 bp, Homo sapiens
  misc_feature (12)..(12): n is a, c, g, or t
tgcccacggggnacgcggtcagtccgtgggcatgtccagcctggagcagctggagcagaagcttggcagcaacagaggaagggcccctggagccggactgtcgtggatgcctttaatcaagcctggcattggggttgcgcacgaatgtcccaactacttccgctaggtcccatcgatggcctcaggcatgccgcaaggtcgttctgctggtacacgctctatttggtatctactgcaccactgcaccgagtctgggcccttgaaggctgagcattaggaagaggttttgtactgagattcgtctagcatcctatgacattaattttgtcgtagcttccttgcctatgactccctgattcacatttatcacgtggtgaaaagggtggggggagtgagttcccaactttgaggccgcttgcctggttagatatacaaggcatggcacgttggaccctgggctggtcaggcctaggtctttgacgtgaaaccccaagaaaacaaagaagaagcaatcaagaaataacgggggaggcc

SEQ ID NO: 715878 - DNA, 513 bp, Homo sapiens
gctcaggcagagtcctggatataggaacacagtaattctatgaagtagaacttcagttggcttaatcaaactaatgatagtctaacaactgaggcaagatcctcatctgagaggtgcttagaaactgggatccccagtagacccattaaccaatactggaacgtggtatctagctaccgtgatgtcttactttgagttactttatgcttcagaatacagttgttggccctgtgcattgaattacagccgcatattggtggtgtgcgatatgtgaacgctttttccaaactagagtcgtctcagcaagaacttaaggttctttaccttctagattattttgcgcattaccttcggcagttacaactccgaactagagtattaccatataacagtcgtagatccttatgtgtgtggtattagcccagacatctgtaatgtttttgcactgggtgacagacaaaatctgttttcaaactcatatccagcaccaaaatactatttctggctgaactg

SEQ ID NO: 715879 - DNA, 149 bp, Homo sapiens
atctagagcatccccgtcgagcgccacggtatgttggcacccacctgtgtagtctcagctactttgaggctgaagcaggaggctcacacctaggaggtcaaggctgcagtgagctatgatctcaccactgcactccagcctgggtgaca

SEQ ID NO: 715880 - DNA, 256 bp, Homo sapiens
atatacaatacccgagatatggaaacacctaaaaatgctggtgttaatgacaatgtggtgtgtgtacacactgaatattattcagctatgaaaacgaaggagatcctgtcatgtgtgacacgtggatgaacccaaagtcattatgttaagtgaaaggacccaggcacagaaagacagatactgcatgtcactcatatgtggatctaaaactgtcacaactcacagaaacagaataggacagtggttgccagggggt

SEQ ID NO: 715881 - DNA, 356 bp, Homo sapiens
gaggggagttgcgtattcatgaaggtgatgatgtttatccaatgtaccacctagagtgcccttggtgctctgcgtgatctttagtggaaccctgttgtggagaatgatacacaggacaaacttaccctgatgttgttaaatatatgttagatgaccagttgctttgatttctttgctcaataaacattggattacagctggtttgctgtgtggcatgcctacatggaggggacacactgagccaatgatttcatcatctgggtccctttggtttatatcagtttccaacatgacttgtttgtggggcttgtgggaggggcacatacatcggccccaggattctaacatctcctggt

SEQ ID NO: 715882 - DNA, 738 bp, Homo sapiens
  misc_feature (1)..(1): n is a, c, g, or t
  misc_feature (125)..(125): n is a, c, g, or t
  misc_feature (169)..(169): n is a, c, g, or t
  misc_feature (257)..(257): n is a, c, g, or t
  misc_feature (260)..(260): n is a, c, g, or t
  misc_feature (262)..(262): n is a, c, g, or t
  misc_feature (264)..(264): n is a, c, g, or t
  misc_feature (275)..(278): n is a, c, g, or t
  misc_feature (281)..(281): n is a, c, g, or t
  misc_feature (283)..(283): n is a, c, g, or t
  misc_feature (285)..(285): n is a, c, g, or t
  misc_feature (294)..(294): n is a, c, g, or t
  misc_feature (301)..(301): n is a, c, g, or t
  misc_feature (305)..(306): n is a, c, g, or t
  misc_feature (308)..(308): n is a, c, g, or t
  misc_feature (310)..(310): n is a, c, g, or t
  misc_feature (313)..(313): n is a, c, g, or t
  misc_feature (316)..(316): n is a, c, g, or t
  misc_feature (319)..(320): n is a, c, g, or t
  misc_feature (337)..(337): n is a, c, g, or t
  misc_feature (342)..(342): n is a, c, g, or t
  misc_feature (344)..(344): n is a, c, g, or t
  misc_feature (353)..(353): n is a, c, g, or t
  misc_feature (359)..(360): n is a, c, g, or t
  misc_feature (370)..(370): n is a, c, g, or t
  misc_feature (455)..(455): n is a, c, g, or t
  misc_feature (466)..(466): n is a, c, g, or t
  misc_feature (487)..(487): n is a, c, g, or t
  misc_feature (644)..(644): n is a, c, g, or t
  misc_feature (662)..(662): n is a, c, g, or t
  misc_feature (665)..(665): n is a, c, g, or t
  misc_feature (670)..(670): n is a, c, g, or t
  misc_feature (731)..(731): n is a, c, g, or t
ngtggctggccaccctccccactctggccatggtcctgcacagaggtttgtcctcaagggtgacccttcttggccgcccacagctagacctccggcggcgaggcacgcagtccatgctgctggcncaagtcacttggccagctcctcagccaccgctttgcgcatcttntccttggggtaggcgcctttctgccattcagacttgagttccagccactcatagaatgggacgtccactatcaggaagcctgcagccnctntntntcgccgggccnnnnctntncntcccttctnttccttncttnngntnttntanttnnggtactcccaccgcaanaacgntngcctcttantccctnntggtggtgtntggttcccagttggctgggcaaggtgtggtgccacaaagtcccttacgggcggaaactcgccgtcactgtccagcagcactctcngcatcgctgcngcctgccttactgcgtggccncctcggggctgcgcttgtcggcgctccccagcagccccttcagcgtctcctgcagctccttttgcaggggggtcaccttcctgtcaagggctgagggcccaggggccacagccgaggcaggcagaaggggacccgagtactcggggtactccagcanggcagtggcgttgatgtngancaccntctggaaggtgttctgatccttctgagacttgcccctagaaattggatgtgaattcagggnggaggac

SEQ ID NO: 715883 - DNA, 1459 bp, Homo sapiens
  misc_feature (1192)..(1192): n is a, c, g, or t
  misc_feature (1295)..(1295): n is a, c, g, or t
ggcttctctgcaaccagacgcacggttgctcgtggcagctcgcgtcggtccactggaatcctcggtcgtacacgggcgccggacgaggcgagcgatcagatcctcgttacaggaagtcatggcagggattggtacttgagtgtgagataactaatctcgtacttctgagcaagcttcactattgagtcgcccacttcaggaccccacgttctcccgactgtcgtgatcgcggtgtaaatcatgccatttgatgctcaagtagcgtccagtactgtgagcacgcgttaggtcgtgactcggtgaaggcaataagatcatgtcgtttccacgtgtgctgttgggtacctaggtacctatgcttcgtcggagcgcccggggctcgagtcgttccagagggtcgaccggccacagggacgatcgcacggaaacatagtaacccagtggtaggactgtgcgggcgtagacgcaccctcactgggctgctatgcaggcggttgagcctagatcgctgatcagacgaagtaacgcgagtttagtcgggccagcgaagacacgggcatctcgtgaggtgggtctgagacgtaataagagttaagaactggaccgtcgggaagacgttcttttgcgccccgggatgtgtgatgtctcaaacgtgaagatggcatggtccgtcgttggccttgtccttctgccatgttgttttctggaggggggaatgcataccgcggtggtagactcaaaaatccgattggggacataagtcccagggaatctacctcggtagcccagcacggtgaagccgaggcccctccactcagagtttggatttggccccaaaggtagggcagccacccgaggtgagtccaactacggttaaccgcccgtttccgcataagaggcgttgcgacaccatggtaaacaagccaaaaacggagggtgcgttaaaagagggggccgtacacagggaccaggcagtgaaaagcgacagcaggaagggtacagggtggaattggccaaacgaaatctgcgaagagtaacgtatacttgtagggcgagagtatctgcaccttcgttttggagcgttatcacacaggtttaaattcttgttgacgaattctcatactcggggagcgccacgttggagccatgttttgtcgtgccaacatataaagggggtcgcacccttaagggncacatggagagctgtgagattaagaggttgggacaaacacatcgcccctgattttgggataggttcatcgcatatttttgccccccaccttgggatttgtccnccccaatggttccggagcatgccactgtgttatacacaacaattagtgtgaggggacaagatagctgggtgactctggtgaacacgagacgcagaagcatcctctctgttcatagacgggtgacctttctagacgacactctgctctcgcgggaatcaataacc

SEQ ID NO: 715884 - DNA, 226 bp, Homo sapiens
gtctagcctcgtcatactgtcccagtgtgcactcacctagcctcatcatagtgtcccagtgtgtgcacacctagcctcatcagagtgtcccagtgtgcgctcacctagcctcatcatagtgtcccagtgtacgctcacccagcctcatcatagtgtcccagtgtgcactcaccaggcctaatcataatgccccagtgtgcactcgcctagcctcatcatagtgtcc

SEQ ID NO: 715885 - DNA, 842 bp, Homo sapiens
tggagaatatcggggtcacagcgtgaatgaaaggctttctttaaaaagtaagaattttcttctcaccaaaagtctggactgaacgcagataccatcttaagctcactctatgacaagatttggaagtaaaggcaaataagcagtactgtcttacttaagattgtttctagggacaacataacgtatctgtgaactgatcgcttaaatttgggttattttatcaactcattatatttcctatatatatttggtgatagttccatattgcctatgtcaaagaaaaccgagtgttccatcccagagcaagaaatcatggccccttcgacttgattctggtttctatgtctttacttctcatctaataaagctagacagaatcctctttcatattcaagttgtactgttagatgaacttaagttatttcaggcgtagaacaaaaattattcatatgttaatactgatctttttgccatccaagcagtcggagtttagtacttaagagttctgtagccctttaaaccagactccctggattaatcgcgtgtgataccagtgggcaaggtgcctgaattctctatacacctaggtttcctcatctgtaaaactggcgaataatagtaatagtacctaatgtgtagggttgttataagcattgagtaagataaataatactaaagcacttaggacagtgccgtggaacataaaaacagcttaataatagctcatagctaacatttcctatttacatttctctttagaaatagccagtatttggttgagtgcctacatgttagttcctttagctagttgcttactatgtattatcttatattctgttgta

SEQ ID NO: 715886 - DNA, 87 bp, Homo sapiens
ttcttgccattgaggtgattctcggcctgcgctgactcctgttgagctcggcgacccatcttggccctggaggtagccaagctgtag

SEQ ID NO: 715887 - DNA, 793 bp, Homo sapiens
agagcatcttcaccgtgtgcctagatgcgaccatgcccaggtctcagaagacgtgtaccgcacccacttggcaggccagatgctgcatgggggcggcagcaggctcaacagcgcgcaactcgctggattctgaccaagtacgcttgcacgcttcagtcgctggcgagaagatggcatcctgtgtggacttgctgtacgatgacatgctgcatgcgtgaggggccccctattgtcatccgttctgagactatgtcagtcgacgtacagcgaatgaaacccgcagcttggtgcggtctccgcatgggtgctcgctgccgcatgaccacaagaaagctgcggttcacacaatcgatgccctcgaggatcaacgtagcgactatcgagaaggccaagcagaaccttcagtcatcatgatccaggatctggatatcaccgtgatggtgttccaccagatttggcaaagacttccccaaagtcggagaagctaagcccgagatgccttcatccagatggctttgtagctggccatagcatacaaggatctacggacaggcagtgtgccagcgtatgaaaagtgcctccctgacggcatgttatcacctggggccgtcacacgatgaccatcacgactcggcttgccagtgtgcactcactcaccgttggtcaatggcacatggcattgagctccagcgtcacggaagcaccagaagggtggacactgtctgcgagaagtgcccgtgcagagtcccaccggaggctatcagccgactcgtgccatcctgtcggggaaggc

SEQ ID NO: 715888 - DNA, 958 bp, Homo sapiens
gctggcttctcctacgccttccccgaggccgtcagggtcttcttcaaggagctcatacaggagttagggatcggctagagcgacacaggctggatctcctccatcctgctggccatgctctacgggacaggtccgctctgcagtgtgtgcgtgaaccgctttggtcgtagccagggccgttcatgcttgtggggggtctctttgcgtcgctgggcatggtggctgcgtccttttgccggagcatcatccaggtctacctctaccactgtgggtcagtcacggggttgggttaggcagctcaagtatcgcagctccgtcgctcatcaatgctgaaccgcttacttcagcaacgcggcgccccatggcgcaaacggggctggcggcagcaggtagcacctgtcttcactgtgtgcacctgagcccgtctggggcagactgactgtcaggaaccgctacggtgtggacggggtcggcttacctcatcctggggcggtcgtgctgctgcaatctgctgcgtgtgtgccgcactcatgaggcccctggtggtcagcggcccaggcgggctcggggccgtcgcgaccctcccggcgcctgctagacctgagcgtcttccgggaccgcggctttgtgctttacgccgtgggcgactcggtcatggtgctggggctcttcgtcccgcccgtgatcgtggtgagctacgccaaggacctgggcgtgcccgagagccaaggggcgcttcctgctcaccatcctgggcttcattgaccatcttcgcgcggccggcgcgggcttcgtgggcggggcttgggacggtgcggcctactccgtctaccttttcagttctccatgtcttcaacggccccgcggacctggcgggtctacggggggcgatacggggcctcgtgacttctgcatctctttggatctctacggcatggtggggccctgagtcgaaagc

SEQ ID NO: 715889 - DNA, 336 bp, Homo sapiens
tgcaacccacgcatgtcggagcgaaccctactaaaggcctaagccatccctggcccacagtggacgtttcttaccatggctcgagactaagggccacccaggctgctttggggttggagatgagttaaggaaggcagggagagatgctgtaccggtctgataacaaagtcggcgccaacccggctgtcctcccactcttccctcctatattgctgcctgcttcgctgccccacttaccacggtcgatgagattgtgctcctcagtgcataccacagttaggtcacatcacatactaaccgactgctgtgccgagctgcctgcctcttttcatgccc

SEQ ID NO: 715890 - DNA, 146 bp, Homo sapiens
atcatgtgtcatggagccctttttgacctgatttgcctgctgctgctaggaggagccctagtagtgcagtgaggcatcggattagcgtttagaagggctatttgctgaggctctcatgagatggagtgcaggataaatcatgctaa

SEQ ID NO: 715891 - DNA, 571 bp, Homo sapiens
ataataatgctgattaaaagccacaccaataaaaaattagtttttaaagacggagtctcactccgttacccaggctggaatgcagtggcgtaatctcagctcactcactgcaacctccacctcccaggttcaagcgactctcctgcctcagcttcctgagtagctgtgaccacaggcacacaacaccatgcatggctaattttggtatttttagtacagatggggtttcaacatgttggccaggctggtctcgaactcctgacctcaggtgaactgcctgccttggcctccccaaagtgctggaattacaggcgtgtgtaaccatgctctgccaaaaaacaaaattttttttttggagacggtgtctggtccttgtggcccaggctggattgcgatggctcaatctcagttcattgaaacctcggccgagaaagcctctctaatggtcttggcccttagctacagatagggcaaccagggggcaagaaacttactgggtatggaagagaattcccggtttcctatccaggcttcaggcgggcccatgctatggcctggagccccctttgac

SEQ ID NO: 715892 - DNA, 468 bp, Homo sapiens
gtgcgcctttaccccgagcatacacgtttaaattctgagagggagcaacacctaggtgagattgaagcagtagataacgaagtctcccagtcaaggaagaagcccaggacctactggcttcactgctgaattttaccaaagatttaaagaactaataccattcctactcaaattattctgaaaaacagtgaacagaatacttccaaacttattctgtaaggccagtatgaacctgttaccaaaaccagacaaagacacatcaaagaaagaaaattggccaggcgcagtggctcacacctgtaattccagcactttgggaggccaaggcgggtagatcacctgaggtcaggatttctagaccagcctggccaacatggtgaaatctctgatctctaccaataatacattgaaaatttagccgcgcgtgatggtgtgcgcctgtagtccccagttactcgggaggctgag

SEQ ID NO: 715893 - DNA, 1032 bp, Homo sapiens
taaatctttatgttcctttattgggagcaagattcctggatcggtatacaggtgatgtgtattttactaaacagagaaccgtgtgtgcagaaatttacattactactccattctagaataggtgtgtatacacttttgtgccatatgtgagtggaattagtttccattttactcaagttttatatacattctaaaaagcttttgtgaagtttcacccagacgtggtccatataatttcaccttctgtgaaaaaggtggcatttataattctcaggcgacatatatttcttacaggcatttaacaaagccttagtgcattataggggtgcattctcgtggcaccaagtggcatttgagccaagacagagcgtgagtctccattatatccacacccaaaatttcaccatgtgggtcacatttgtgagaagctttataccagaaaagcaggggacagtatacgggttcaccatcgagaacttcttacgtgagaagcctatcttcttggggcccacattttatattagccaagtgaagaaattgccagcaagtgtggtcccggtgtataactgtggctttagaagcaccaggtcgtgtgtggagtggtggttggcaggcacaatttaatttatatccgaggtacaaaggccaatttttaaaacatggtccactgtggagatacaaaatcaagggccacaagtgtacctcaggagagatatggagcatatctgggtaatcccaaaatgactgtgaatcactttccagaaaccaatgtgggcactttgaaccccacgttttcccagctatggagacttttaataccatgggatcaaattcccattactcaattcccagtttgccccggagggtactctcagacagggtgggtattcaacaaatccgaagttacgggtagcaccaagtttgcaacagggttgttcatcacagctcaaatttgggagggtcaagacggatacctatctggaagaaaacggtctcatctcgtggtccattaggttatggcaaacatcctta

SEQ ID NO: 715894 - DNA, 495 bp, Homo sapiens
ccggcattattgccccgcgtagagctcacccgcgctcattatttccttttgggtggccaaccgacccctttccctgggaaccgggttttttttggggctggcttgggtgcccccggtgaaaagccatattgattacagggcagcaaagaaccagtaccaggaatttacttgaccattccccttatttttcatctaaaggaatctcggatttagccctttcattgctaagaaaccttttcactggagttcttaccagctcaaccaaatttccactctgctatagcaaaaacaataatgtttgctttaaaaagatttcttgacctatgccttttcttaaaaagtttgatagattagttagaactttagatcatcagatcagtcttaaatggggttcttggaattttatatttgacaatatttatactataccaaactcatttgcagctcttagggttggtgggtaaaaacatttttttaaaggcagtaagtttataa

SEQ ID NO: 715895 - DNA, 326 bp, Homo sapiens
tggatatggagtctcactctgttgcccaggctggagtgctgtggtacgatttcagctcaatgcaagctctgcctcctgggtttaagcaattctcctgcgtcagctccccagtaggtgggactacgggtgtgcaacacaacatccggctaatttttgtatttttcgtagagacagggtttcacatgttggccaggctggtcttaaactcctgacctcagttgatccacctgcctgggcctcccaaagtgctgggattacagggataagccactgttgcccagctgcattggtgccggttttttattgttagttaagagaggtcgacg

SEQ ID NO: 715896 - DNA, 1070 bp, Homo sapiens
  misc_feature (37)..(37): n is a, c, g, or t
  misc_feature (761)..(761): n is a, c, g, or t
  misc_feature (767)..(767): n is a, c, g, or t
  misc_feature (770)..(770): n is a, c, g, or t
  misc_feature (775)..(775): n is a, c, g, or t
  misc_feature (777)..(777): n is a, c, g, or t
  misc_feature (800)..(801): n is a, c, g, or t
  misc_feature (815)..(815): n is a, c, g, or t
  misc_feature (819)..(819): n is a, c, g, or t
  misc_feature (828)..(829): n is a, c, g, or t
  misc_feature (831)..(831): n is a, c, g, or t
  misc_feature (1070)..(1070): n is a, c, g, or t
gctactactactactactactaaattagcggccgtangagcatccaagtgaacaaagcaccttagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaacaggaaaaaaaaacacacaaaacaaaaaacaaaaacaaaaaacacaacaaaaaaaaaaaaaaacaaacaccgcgcgcggctaatttggggggggggaaagaaggggaaacagaagggaggcgggggaaaaagagggtactgagaggccccaagatattgaaagaaaagagaggggaaaaacagcgggaggacaccaataaagaagaggagcaataaaagttgacaaggacacggggaaacacacgcaataaaaacagagcggcacaaccggaaagagaaaagagagagaaagagaaaagcacagaaagagaccgtgacagaggagaacgaagggaagacgaggaagacggaacaggaaaagtacaagacgaaagaaaaagaaagagacggaaaaaagacaaagaaaggaagaagaaaaaaaaaaaaaaaaaaaaaaaaaaaccggggggcaatataggggggggggggaaaaaaggtaaaaagggncgggtnatntttcngnacccttttttttaaggggggaanngggggcccaaaggngggnaaacaaaanntngtacccgttctctcttttatctttcgttcgaaaaacaggacaaccgcaaaaagaacatagctacaggggatcaatgtgtaacaacaacgcgctaggacaaaaattcatatagatacaaacttaacaacaatacgaatagtagaaatatacaacgtataaacgatcacatgtaatatcacagtaatagatagataatgaatattaaatctgagcgaggagaacgagggaaaatatccgtn

SEQ ID NO: 715897 - DNA, 818 bp, Homo sapiens
ggcagaggtatcgtgagctgacattgcgccactgcactccagcgcggaagacagagtgagcaaaaaaaaaaaaaaataaaaaagaaaaaaaaaacaaaaaaaaaaaaatctcccaaggcagtcatgcttttggtttgccattagcattttttggttttagaaatattcaaaggtgtaccaacgtagagaaaatagctttaaacaaagcccatggtgtacctatcagtatgcttaaactggtggtcacctttctgccccacttttatctatctcgaacaccccttttctggcacactctttaagaccactggttttaacaagacacttttagactggcatcctggccagacctacccatacagacttcaaaggtactggattaatggcttaattggcctggacctaaggatgtgagctccatggagaacaggagactggtttaccttctcgctccccctgggacctaaaacaatggcctggcttgggtggtaaaggtaaggtggctccagtaaattttttaaactggtgtgtggaccattggaatataatcttcaagacgcaagagagctctttaagattagagggcacttactaaggtggccagctttcaacaaaatgacagaggggaattaaggacagatggcaaatagatctcatttataacctggtgtaatggcagtctgccacgtgcaattaaacaaagaaactttttagtattcaccctttcaaatttcctcaaaatttaaggtttatgactaatttccaccagcaagggaaaactttgagggctgtatcacgttgccatttttaggcccata

SEQ ID NO: 715898 - DNA, 337 bp, Homo sapiens
  misc_feature (15)..(15): n is a, c, g, or t
  misc_feature (56)..(56): n is a, c, g, or t
  misc_feature (166)..(166): n is a, c, g, or t
  misc_feature (230)..(230): n is a, c, g, or t
  misc_feature (318)..(318): n is a, c, g, or t
  misc_feature (329)..(329): n is a, c, g, or t
aaggaggcactgcangcaataggtctacaagacgctattccctatcatagaagagntatcactttctgatcacgcctcataatcatttcctatctgcttcctagtcctgtatgccccttttcctaacactcacaacctaactaatactaacatctcagacgctcangaaatagaaaccgtctgaactatcttgcccgccatcatcctagtcctcatcgcactcccatccngcgcatctttacataacagacgagtcaacgatccctcccttaccatctcaatggccaccatggtatgaacctacgagtacaccgatangcggactaatntcctcctt

SEQ ID NO: 715899 - DNA, 1382 bp, Homo sapiens
  misc_feature (1038)..(1038): n is a, c, g, or t
tctgaaattagtcagattgatgtcttgctctgaggcataagtcccaggtacttagccgttgtaactacctatgatgccactgcaggatttgggtgagcggagggggaagaacaagtcactacatggatacgcggggcacggcgtaggatcgtgaagactacatccacgtggagttggaccttgcgactcgcgagtgtgaattcatccttacacggtgcaataaccgttcatcttgcggattgtcgaatgatgggccagctggtagcgctcgaagtagagaatctcatggtagaatcgtactatgtccgatgtattgtagcaagccgattaactacttagaatagatagctctatgaggattggcgagtcgtatgcagtaggagactattgtctggctgagcaatgattgattaggcgtactatgtcgctatgattattacaagtggcctatagtggtgagtacaagcgttgctagatcatagtatgctaagtccaaggagaccaagtttactagtattgtagcagtagaactcgacgagtatacagttagggtagtagatcaccacgtgattgttctagaattaatctggtgttgtccgtacgtataaaagtgttggcgtttctaaggcgttaacacgacgttctatagggacgatttttggtaagaagcaaggtttagacatttcaatcaagggttagctgactgtgtttacgaacggtgcacctctgggaaggaatcaggttttctttaacttgacggttgacaaattcaaaccgttttgctgccacacttacacatgacaagctaccatcggattcacggcctcccactttggactcaattcttggactagaaacatgaacccctgggtatgggcaattaagacgtccacttggtaaggccatagaatcccttttgggtcccttgaaacaagcaggggtcgtaagagtgccccctaaaagaataactataaaaggtcccatatgaattcgctctttgcgattctcgtctgcgaaggaaaaatcgaggacgttatntgggctaaacacgctcattaacactttggcaaacatttcaccacgagatcgggccagtaggaaggctgagccctttgatcatgaaacacgctttaaaagtgtggaacacagataaaaggtcacacttcgacgaattttcagtgcggaaccctcaagcgtctggccaactacacgttcgtgccaatcacactacggaaacacccgtgtgaggtcttgaatctaaacttaagaacagctcgggacacttgagacagtttacatggcacaacaaacagacaaacagcagcacacacagcagacctacagccacagacaacagacgacacaagaaacaacaacagacc

SEQ ID NO: 715900 - DNA, 396 bp, Homo sapiens
tctcgcgaggaggcggcagtctggtgaccatcccagggtcgctcaacttcccgggtgtccgagttggcaccacgtgctctgccgatgcagccagctgccttccaggctttatattctgtctgcagaagcctgacctggaagatgagcatctcgttttcttctgtcagatgggctacgctggggcctccgggccacgcagctcgcccggagtcttggatacactgggtctcgcaactacgctggagccttatagagtaatggttggcgtacagagagttaggcaggaggcagcttactgattgccaccccctggccccttcttggccaccttaacttagtgctgtgaacaggctgacttggtgacttgggcaactccttatagtgttgtgcgcacat

SEQ ID NO: 715901 - DNA, 1049 bp, Homo sapiens
tccgggccaaggtcatgtagtgaattgacctaagttcattagggcgtacttgaggtcgaaggaccgtgaaacaaggttgtacaagatcaactaagttggaagccgtatcaattcaatgagcctgaatctaaatgtttgtgagccagtataagtactaagtaggtcaaactgtcagggtatgctataaacctgagttcttccagtcaagcagggcgaggtgcagggatgtgttggacgtgtgctgactgccttcgatagttggagctacacatatcatccaaaatacccacctagctgaaagcgtcttttcgctcgggcaaggattagtttgttcctggcaggtatcaggacttggcacactcgaagcctatggtggtacaattgaaaccttcattcatagccgacgttgaaacaacgtggtttacatggtacccaaaggatgtacctatcgcagatgggatgagaataggaccaagtttacccacactcagaggcatcggaggacatccctcgtatgcgaaggaagcacgacccggtcttacgcgtcccggacacttgcttggcaccggagataatgacactcacgacccacagcattgccgagaatcaatcagacaaggaacatcactctgcgtacggagtattaccatcacgctgccggctgaatccatgcgaccgaggcagtgggcgtcaacgtatcaacacaagcagagaacgtggctgatagatagggtcaaagggtggactacagaacgacaagagcgttgttcaatcgaggggccgttgcctcgcaagccgctatcacagggcgccacttcccttggttgtaagatgggggcccacacagtccaggagactgatagtactcatagagggacgagcgccccaaggtgcgaaaagtgcttgggcacaccccattagcgcaattacccgagcacaagctgatgcgagcgatgcacagccatgtaggcatagtaacaaaatctggacagtaccggacacagtagagacaactttgagggtaacaccgttgcagcaactcctctcaa

SEQ ID NO: 715902 - DNA, 780 bp, Homo sapiens
cgcagtggctaacgcctgtgaatcccagcacttcggaaggctgaggtggacagatcacctgaggtcaggagttcgagaccagcctggccaatatggtgaaaccctgtctctacaaaaacacaaaaattgagccaggcatgatggctgcatgccatgtaattcgctagctactcgtggaggcgtgtagagctggagaattcgcttactgacccgggaggcggaggttgcagtgagccgagatcgcagccattgcactcccagcctgggtgacagaacgaaggactccgtctgcgaaataaacaaaacaaaataaacaattctcatggaatactctgtatggtttcaagaaattccctgaaagagttgactatagagtaataatgtaagtctaacgagcgaaagcataaagtgtataataggtattacattatatttatagatctaggcttagcgagatctatgaaatattgagctaatattatgagtcttctgtgatggggcttctttctatgctactttctcagtggcttgtactttgtataattcaggccctaggtttggagcactaagttgttgcattttagtggtgaccttggccaagttatgctctttgtataaaacaccagttacgcaaatatggtacgtgttatcaacaactaataacttttagaactagagcatatcttgaaaaatttatcgggggctttttgtccacacgtgaagaacttccaccatgaagggacaacagcgctggccaaaagcctccgggggattaaacca

SEQ ID NO: 715903 - DNA, 126 bp, Homo sapiens
tgtaccgtgggatatgactgaacgcctctaagtcagatccgcccagtgcggaactgatactggcagctgccgctggagcctcgtgttgtgcctcgtgatagcctggtcccccgccctttctgtcct

SEQ ID NO: 715904 - DNA, 395 bp, Homo sapiens
  misc_feature (114)..(114): n is a, c, g, or t
  misc_feature (119)..(120): n is a, c, g, or t
  misc_feature (126)..(126): n is a, c, g, or t
  misc_feature (135)..(135): n is a, c, g, or t
ctctatctcgtccgggcgaggatgtagaggacgacctcatctttaccagcaagaagtcactctttgggaagatcaaatcattacctccaagaggactcctgatggatttggggnaaaanncccttncccaaggtngcccggctgaagacatcctcaggaggcccagacatggacctgtgagaggcactgcctgcctcacctgcctcctcaccttgcatagcacctttgcaagcctgcggcgatttgggtgccagcatcctgcaacacccactgctggaaatctcttcattgtggccttatcagatgtttgaatttcagatctttttttatagagtacccaaaccctcctttctgcttgcctcaaacctgccaaatatacccacactttgtttgta

SEQ ID NO: 715905 - DNA, 1631 bp, Homo sapiens
cgaaaaattctaggctagtatacaactacgtcaaaggcctccaagcgttgtagagcccctacgggctactacaacccgttcgctgacgccataaaactcttcaccagaggaagccccgtaaaacaccgccacgatctaccatcagcgcctctacatcgatccgacgccgacctgtgagtcatcgtcaccagtcgacgtgcttctactgatgaactccaccatgcagaagtagcccgcaaacgccgccaatgcgatcacagcccatcaacacgacatacgggaagctcacccagtgagacacatcatacgcaccacacctgcgtacgacacatcagaccgaaagcaggagacaaaaggcatcaagaaatcgcggcgctagcagacaaatagaaagaccatcaaacagcctacaagcaccacaagaacatccgcgcaggaccagcatgggcggaagcacaacgaaaccgccacccgaacgcaaaacacataccaatagtgccaaagtacaaccaagaaacacgcaagtaaacaaaacataagcctcaagtcacaaaacagaaagccctcacacatcaaagaacagaagagacacagaaacagacagaacatcacaaagaacaaagcaagacaaaaacacaagaacaacagaacacaagcaacacatgaagataacaaacaccagaccacaacaaaaatgcaaccgcacaaccgagacagcaaaaaaaaaatgaaagacaacgaaacacagaaccacaaagacacgaaagccccgacacagcacgcaaaacgacacgaaagagcccaccacaaaaacagaaccacaaacagcaaccagcacaagcgaacgacagcaacaggcacaacaaagaaaacatcaagagaccaacacaaaaaacaccacagccgacagcaacgcacccggcacagagcaccgcaaacaccaaccccgaaacaacaacacaaacaggacacacaccagacacagacaggaaccacgctgaaaaacaactacacgaccacaaaccaacacaaacacaacaacatacacaccccaacccccacagaagcaaccaaacaccgacggaaagacacaacaacaccccaccccacgaccccctgaccacacacaacaacaaaaaggccacagaacacagccacaccaccgcacgacaacaccaccaccaccacgggcaacgatacacggcacacgtcaccgcaacaaacaaccgacacacccacacgaagcaggcaggaacaaaacacacgacaaatgccagcatacaccacgaccagcacctagcgaggagcaagacacgaggagacacacaaacaagaccaaacagcaactgagagaaccacacgacaacagcacgaaacacacgaacaacggagcctaacagcacaacaaatgaacagcacgacaacacacaaggcgagagaccacagacgcaaatcagaccacacacagcaagagccgcgagaagacgccgcagaagacaagcagaggagagaagatacacgacacagcacagtccgcaccagagcacacaacaaccagccagaacaaccagacacaacaaagcagccacaaaaacacaagcagagagaggacacgaaacggaaagagaaca

SEQ ID NO: 715906 - DNA, 1106 bp, Homo sapiens
tgggggaaaaatacttttataaaaaaaaaaattaccaatcaaaatattgaacaacaaaatggggggtttaaaaacaatgggaaaataaaaattgaaacacgtggctgtgggggcagggagtgcccgggggggggaacctgtgaacaggggccacggatgacccgtccgcctcgatagataactggccaccgagtggaagtgcaggctcgtggtgcggcaaaagagctgggggagcgtaaaaaatcctccagggccgcaagtggaatcagcgccagtgaatgcccggggatcccacggcccctactatctataccaagagggggcatccgcgcccgggtgacggagccccccgtgaaaaccgcctgtcaggggaggccaacacccacgagataagccccccagaagatgtggccgagccagagcgaccgaggccgcgaaagagagaggaggacacaccccgccgatatgagagggcgtgacagggtgttggccccgcacagagggccaaccctgtgcccggaattcacacgacgagactacggagggaggcgaaacaccatgtggtgctccccccgccgtattaagcaccaccaaaggtggggggtgtacccacagccaggtgtggaaactgaagagcggcgcccccgcgacacgaccagagaggtgtgggacagcatcgcagagacagtaagacgggccgtggactacaccagacggaggggggcccgtatctacctccccccccacatattcaaccagagccgcacaagcaatataaccacaccgacggaggggacaaaagcagcgaaagccctcacacgagagaaggtgcaaccacaacacaccgcggcggagcacacgccccggcagagtagattcaaccccacgggagacaaggaaagcaaccccaaagccaccaccccatgctgaacagccgcaggaggcgcaccatataaatgacaaccaccacaaaagagaaagccaccaccagagacaaagcatctcaccacaagaggaggaggcctcaccacacgccgccgaccgccgtcgtcgtacacacaagtcggggaggaacatcactaaccgcgacggcagcaaaacagctt

SEQ ID NO: 715907 - DNA, 199 bp, Homo sapiens
cgcatgtgagcagcgataagtgcgctgtcatgtcttgaaggctccctcccaatcctcatttctccagaactgatcatattgatatttggaactgtgcagatagtcttttgcagtttcctggactctggctttgtgagggaggatgagagataggatcttcatagaagcgtggaagattggagtacatgtgttatgcatg

SEQ ID NO: 715908 - DNA, 402 bp, Homo sapiens
tgcatgatatttcataccgcagctatatttaacagggtctgtgacccacaagttgggccacagcgcaaattgaagcatttgcatgtatgacaacctcagtgggaagtgaaacatcagctgactcataacaacaaacaacaaccaaccagcaccaagtcacagttgcacctattcaaaactagctctaacgtgcgctcatttttaaacttcataaaaatattcatgattttatgcagtttgcaatcatctctcacacagcattcgggtgggcttcacctttaggtgaaaacagctatccactcctgtgaccttataaactcaggacatgctggggatgcaaacgtagcaaacaggccagggggaatgctgaccaggcttgagacctggaagcagctaggagtg

SEQ ID NO: 715909 - DNA, 884 bp, Homo sapiens
tattaaagaaatcacaagtgcaacataaaaagtcattgatcattcgttctaactatagatctgtcatggtttagtttacaatttttaaaaagttcttaaaatactgaaaaggcagttgacaaccttgtgtatggctgatgaagttattcttgatagtcgttacattacttgaatgttcaagagtacagtatatttaaaagttaagaaaagtgaaactatatgtattggtgtgtgatacatttataggcttagagtcataaataatgctattgtttatgattgaaagcgttgcgaggcgaaatccgaatttacgattgtgtccctgcacctaggaagttactttttgtccagcgtttcaagtcttcttagttactaatactttgttgaggcttgaaaaaggaaatcattcacaggaacttttggtatatgatggagaatgaagaactagagtcgagacagctttaattgacattgtcaagatctccagtgatcaggaatacatttgtttacttggcttaaactgtagtgcgtagatatgctcaatttcttgaaggagacttctgtcttgatacgaagtttcctgttgttctcgccttgtggtccaataaggggcgggtcctgcgtgaagatgctatggattgaatgattgcgactgttcaccttttcgggcgggtgttctctgggcacgggcggttgcgaccatataggccgcgcgacggtcccgttatgcctgccccagggggaggcgctacctccttgcgggggggaacaccccctttcttctggtgggttctgcgagcacggtccgtacggggcggcccacgcttttggggagtctctcacacccacttgtgttgtgtgtgcacccacgcgccggggctgta

SEQ ID NO: 715910 - DNA, 220 bp, Homo sapiens
tgcagaaatgtttgccgacgtgaggaaatagaggcccagtaatattaagtaacttgctgaaggacagccgacatagaaagtgggagaactaagactccaccctggcacgtgggctctagagttctaaagaaattttcatagaaattcaagtaccataaacagcactcctatcatccctcagctcagccaaagcgatgctgtctaagcaggtactgaattt

SEQ ID NO: 715911 - DNA, 106 bp, Homo sapiens
tgttactaaattcttggctcgggtgttgggttggggaaggggttatattatttaagggggattccgttttccaaattcggggatccgcggaaaaaatttgtgcaat

SEQ ID NO: 715912 - DNA, 1315 bp, Homo sapiens
ttctgctctttcttgtcttctggcatagattgattttaagcagactcaagggcaatttcaccaaactcaaagcattttagtcatctaggtggcaacaaggagactttaagattgtattacgggctgggcggcggtgactcacatctgtaatcccagcactttgcggcaggccaagggcaggagaacacttgaaggacgttcaagaccagcgtggccaacgtggtgcaaaccctggtcatctactaaaacatacaacaaataggttcagcctctgtccaatcatacctagcaacatagacaaacggtcaaacattgccttctactccctgcacacggacacaagtcatcgtccatccgaaagaaagacgtctctcgttgcactgcaatacagacagttgcctgcacctacgtcatcacgctgtcgcctctcacacaccacctccagcccatgcatacagatggttagccggcacaaccccacgggacaggcaataatcacacataactgtggatactatggaaacattccctatccatcgataaggcattgaaacataagtccttcgtcaactactcaaacacctttcgactggtaagacgacacattcagcagcacttaacgcgggtaccaatatccatttgacacaaccttggcacccacttccccatggggatgcttcaaaatggctgaacgacttttgaccattacacctacatagtgacgcggccactttcaaacaacaacagtaaaaagtacacacaacaaccacactacaaggtaacacaacaactcgaatagctactacatggacatccctagtcatataacagcaacggtattaaacgcatacaacatggatttctacgatggcaatacaaattgcgccgtgatgacagtagaacttggatatcgcagcaaaacacatatcattatataaagacaaaacggtttactacaaatatcaacacgggatcagccctacattgttacggcatcactacctgcacacatggttgccacggcacgagataataggtctgagtgcttaccagatcggtggaattcgcacccgtgaaccaacaggtgcgtaaccacacatatagggcaacgggactagaattaggagtgacaataaatatagagagaaacacagtacagtgtcacagtgcgcagatcaacgactgtctgcataaagactgtctgataacagacaagacgaacaactcgaacaagagactctagcgcggcacaatagaattgtcacacaacgacgtcgagaataactcataaatagacatgaaagagctcaaccag

SEQ ID NO: 715913 - DNA, 147 bp, Homo sapiens
cttgtctctgagtgttgtataagtgtgctttcccttttttcttgattaaagttgccaaagtttcatctttcttatcggctatttatttattttttagacggggtctccctctgtcgcccaggctggagtgcagtggcgcgatctcgg

SEQ ID NO: 715914 - DNA, 1040 bp, Homo sapiens
  misc_feature (450)..(450): n is a, c, g, or t
  misc_feature (460)..(460): n is a, c, g, or t
  misc_feature (490)..(490): n is a, c, g, or t
  misc_feature (613)..(613): n is a, c, g, or t
  misc_feature (616)..(616): n is a, c, g, or t
  misc_feature (624)..(624): n is a, c, g, or t
  misc_feature (640)..(640): n is a, c, g, or t
  misc_feature (644)..(644): n is a, c, g, or t
  misc_feature (649)..(649): n is a, c, g, or t
  misc_feature (652)..(652): n is a, c, g, or t
  misc_feature (656)..(656): n is a, c, g, or t
  misc_feature (659)..(659): n is a, c, g, or t
  misc_feature (667)..(667): n is a, c, g, or t
  misc_feature (677)..(677): n is a, c, g, or t
  misc_feature (689)..(689): n is a, c, g, or t
  misc_feature (701)..(702): n is a, c, g, or t
  misc_feature (712)..(712): n is a, c, g, or t
  misc_feature (715)..(715): n is a, c, g, or t
  misc_feature (720)..(720): n is a, c, g, or t
  misc_feature (729)..(730): n is a, c, g, or t
  misc_feature (740)..(740): n is a, c, g, or t
  misc_feature (748)..(748): n is a, c, g, or t
cttcaagaggcgtgatctggccttcggactcgctatgtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcgagaggacacgaagcaaatgatgagtagccttcatgctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggncttccctgantgaggccgtctcggtgcccccagctggatngagggaacctggccctttcctagggaacaccctaggcttacccctcctgcctagaagggtcacattttggaccctgtctatccactaggcctgggcttgggctgctaaacctgctgccttcanctnccatcctngacttccctgaatgangccntctcngtncccncanctggatanagggaacctngccctttcctanggaacaccctanncttacccctnctncctcncttcccctnnctgctgctgngggagatnctgtccatgttctaggggtattcatttgctttctcgttgaagacccggtggtgcactcaaaggttgttccactcctggacaaaaaaggaacaaaataacaaacaaaacagcaaacacaacaaaagcagtacgacaaagaaaacaaaaaaagacgcggggagaaacaaaacggagaggagaaacaagatatgataagcaacacaaaggcgccaacagcgttacgcacaccaaaatagttaaaaagagagagaacaagcggcgccccaaaggagggagaaaaacaggacgctcc

SEQ ID NO: 715915 - DNA, 215 bp, Homo sapiens
atttaaaacacaaagcatcgacttctgaaagacacgcagcaactggcaaacagctagaaaaaaatcagttggagaaaattcagaaagaaacatcccttctccaggagctggaagatttgggattgggtaccttaaagatatacggaaagcaagttgatgaccagaaatcagtgcatacacatctactggtaaacctattggaatacacatgaata

SEQ ID NO: 715916 - DNA, 961 bp, Homo sapiens
  misc_feature (345)..(345): n is a, c, g, or t
  misc_feature (534)..(534): n is a, c, g, or t
  misc_feature (537)..(537): n is a, c, g, or t
  misc_feature (545)..(545): n is a, c, g, or t
  misc_feature (561)..(561): n is a, c, g, or t
  misc_feature (565)..(565): n is a, c, g, or t
  misc_feature (570)..(570): n is a, c, g, or t
  misc_feature (573)..(573): n is a, c, g, or t
  misc_feature (577)..(577): n is a, c, g, or t
  misc_feature (580)..(580): n is a, c, g, or t
  misc_feature (588)..(588): n is a, c, g, or t
  misc_feature (598)..(598): n is a, c, g, or t
  misc_feature (610)..(610): n is a, c, g, or t
  misc_feature (622)..(623): n is a, c, g, or t
  misc_feature (633)..(633): n is a, c, g, or t
  misc_feature (636)..(636): n is a, c, g, or t
  misc_feature (641)..(641): n is a, c, g, or t
  misc_feature (650)..(651): n is a, c, g, or t
  misc_feature (661)..(661): n is a, c, g, or t
  misc_feature (669)..(669): n is a, c, g, or t
cttcaagaggcgtgatctggccttcggactcgctatgtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcgagaggacacgaagcaaatgatgagtagccttcatgtgagacttgccctacagaacaagtgactcttgagtaaggggtggggggaccccnacctgtccatcctaaactgacacctctctcctgtctcaagctagctgtccatctctgccgtggtgatgtcctatctgcagaatcctcagcccatgacgcccccatggtgataccagcctagaagggtcacattttggaccctgtctatccactaggcctgggctttggctgctaaacctgctccttcanctnccatcctngacttccctgaatgangccntctcngtncccncanctggatanagggaacctngccctttcctanggaacaccctanncttacccctnctncctcncttcccctnnctgctgctgngggagatnctgtccatgttctaggggtattcatttgctttctcgttgaagacccggtggtgcactcaaaggttgttccactcctggacaaaaaaggaacaaaataacaaacaaaacagcaaacacaacaaaagcagtacgacaaagaaaacaaaaaaagacgcggggagaaacaaaacggagaggagaaacaagatatgataagcaacacaaaggcgccaacagcgttacgcacaccaaaatagttaaaaagagagagaacaagcggcgccccaaaggagggagaaaaacaggacgctcc

SEQ ID NO: 715917 - DNA, 584 bp, Homo sapiens
cttcaagaggcgtgatctggccttcggactcgctatgtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcgagaggacacgaagcaaatgatgagtagccttcatgaaactatggactagcatctccccctagcagcatggcaggggaagtggaggcaggatggggtaagcctagcggtgttcctctaggaaagggccaggttccctgctatccagtctgggggcaccgagacggcctcatgcatgggaagtcacaggatggcacgctgaaggcagcatggtttatgcagccaaagcccaggcctagtggatagacagggtccaaaactgtgacccttctagtctgatatcaccatgggggcgtcatgggctgagattctgcagatagcatcacgcacg

SEQ ID NO: 715918 - DNA, 1037 bp, Homo sapiens
  misc_feature (271)..(271): n is a, c, g, or t
gatctctaatatagtaagctgtaaaatgtcttcatataaaaaagtactatgtagtacgatggcgttcgattgattgtaatcgtactcgaacatgtaggaacatatctaaagtctgattacatccagatagatggtggtagcgtaaatataatttaattctcatatttattactaggacgagtagtagttgcacacgctctaattactatgtctggggctccgttacttcccttactgagtctattcatgcttctatatttaagtaacacantgcagacatttgtactatgtagtaaattgtatggacccaatattcaaatgctttatgcataatctatgctgaagagctgccatgtatactaccccctgttatactatgcatgtccttgcgcgatgtattggtgtgtacactgggaattctctatggcgtataaatatagagcaaaaagagacgcaaaagttaaactgaaaaatacactatcctatgtacatcgtgtgtaactggacttacaacttattctaacataacttgaatgtaaaaatcgtagaagctgaggatgatgcgatgtgtgtactactagtccatgctgactctccatgtcaccttttagggatagagcgtgtaggtgcattgacagtaaatatcttgtgtattccactagcgaagatctccaagagcacatgtcacttgtgggcctatcagtacgatgtagtacctctcgtactcttcacaagtataaattatctaattaccctataagctcgtagtgattagtgtggggcatcgaccctgtgaggtctccgatgcatacttggtggtatacttggcgaggcaaaggcatcgtattggcagttactccgggggaaggcaaagatttgccgtgcactctcgtagcaatggatggccattgagccactccagaaacacttggttgctcaacagcaatcgaaaccatgtcctctaattggaaaacaaactggcggacttcgactgctatttttgtacatcaacctctctttgtgttgaaaccttaccc

SEQ ID NO: 715919 - DNA, 550 bp, Homo sapiens
cccagctaatattccttgtttttttataaaaggccgggatacaccattgttggccaggcgggtttttgtcttcttgacctttttttttctggccacctttgccttcgggggtgatttgttgacagggaccacccccggggctggccaaacattatagggggaaaaaaacttttgcttttccttttgggggggaacccccccaaaaaattgtctccaaagggatgccctatactttaacaaaccccggactgcagaggaccttcttttgtctaccatatgaactctttatgggcggcagggaaatcttttcaaaatattaattctaaacacacatacacaaggcggcgtcaagaaaaattttaaaaaaaaaaaaacttttttttggagacctctccaacacagatacaaaatttcttacttttaacaaccaatgtctataaaaggtggcctcctagaagcaaaaaaaaacggggcttatttaaaaaacccccctggagaaaaaaaaacctacctcaacttcttttatctgggggcacccgtggctcttttt

SEQ ID NO: 715920 - DNA, 110 bp, Homo sapiens
tcatcaaggggcatggcccatggctcaggtttcatcagcatagtatgggtggttggtgtaaatagcagtgcaggcagagcagtcagcaggcaggttcagttgtaggccaa

SEQ ID NO: 715921 - DNA, 156 bp, Homo sapiens
  misc_feature (38)..(38): n is a, c, g, or t
gcgactctagcaggatctcatccccaaactttgagagngcaaggtgggcgggtcatgagatcagaagttcgagaccagcctgaccaacactgtgaaagcccatctctactaaaaatagaaaaactagccgggaggtggtgttgggcgataacatca

SEQ ID NO: 715922 - DNA, 314 bp, Homo sapiens
agggggtctagagatccgtctactcgcagtgatggataaggtgcacgacacgctgtatttgatttagtaagatttcacatgttggcagatgtctcaaaccctgactcaggtgatcaccacctctgtctccaaagtgctggattaaatcatgcgccaccatgcccagctaaactttgtgttttcagtagagatggggtttgccatgttgggcaggccggtctcaaactcctggcctcaagtaatccgtctgtgccttttacccccaacacaatcttggtgacaaggactttgtgttttgttctctattaaatccc

SEQ ID NO: 715923 - DNA, 252 bp, Homo sapiens
  misc_feature (24)..(24): n is a, c, g, or t
gaggatcccttcagcacagttagntacttaaatatattggttaatggttggagggcatcagtgtccaagttcaagaataaaacttggcatcgttagatattttcaaaagtgaacatctggatggttctctataccgggagatgtgttggtgtatatatatatatatatctgcaaaatatgtcctattttatcttaaaaattttttcaaaatcgggcttttctattggagaaaagccctacggtgctctctcg

SEQ ID NO: 715924 - DNA, 359 bp, Homo sapiens
gagctgatgcacttgtgcatgcggcacgaggcctacctagaggccctctaccacctgcagtccccactcgaccccaggacgcgtgctgtctgaagtctgcgtggagcaccgcaccttcatggactccaagatgaagcccctgtggatcatgtacagcatcgaggaggcaggcatcggcggcagccgtgggcatcatctttaagaacggggatgacctccggcaggacatgctgaccctgcagatgatccagctcatggacgtcctgtggaagcaagaggggctggacctgaggatgaccccctatggctgcctccccaccgggtgaccgcacatgcctcattgaggtggtactacgttc

SEQ ID NO: 715925 - DNA, 255 bp, Homo sapiens
cctctctgggctgcatttgcagcccagagaggctggaagcctggctgagcttcaagtcaagaaactagcctgaggtgtattgcaatggcgtgctctctgaacgagatgatgtctatcctgtgaagcactaagcctggaaacgggacagtcaccatctagtgttcctggtctggaatggctgctcaagtgtgcaatgcgtgttgtgtgttgtatgtggcatggctacctggtaaagccttatctgtatctccacca

SEQ ID NO: 715926 - DNA, 1151 bp, Homo sapiens
cgtcgcacttatagatgtggccagaacatctcttcgtacctaacagttcatgctgaacttgcagatgtcttaacagaggctgtagtggactccattttggccattaacaaagcaagatgaacctattgatctcttcatgacttgagatcatggacgatgaaacataaatctgacaactgatacaagcttaatcagcagggcttgtttcggcaccacggagcacggcatcctgatatgaagaaaagggtggagcgatgcatacatcctcacttgtaacgtgtcattagagctatgcagaacaacagcaagtgacattctggcttttattctaccacacgagctgccaccacagcaagagcagacaaacacctcggtgcaacagcctgacacaccacaccacttccctttcgacagcataagggctcaactcaaaactcatctagcacacctgcaccacagcgcacacgctctgctggcgcacttcagccactaaacggcactttgctacggttacttaaacttccaacaacaacgggccaactcgaaccccccatattctcccctcttaaggaatggcttcctctctccaacacgcaagcgcctattagcttgccatcctgccgccagcaggtcctccaccaaccgagcaacactactgggaccaagcgactgaacctccttgcccatctgaatggcatgaggcggtcagcccccatcacaattgtctcttattgcaccgcaaccccttttaaagttcacttgtaaccttgccctttgtgagcgaaccctattgcaacgcgaacctaacgcctacttattggaccttaattacacttcgggcacacagtaaaagaagcaaagcgcattccaacccctattcaacttccgaagcacacactggcttacaccacaagtcaccgttccgcaattcattggttcaaccaacttgtactgtgcgccttcaaccaagggcaaccccaacaaatacaaggccaacacccagattatcaacctccacgtccaatcccactaagcaactttccacttagcttggcgcaacgtgcgactatgaaccggggacatggttcaacaaaaaactgtccataatcgcgacctgcaacttcccctggcaacatagtatctccaaggag

SEQ ID NO: 715927 - DNA, 668 bp, Homo sapiens
  misc_feature (22)..(22): n is a, c, g, or t
  misc_feature (24)..(24): n is a, c, g, or t
cgtaaactaagtatcttaatgngncctaaaacaacatattttcaggaagatgacagtaaagtctacaagtctctaatgaattattccaggactggcaactgtgggaactgtgtgtgttaggtttgaattcttgttataattagctgatctgccacacgagagtgctatttggattactgggaccagctggagtcaaggctgtataattcatcactggctgcttaggcttctattaatgcgctcaggaaagtgtcaaagcataagactgagggccctcaaaatatcctatcttctggctaaaaaatatctacacttctagagtaaatttgtgccatacagagatctatcatgaactaagaattgtccatattagacctgagccctccaaggagcatatgacacggttcccaactacatacactttgtttaaatactcttagatcccttgataaggtgcacgacatttatttccccgaaaaaaacccggtattgctcacgcccctttaaaccctttaatttttccaaccccccccaaccaaacgcgtattacaaaatcgtaactttcgccacccaacctgcccttctcctcatcttccactctaaccccgccttcatcaaccttcccatatacacgcccgcccttagcacaccgttttctcatctgccct

SEQ ID NO: 715928 - DNA, 130 bp, Homo sapiens
ttagagacgtgtgcaattgaggaagtcccagacataggaaggaggtcagatgccagactggcccattaatgacagatgtactatacagcaagtttgccagcttgtggggattcgtctgggaacttctgca

SEQ ID NO: 715929 - DNA, 351 bp, Homo sapiens
  misc_feature (278)..(278): n is a, c, g, or t
  misc_feature (321)..(321): n is a, c, g, or t
aaaaggaaaaggttgaagaacaagaacaacaacaacaacaaatcatcaagattagaatcactttgacctccaccaaggttaagcaattggaaaacgtctcttccaacattgtcaagaacgctgaacaacacaacttggtcaagaagggtccagtcagactaccaaccaaggttttgaagatctccaccagaaagactccaaatggtgaaggttctaagacttgggaaacctacgaaatgagaatccacaagagatacatcgacttgggaagctcctgnttcaaatcgttaagagaatcactcaaatcaccattggaacctngtgtgggatgtcggagttgtttgtttggtt

SEQ ID NO: 715930 - DNA, 213 bp, Homo sapiens
agtgttctagaggatcccttacagaggaggagacagacagaaggaaagatggcttggagaaagccagcagtctgcgaggctggggaggatggagagtggtttggggttttgggtcgggctctagtgtgatcaactgcagaagcattacaccgtggcctggtttctttactcagcccctggtgtccacctcctctgtgctgtcgggtaccgagc

SEQ ID NO: 715931 - DNA, 334 bp, Homo sapiens
tggcacgaggccaagatcctggcacgaggccaagatcctggcacgaggccaagatccggcacgaggccaagatccggcacgaggccaagatccggcacgaggccaagatcctttggcacgaggccaagatcccccctgactcgtagtagcagattctgctgttataaatataaaatcaactttatttaatcatgtcttggaaatgcatatgtgggcacgaagggagcggactgcatatgctgatagattgggctttaaagctctttggaagtttctcctttgcagctgaatattgtctcaatttcttaccatggcatatgaggctggccgtaac

SEQ ID NO: 715932 - DNA, 561 bp, Homo sapiens
aaggtcggaaaaggggattataaatacagaaaaggtaggacaatatcctgccctagagcacttatgttctgggtgtatgattgaactaaacactaacataataaggcaatagctatcagaacaataaatggtacgggccaagtgagtggtattaccagaagtgggttggggatttcagaggaggagggtgtgccatgggctgtcatgatcagggagagccaaactatattgggctggatgcttagctctggaggttatggtagacaggtccatctgggaccacaaactaaatatttatgtgaagtacatttgagttcaatgtgaaaaggggcaatttaatgaacagactgtcaaaaaaggaaactcataagacgaggaacttcccatcttaaaagtcttctgtcactagaaaacaataataaaaataacaattataatagtagtagtggtggtggtggtagtgataccaggaactatgccaaatgcattttctcacctattacttacgctaactctatgaggtactaaaggtaacaacaggtaacacatagtacgtacaat

SEQ ID NO: 715933 - DNA, 118 bp, Homo sapiens
gcgggccgccgccccccccccttgggaaacccataaaggggcattgccctagccggtccggcctttttccagtccatcctgaacccctggaaaacccataaaggccgtttttttggca

SEQ ID NO: 715934 - DNA, 135 bp, Homo sapiens
cccagacaccgggacgattttctagctgctgcgaagcctgccaggtcaagaagacggagctgtgtcctccgacacttggcggttcgctgaactttctctttcttgtttgattcaccgtggataaaagggaggtag

SEQ ID NO: 715935 - DNA, 134 bp, Homo sapiens
tgatgacagtgatgttgatggtgtcgatgttgatgctggtgatgatggtgttgttaatgttggtgatgatggtagtggtgaaggtagtgatggatagtgatgatggtaggtgatgatggtgatgagtggtgatg

SEQ ID NO: 715936 - DNA, 983 bp, Homo sapiens
ggcacgagcggcacgaggaaggattcctatgtgggcgacgaggcccagagcaagagaggcatcctcaccctgaagtaccccatcgagcacggcatcgtcaccaactgggacgacatggagaaaatctggcaccgacaccttctacaaatgatgactgcgtgtggactcccgaggagcaccccgtgctgtctgaccgagtgcccccgctgaaccccagggccaagccgccgagacatgatgacccagagtcatgttctgacgaccttcaatcagcccccaggcacattggttcctgttgcgtattcgcagggctgtgctagtccctgtgcggcctctggcctgtaccgactggccatcggtgatgggaactccggtgacgggggctcacccacgagctgtgcccattctacgaggggtatgccctcccccatgccatcctgcgtctggacctgggttggccgggacctgactgacctacctcatgcaatgatcctcgaccgagcgctggctacggtcgttcagccgatccacgggcgagcgggaatctccgctgcgctgacattgtcggcagaacgcctgtgctgctctcgccctggacttcgagcgaagtcgatggccgcgcgtgcttccaggcgtcctccctggagaggagtctcactagctgcctgacggccccggtcatctccatccggcacctggagcgggttctcggtggcccttgaggcactcttgccagacctctcctcccctgggcctggtcgtcctggtggcctctcggtcgaaattgctctttcgactcctgtcgctgcatgtgtgcgtggtcatcctggaagaccgctacgccaatgctgtggtgtctggcggggcccaccagttcctgggttgcggccgggtgccccttgtgttctctgtccgggcccggactgagataagcgcctcgccccgaggggcaacccgcggggacggggccctggcggggcctc

SEQ ID NO: 715937 - DNA, 224 bp, Homo sapiens
ggagcaatcacaccgggccgcccggctaccgatcccaagttccggggaggttgtgctgcaaaaccgcgttgacgcggtcgaacgcaaccgggtggcggaaaaccagcccgaaaatcgccgtgcagttgcactcgggcgctgctgtgcgcgccacgttgcccagcctgacctgacggcgcaaatccgcatcggagatcgccgtaccgtcaggctcgggaaggtaa

SEQ ID NO: 715938 - DNA, 230 bp, Homo sapiens
aaaactaactcaacaaacaaatctccacccacaaataattataatttcataaagcatgccaccatgtttttgacagaactaccctaataaccccttttccagttttactttttggtggtgatatagaagttcagcaccgagaacgtcttctttctattgatggctggatctattttcaggcccctgtgaagatagctgtcattttcaagcagctgagagttctcattgat

SEQ ID NO: 715939 - DNA, 126 bp, Homo sapiens
tcaaaaaaaaaatagttgggtataatacatgctataaaccaatacacatttctgactttgggggcagagacagacgggctgatgttgtatagttggtagccctggagtaagaagttgacattaatg

SEQ ID NO: 715940 - DNA, 327 bp, Homo sapiens
tgaaaatagccagttcctgccttaacctgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctccttaactccaccgcctatcccaaaccttacaaggaactaatggataatccccaccacccttttgctggattctttttg

SEQ ID NO: 715941 - DNA, 158 bp, Homo sapiens
aggcagttgtcaagtgaggccgttcgcctttaagcagccagtaccctacaaatcagcatcttgtatggacggggagattgaggacacaggcagatagattcctatgtactcacgtgtatctaggtatcatagatggtgaggcaacagtggttatgtct

SEQ ID NO: 715942 - DNA, 834 bp, Homo sapiens
catccgtgtcctgggcatccaggtggacacagatggctctggccgcagctttgctggggccgtgagcccccaggaggaggaggagttcctgtcgcctgggtgtgcctcccacaatgtctatgaggtcatctccaagagcatctgcccctccatctttgtggggcgaccagacatgaagaagtggcattggctgtgctgcgtcttagtggggctccctgaaagaggctctcctgatggacttactcgccgaggtgagacatcaaactgcgtgatgctaggggaccctgtggacagaccacagtcccagactatcttgtaacgtatttgtgtgagaacagttgtgtctcccactttggggggatatcaccgtcttgggaaaatgtgcgcgcactgtcgcacgcctggagcttgagcacagtacctcgcgtgactgaggggagcccccttcttgtccggaaatttcactcactggagtggcggagccatggtttcctgggcgaaatggtcagggggacccggccatgggatatgaccgaaagttatatgagagaaggaatatgcgcaggcaaagcacatgaccccgagcttggggcgacacatcccacggcagaaggccacatggaaagacacacgcagagacaccaaatcatcttaataatcagcccacaaggagcgtgggtgagatcacccacaaccaacccccctgaaacactatccaccgccatgtccatcccgtgtacaccatgttgaccatgtacggaccacaacaatcacagatgcgatccagcgcacgacaatggcgaaaatgacacaccgaaagaggggggaagggaa

SEQ ID NO: 715943 - DNA, 446 bp, Homo sapiens
gtggtatctgacacaactagatcataaataacctacagttcagtacacatctatctactctgttatgtgcgaaaagatagaagaaagctaacacttagaaactaagctaaattcaacttcccaagtataccttctcccaatactgtaagaataataatagctaacatgcctagaacgtgtgttataatcccaacgattatactaaatattgtacatatactaacttgtctaatccttacaagtctatgagccagacagcatttattattcccattttgtatatgaggaaactgagatcacataggagtaaactggtctacgatcagaactggcaaactggcaccgtaaggattcacatctcagtaatctggatcagagtctccattcttagctacaccataaacctacatatacaacaaaaactcactagccatagtcattcatgc

SEQ ID NO: 715944 - DNA, 93 bp, Homo sapiens
aaaaacgggaatcaaactgaatgtcgtcttcagcccagacactgctataactccctgacattgccagcgcatgcaccacgaagaatcgtatcg

SEQ ID NO: 715945 - DNA, 796 bp, Homo sapiens
ctcttcttttttctgttttgttttgctgttttttttccacccttctctgttgttctctcggtcctctttctttcatctttcttccatttttttccttcggcatgtcctcccaacgtcgcttctgtccggccttttggatccccttcctctatccgtctcttccactcattgcttcttttctgtcgtgtgtcccctcgtttaccctcgtccctacacttctcgcatcttctgttccttaacgctagtttctgcatcattcctgcatttcgtctacgtacgtgctgttacttccttcttctcattatcaactacttatctactagtttacttgaacgaggcctggttagcggtctagctgcaacctcaagtctaggtactgacgcccgacagactcctacccttactagtctcaagcccctttccattcagtttattttgcagcaggtttttattattattattattattattattcacaacagacactttccctaagaatctcaaacgtgatgttcgtaacaatccggtaaattagataggggccctcgctagttttctgtgtcagtgctgtcactggtcaaatgtggatacatcaaggatacgccgagccgatcaaagagcaagctcgaagtttactctggagtgtttcggacatgatacaacgtagccctaggcacaatgcccgtctggattgtgatagtgagcaaccaagttcgcttagtgtattctgtaatgtgtatatagtcaatgtacggtataacgaatgtgatgcatgaacgtgaaaatattgtagata

SEQ ID NO: 715946 - DNA, 217 bp, Homo sapiens
ccgaggtagctcgtcatccactgccttcttgcttgcccttccatcttcggtgagcctggccgcccagtacgcaccctctttgttgccattgctccatccaacaacttcttgagctccaacattttcctcccgctagcctctcggcagcctgatcccgctgttccaggcccttatccacactgggtaccgcagctcgcaattcagtcaatccatggtc

SEQ ID NO: 715947 - DNA, 1489 bp, Homo sapiens
gcgcggaccccgagcacgcgcctgacagcccctgctggcccggctgcgctggcagttagacatgtgccatgctatgtgtccccgaccctggtgtgcctgcctgagacctgctgtgctcagtggacctacccctgctgctacttcacctgtggacgcaggtgtgcccacgctgctcagtggtgcgatgtgagctggttggcgtacgtgatctgacctgtaacgggtgtacaaacgatcaatgacgatgttcaaccctgacctggcaatccacgaggtgagcttccctgtggtcaatcagggccaactatcagccctgtgtgcatgtgaattgccaactggtatcccaccttatggtgtgccatttccaacaatcacaccacaggtgccattggtgacacgcaacgtagtatagacacatcatcatccatggatctggacggaaacttgtctccaagaaggcaagcaccaagacgtattagaagcaccaacgcaaagacatacaaaggcagctagcacgcagcattcgcagattcctgtgcgaacgcctagctgaggctcaactagattgagaagcagggcatcgtgcgagctacgattcgaaagagccaaaacaccatagtcatatacattaccatcggcttgtaaccattgccttgccaccaattctttaggcattgacatgagacattggagatagacaagacaccttgagacatcaaccccattatgaggatctatatgaggagcacggatacactaataataagacccactattccataaccattcttggtgccaggatgacattgcgctaccagagtagacaaggattacaagggacaccacaagcgaggccatagagaacttaggcgcttagcacacgacacaatatgaaacaattatattggaggaggcaacaccaattgactccagagaatcaattacaacgacaacgaccgttcaaaaaactggtagggaaaaaccccacttacttggccataacaagtccaacttatatacggtaggacatatggagcagcaaccattagaaatcgcggaggggacgacccacagaccaaagcaatcggattaggaatccacaccaaatatgcaacaactttaccacaacaaaccccacttccccataatacaccaacaaacactgggcattccagcaaacaagataaccccaagataaccattcacaccagttgacaataccacataaatatacatttcagcctttggcgaggaaacgatctccctcctccatgaagagaaggcattgtgcgacccaccgacagaaaccccactctattcgccgtagaaccaccagaggacaaaaatacagtcgcttcacaaaatggggcgccccacacatcaagatggctctcctacaccccgggagcacttcgaactcgtggaccaccggacaacatcggagacatacgacacatatacacactcagaacgagcaccaaaaattccg

SEQ ID NO: 715948 - DNA, 286 bp, Homo sapiens
ctaaattcgcggccgcgtcgacggtgatgcggcggtccgcaagggctccgatggggtccgaggcgaggttgtcagggccggagaagggccaccacgcaatgacgggggagtccgacagtagcagcggaaggataactgaggcaggacgcttcgccatggctccggaaaaccgcagcacgatgacatccccgggggtgccttcaccggcatgcacctcggcgtcaagcttgtctttacgagaacgcgtcgtcacgaccatgaggaggtcgacgcggccgcgaattta

SEQ ID NO: 715949 - DNA, 979 bp, Homo sapiens
ctgggcctgagctcctggctccgtgctggggcgcctgcgagtgtctcaatgatgtgctggagctagggcgaattaaatgcacattgtgatgagtttcctgtggatgtctgagctccaggtgcttcttggctttgctggccggaacaagagtggacggaagcactgagctcctggccaaggctctgcacctcctgaagtccagctgtgcccctagtgtccagatgaagatcaaagagctttacctgacgacgctttcccctggaagaccctggggccctctgatctctcccttctctctttgcccccatggcacctctcctgtaggactacccctggtcctctagactcccattcccccaactgctgtatggccctggcaccctgctagggccccaagcgttgaggttgacattgcaacccaccatctgacccagacctgttgcaccactgatgtcaccatgaaaccattgcccttctatgaagtactatggggagctcatccggacccatcagccttgcattctcactttctagccagcggtttgaggaatgcgctactttaacctttgccctacacaacccagcaatgtgcgagcagcattcttacatccagagaggttcttgccaggagccaaactgtgcattatacccataacaggtgcagctaagggtcttgactctgtgagtaacaagtcttgctccaccaatgggattgatttattaataccctgtccgaaccagtcgtagtgatccaacgtgggtcaacactgtgcgcaaagagcatggtagtctcagcccatgtgtcccggtgggtttaacccattatgaccccgctacgtagcccaaccgtacaatttgcggtcctgatcacgcagaatgatggtgtcgcgctaatcaccagacccccagagatcgagacagagccacttaacgccacgtgtggtgtacggaattccttaatgtacacgtggtatcacca

SEQ ID NO: 715950 - DNA, 426 bp, Homo sapiens
tgtcatgcggcggccagaaaaggtccaggtgaggtagtccacagcatcctgcttgtctcaataggtcttggtagacaatctcagcattgatggtggatcgtgcatacaagtggtccaaggtagagattctactggacaatggctcatatatagaacttcgttgacagaaatccttcctatggagccctgacgacatgtatgacgacagcgcccctcgatcgtccatgcaagagggtcggttggtcgtggcccaccaatcgtgaagcacgtcactagataggggtaatccacatatagcgcgtggatcttgcctattagtagtactagagtatccactgattgattacccaggctgggcagccgacgttcactgccccgagcaagggacccacgtcgcgggtccctgacgctcgaatatcgtaatca

SEQ ID NO: 715951 - DNA, 1083 bp, Homo sapiens
ggcgtagtccgcccggatttacgggatctgagaccctcctgcaggcttcctcagggacagccccactctgcctcttgctcctccaggtcagcaccattgcagcccctgtggctctgctggtgcactctgggtgttgcccctgtgccagcccctggggccgcctgaccggggagcagctcctgtgcgctagcctgcatgcggtagtcatgcagctcaatagaggtgcccaccctggacagggccgacatggaggagctggtcatccccactcacaagtgagtggcccagtactgttggccctgctgcagcgcagccacggtgacctgtcccgcgggaaaaagaggttcagccagagctttcccgagaggtggccggcaggcgtcctggcagtttggagcggccagacaaaaccttgcatggtatgtcagtgcattggagcacgcggaatgagcgaccaaacaagcgagctggtgcagggccgtgctggcgagaatctatccaaggaggcctggtccccaaaagtgcccgacgtccttgcacatgggtcacgggtgcgtgcttgtcccccggcgtcaagacgccctgtgggcaccgagggatgacccggtcgaaggtggtcatggcgcggttccgaggtacgaactgggattccaagctgacacctcaccttcattagaaatcccagtggcgtggtggtcccaggatcacaacgggaggaacaccgagctattggacaaaaggagaccttaaccagaacacgttagacccaggagagggcacagattgaaaacttagccatgacaaaggccacgctataaacgaccggagtcacaaacgtagcaacatctcagtgtttgaaattgcactacacagggagattgataggaggtagaacagaacaagacgaaagaaatttattggggacccaggaaaatggacagatacagagagtagcacagaaacaaaatgattgagaagccagaataacgagcactgtcgacatggggtggtgagccccaagaacaggtggaaatgtgagaaaaacgaccacaagaatatttgaacagggcctgcaaaccgaag

SEQ ID NO: 715952 - DNA, 876 bp, Homo sapiens
gctacaatcgtaggtgacttggcaagaccgcggaaggctatcttaccaacagctggttggggggctggtgatccctggtgtagtagtgtaaccttaccctatagtgcttggcttgcacctctaccttgttagctcatctggagccgctcccagggccaagtctcctgacaggagattggttccctgcaaagatccactggcaacggtgtcagttgtatgacccagtgttagaatgcaagaggtcaggttattctatccctcatggtctgaaaggtccatgtccttggttccagcactcactccacgtccagagaggttctcgagaccaatcacagtgccatgttacctcgggctagtaggcactcgcgaggggagacacttgcggtgtcacaactccactggacatgcctgtggctgcgagataacccaagggtctggctttgttgcatcgctcacaaattcggtgctggcggctagttgtcccataccacccatgcagctaacgtagcgtgaggtataacaagttcccaggagccctgtcaagttgacctcctcgagcttaaaacccttcgattcttctgctttgttcgacatgcaaaatcgaacctcgcggagatcgggagggtcgactccgcccttctcgaagtatttccttataccaaaggaattccactgatgagaataactcgggtgatccgggaccctgagtcaacgtaagtcctccgtctattgcacatactttctgccgcaagagttcccagtaacgttcttcatgtgggcaagcagtcactgactccagggtgcgtgcgaagagggtcggcctgcagatcctggttgaaacatcccgggtgtgtgtccatccaggtatcggaccgg

SEQ ID NO: 715953 - DNA, 641 bp, Homo sapiens
agcggagtgcactgctagctgaggaaggaagacggacattaaggtccaatgttctgtctgtactcatcaatgcctgtgtctgggtcctaactgcatctattacagtctacactcctactatgattctggacggatgggatgagagtttgattcttacaacacctgcttagagctattggttgcccctctccacatactcttcggacaatagcgaaagccgtgaagcaagtcagttgatcctagctgtcctttcgatcgtaaccaacagcaacacgggccattggactatcgactcgtccctgtctcgtgtgcacgaagatgggtctgccgctaatactgcatacgcgcaaaaatgcgcttggaactcgttccctcccctggaactacatggttcaccttgttccactccctgaaacgtgtgactcgtcgcatctgtgacactctaggaaagccgcgatagcgagttcgtcgcgaaatatgcaaattacgagaccacttcttgacaagatggagcaacgataggtctgggagactaacaagacctagtcgctttgtatataatacctttccactgtggcattgcaagcgttccttgtcgctacgtgaagcaaggacatggactcgacctctaagcactattg

SEQ ID NO: 715954 - DNA, 491 bp, Homo sapiens
agctggagtgcagatgtgccatcccgggctctgggctcctagaccgtgtggtggtgcctgccagtgagtgggcctgagcctcgcacgtcctctgaaactacgctatgctctgcttttgctgtgctgcgatgggcgtgggaggcggggtgcttggccaaagatgggctaggggttggaggaagatggcccggtagcccgctgtggtgtccttgaggccgtactgtgcgtcctgaacccacccctgaacgctaggagacggacgcagggcctgtgaactcttacgctatagtcatgaatccgcgatggggaccgcccgaagcgatcaatcgtccttggaacacgcagccccagaacagccctgcgacagaggcatcattccagggaaggcacatcaggaacgttccattgaagaagcgatcgaatgaggagcatatatcaggccaccgcgggggaggtgtccggtcacgggggcagcaggtcatcacatgacc

SEQ ID NO: 715955 - DNA, 355 bp, Homo sapiens
ctctagaggggttggtcccatgggttaagagctccccccaggttctcccctcaggggttaagagctcagagttcagacaggtccaagttcaagcccaggccccccccttatagggtacaggtggggttcgcctgtaaatgaggacttctggaccattccaaatattctggggttgagggaaattgctcctgtctccaaaatgccaagggtggccaggccctgtggctcccccctgtaatcccacccctttgggaggctgaggtaggaggattgattgagcccaaaagttaaagcccagcctggtcaatataccaagcccccgtctctaaataaaaaataataggccggccagcca

SEQ ID NO: 715956 - DNA, 276 bp, Homo sapiens
  misc_feature (44)..(44): n is a, c, g, or t
  misc_feature (213)..(213): n is a, c, g, or t
  misc_feature (215)..(215): n is a, c, g, or t
gccccgctgtctatgaggacgatttattattccactgggggtanctggcagtggggtcatcaggtactttcaagaagggctcgtgcaggacatcacacagcctccgggctttctgagggcccaggcctgggcataaggccagatcttctcttgatgcggcgatgagctgtatccagagatccaaatgtggtcaggagggtctgactgtccgtntngttgactgacttcacggtggtcagacattcagtcacccgggagacgaagtcctgctctagc

SEQ ID NO: 715957 - DNA, 632 bp, Homo sapiens
aaattgttctgccccatggccctgctggtaacacccctttgtcctccaaacccccgttgtttcaccggcactcatttttcaatatttgccccccgcggttaatctccccccttactattggcggcgccggcgacaaatcctcaactttcaaaaggcacactcacaacttggccctcataataatcacctcttctcacaggagcttccaaaattcggtgtgcccccccaataaagctctttttgtgagaaatttttttacgccacagccccctcgctccttacctccgccctttccccgcccctattttaaccccctgtggagaaaatctccgttgtggtaggaaacagcgttgttccctgagtctcaataatcaccttctcctacttatcacggaactgcaaacactactatgttcccacgcccctaaatcttccccccttaacactaattttaacacaccaccaccaccatgggggtcatactaccaccccccactacgcttaaccacacacttaacccctctccttcaaccaccgcagcaaccacaccccaaagttcaaaaccccatcccccctttttcccctttccccccacccccaaaaccttacccgggttttcccccaaaaaaaaa

SEQ ID NO: 715958 - DNA, 555 bp, Homo sapiens
  misc_feature (525)..(525): n is a, c, g, or t
aaagatgataaacaagttgattgtcagatgttgtgtctagatgcatcgggagctcaaatagaacagatatcatatgctatgttagacgcaaacacaaaaggaagagggattctcagtcaaatactgatagttcacaaagtcattcgagtttcgtccgctctccctgtgagagcttgaggccaaggactaaacctgcggtagttgaagagtcggaatggagcaggacagctgaagcttctgctgctaaaaggggtaagagggcaaaaacagtgggatcatttcagtgtgatattgatctgtgtgatatgacatttgagactagggctgaacttaatgcccacaagcgcaatatttgcactgacgagtcatgtggcaagcgtttcagctcacacaaatacttgaagcgtcatcaatgtgtccacagtgagatgaggccatttaaatgcccctgggaaggatgtaaaatgactttcaagtggctatgggctcagactgaacatatcagggtgcacacaggagagcggncatattagtgctcagctcctgattgtgggc

SEQ ID NO: 715959 - DNA, 460 bp, Homo sapiens
  misc_feature (448)..(448): n is a, c, g, or t
  misc_feature (457)..(457): n is a, c, g, or t
gttcacatggtctttcctctgagtgtgtttgtgtcctaatcttctcttcttataaagacactagtcatattggattagggcctccccatgacctaatttaaataaattaactatttaaagaccctccaaatacagtaaccttctgagatattgagatttaggacttccaacatatgaattttagaagggaacaatttagcccataacactgtgtccaattcttttaaaattaatgtttttgttgtaaatgggactatataaataccttcgtatatatgggcagaccacagggacttctgtccaagaggaactgagttccaactccatctatggccagcctgggggcaaccagagccgagacttccaacttcgggaaaaggccaaaaccaaaaccaaaccaaccagggcaaaaacccccattttgggcttgacaggttgactttttttngggggccanctt

SEQ ID NO: 715960 - DNA, 1312 bp, Homo sapiens
  misc_feature (1312)..(1312): n is a, c, g, or t
ccgctgttcctgggacgtacggttgaccgcgcgtatgctgcagagaccatgatctgcctgactggggcagagtgctgatggcatgcacccagtgtgacatgtggaagaaccggtacagcagcccagtgtggtggacctgtgtggccatgcatgcctctgatcagctccacctgctgacatggttgtcctgcatgacctaatgcctacacacgcaacggcagatgctaaccctgcgacataccaatggacttgtcttgctgactgcaagccacgacgagacgtgcgatgctcgacgtgacacctacactggctggctagctagtacagctgtgggctacagcccgatacctactaccaatgctaggatgccccaagcattagcaatacaaggcaccagtcggaagtaagctagcgccacaagggtgagcccttgggccacccaacaagctatagagcacggagcagaccgcgtaccgccccgataccttggccagcaaagccgccaaccggccagcacacgcggtaccttagtgcctgtgacaacaccacagggacgcctttgttgctctctcaccttcaaaccgggcgatggtacccggagccggagagcccgacaaaagcgaccgcactttcgcgttaggtacctaaacgactaggccaccacaactggcgggcaaccaacctgaggtctcggtgccacacaaaccgccccgcacagtctatgggtacccccgcgcacaatcggctcgccgagggccgacctctggtggcgcaaccactgcggccatcgagaaccgcacccccagaggaccgaggcgggatcaggcccattccacgcgatgcgcccaacccgggcaaaggcgacacgggcacgccgcgcaactatgagcgcaccaccaacaacgacgaaagcaacaaagcaaccgggatctcaccacaccaggggctgacaaccgcgccatccgggcgaacacccccccccctggcgggacacgcaggctgcgctctcagcccgtacaacacacgcaaacaaagagagtcttcaacgacaacagcgtggtacccccgacaaaattttataggctacggtacgagagcccttttaccaccaccccaccttgcgtctccgttcatacttcgagcggaaccgtaagaacgcagcccaccagatagacagaccaacacttatagcgacgcaggtccatagctgacgcccctctatctgcgagcatacagcagcgcgggttgcatagtagcgaggcagacggagcgactgcgctactcacaccctacgcaaacgaaagcccaaagn

SEQ ID NO: 715961 - DNA, 204 bp, Homo sapiens
cgtagaggatccccatgcttctccccaggatgcaggttgcctcaacatacacgtcaagttaactctgattcatcccataaacagtaactaaagattaataaccatgtgattatctcaatatatgcagaataggctttcaataaaattcaaggcctctccatattaaaaactcttaaaaatcagggtacatggggaacatgtggg

SEQ ID NO: 715962 - DNA, 173 bp, Homo sapiens
ctctacagtctcatccaagacttgaagagctcccgactatgtaatactactatgtgtttaccaagtggactgttgacactgctatcgcttccgaaagaccgtatagggacgtggggattcagattaccctcgcgtatataacggaatacggcgtctaaggggtttaacgtgtc

SEQ ID NO: 715963 - DNA, 715 bp, Homo sapiens
tacaaaagccagtcggagttaatggtttcatttgcccaaaaatacaccttgggggacctcaaattctttccaaaaatcactaccacacatatagaatttgagaacattcgccacccttccaccatccatttctcgcagagaacttcaaaataaaaatgggccagtctggcccccactcgggctcctcgtcaatgggctggtctcttcttttccaggggctgcagttctgatgtagaatgatgggtggccattccagcattggggcctcgggcaggctgcatcacatgatgggcacagcatgatgttttggtgtcccgggcagtttaataagaaggcttttacactggtgtccccagcacctcggatttgggacaccaaggtcatctagcttctcacctcgctctaacaagaaactccatggttgtttgtcgcaaaatggatctagggtctcatctagttcggcctgcactttagtcatggggatcaggcttctcgagggagtactgggaatctacctggagggtgaccatccagggcggggaaagggattggtacgcaggggatccaactgggccagttctatcctgtcgacttgctgtggacaatccatctagtcccttctccagacaaggtaaaggccacccgggatgcgtatccatggtccgaatgacccacacctgaagactatcatcccggacgtaaacgtgcacaaatg

SEQ ID NO: 715964 - DNA, 123 bp, Homo sapiens
cggccggtaccttcctctcctcccacctcagcctcccaaaatgctgagattacaggtgtgagccactgcacccagccatatcttttgatttataccttaggcatatataccagttgaaaagta

SEQ ID NO: 715965 - DNA, 374 bp, Homo sapiens
  misc_feature (34)..(34): n is a, c, g, or t
  misc_feature (121)..(121): n is a, c, g, or t
  misc_feature (125)..(125): n is a, c, g, or t
  misc_feature (246)..(246): n is a, c, g, or t
  misc_feature (260)..(260): n is a, c, g, or t
  misc_feature (367)..(367): n is a, c, g, or t
tgctgcctgttaacatgatgcctttgaaactctnccgccctttgaaactttcctacccctccccttcaatccttatccctaacccaaatgagaataatgacatattgaaaacagcctctancttnaggctggccacggtggctcacagctataatctcagcactttgggaggctgaggtgggagaattgcctgagcccaggagttcaagaccagcttgtgcaatatagggagactccggctctacnaaaaagagtttttnaaaattagccaggcgaagtggcacacatctgtggtcccagctgctcaggaagctgaggtgggaggatcacttgagcccaattcaaagctgcagtgagctgtaagttnatcactg

SEQ ID NO: 715966 - DNA, 126 bp, Homo sapiens
gactattgcctgggtgactagagatcccgtgctgctcacatcggacagctgaagacaacatgaagatgtgattcagcactgccagcgagtcaaacccatcattgatctcgtccataaggtcatcag

SEQ ID NO: 715967 - DNA, 238 bp, Homo sapiens
  misc_feature (7)..(7): n is a, c, g, or t
  misc_feature (22)..(22): n is a, c, g, or t
  misc_feature (43)..(43): n is a, c, g, or t
  misc_feature (144)..(144): n is a, c, g, or t
  misc_feature (153)..(153): n is a, c, g, or t
  misc_feature (233)..(233): n is a, c, g, or t
tatctcnccttgcacatacagngtacgtaactggtaggctgtnccgcacagacagactgatctacagcttgtctagcaaaagtgattcaatcttgtgatgacctgccttgcaaacccaaacataattcattgataataatgtcncatattccngtgataattgaaatagttaaggttatatttgtttaacattgggacataattatcttctaataaagctaaagtttctgttnaaaaa

SEQ ID NO: 715968 - DNA, 711 bp, Homo sapiens
ggggaacaataaacctggctaagacaaaacaaaaaaaaaataaaaaaaaaaaaaaaaaaaaagaaaaaaaaaaaaaaaaacacaggaacaaaaaaaaaaaaaaaaaaaaaaaaaaaaaaaaaaaaaaaaaaaaaaaaaaaaaaaaaaaaaaaaagggggggccccccgggccaaatgctctttaaactgggacaatttttagcaaggggccaaaattgggcccaaatgggcaaaatgccccaaaggggggggggtaaaaaaaaaaggggccgggtcttaaaaaccgtgaaacgggaaaaacccgggggaccccaaaataaaacccctggaaaaaaaaccccttttccccaggggggaaaaaacgaaaagggccccaccaaatgggctttcaaaaaagggggccccccaaaaggggaaagggaaaatggaacggaaaaaatttggaaaaaaacccggaaaaaatgtggtaaaaacacccaatttttaaccaaagggggcaaaatggggaaaaacccttataaacaaaagaaaatcccccaaaaggggttaagggtgcccccatgtgggaaaaaggccccccttaaaaagaccgggccccccaacctaagggggaaaacacgtatatagggggaagggcccacacgggaaaccatccccaaaaaaaactttttggggcccagggccccagccctgggcccccgggggcccccc

SEQ ID NO: 715969 - DNA, 248 bp, Homo sapiens
cgaatggacggaatgttatggagagtagggagttaatagaatcaatccgaatgtaatagaatggaacggaatggaatggaatggaatggaatggaatagaatgcaatggaatggaatcaacccgagtacaatggaatggaatggacctggaactggaactcgaactggaactggacctacgaactggaactggaactggaactcaaccccgacgtgaaactggacctggacgaggacctggaactgga

SEQ ID NO: 715970 - DNA, 124 bp, Homo sapiens
tttccattttacctcccaccagatccggagatcgcccgccatggctttacttactgcggccgcccggctcttgggaaccaagaatgccatcttggtcttgttcttgcaagccccggcatgccag

SEQ ID NO: 715971 - DNA, 1472 bp, Homo sapiens
gggtggagacttacattactcctctcatgaaagcgggagtacaaaacaacatcccggcggggcggctatagtggaagccctgcttcttggtgtagacccgcagaaagttgggccacaacgagggactgttttttttcatgttgaaaggagaatctttttctataggcgccgggggtagccacacacccacaacggtgttgccggacccccacctgttggtatttaaaaagggggtttctctttctatccggcggcgatatttaaaaaggcgtaattaaatgtcgttcctgttccgccatcttaggtggtggtgtgcccctctggggccacatttttgtttgggcggacaccaacaacaaaatatggggggagatttctctttcaacgggaagcccctcttggtgtgaagacagggtggaaacatttccttgaaaacctttttctttgaacgggataaagtacagggcccccccgccttgtttgatgtaaggaacaaggagtgtctggcgacgcaaatatcacacacttcttttgtggggggggaagtatcctcccctaaaatggggatgtctgttccacacatgtttgtaaaaaaagtttcctctgtttggaaaatgttccaaataattgccacagtgtgttccacacctcggtttcgtattaggggccgtatcacaaacacaacgggaggatttttttttaggagtttggaagaaggtttttggtcgacaaaaagtgtgggttccccccctctttttgatatgatctgaagattgcctcgctgggagattttataaaagccaccgctatatatatttgtctttaataagagctggtgagacctcgtggggagagaaagacacactttcaaacacttttccctcgagaaagtctatagagaaaatatatgagaaatcgtggtcttgtttaaaaaaaatgccacccacgcgcgtatatatttccctcgatatggctgtgaaatggggtatattaaaattcttggtgtatatggtctttctacacacctggggttaagtgtggtgataaataaggttcttgcccacaccgtcttgagacggcacccacctcgtccacaatggcttgtgtaacgctatctgcacatttggccacctctgaagccacgcgtggaatgtgttaaccgtggtgttaataataaactttcctcgggctccgtttacactgagaacacatggcctaagtccacaacactcttttttcccacgtgagagtgcaacactctcctgggagtccacgtgtataaaatcccaatatcacatgtcttgtgcactaaatttttcccaaggagttttatttttgtgaaactaataatcacgtagtggaacacttaccaataataaatgtataaaaagagtttaacataccaacaatgcaacccactatccaagtgttatatcaacttaaaccccccatataaccttggacagtgacca

SEQ ID NO: 715972 - DNA, 379 bp, Homo sapiens
  misc_feature (175)..(175): n is a, c, g, or t
  misc_feature (278)..(278): n is a, c, g, or t
  misc_feature (353)..(353): n is a, c, g, or t
ttttttttaaagcagggtctcacttggtggcccaggctggggtgcagtggcatgatcttggctcactgcaacctccacctcctgggctcagttgatccttccatctaagcttcccgagtagctgggactacaggtgtgcaccaccacctctggctaatttttgtattttttctanagatggggtttcgccatgttgtccaggctggactcaagctcctggcctcaagtcatctatgctcctgtttggcctcccaaagtgctgggattacaggcatganccacccgtgcccagctgaaagcctaattctttaattccatacaaggtctggaaattctcatgggcaatacaaaanaagtttgcctcacctcctgaaaggcg

SEQ ID NO: 715973 - DNA, 335 bp, Homo sapiens
tagcggcccagacttctgtcacagctactttctgtctcgatgaatttgactatcctatgtaccttatgtaagtggaatcatacagtatttctgtgactgtcttatttcacttggtgtaatgtcctcgtggttcatctatgttgtagcttgtgtcagtgtttccttgcctttcaccctgaataatgtttcattgtatgtacaacatatagcacatatttgtttattcattttcccattgatggatacttgggttgcttctaccttttggctgttgtgaataatgtcgctatgaacttgagtgtacaaatacattcaagtgtccctttgagacactg

SEQ ID NO: 715974 - DNA, 218 bp, Homo sapiens
cagcaagaatgcatatcaggaagatatttacgttctcaccccaaaatttccacgaattggacctgaacatcagccaaatggtagaaacacattaaagccactagaatttatgttgcaatacgatgcaatggataggaactccttacagtctgctgtatctcacattgcccaggtcgcctctgtttattcccccctattctgatatgccattcttgctg

SEQ ID NO: 715975 - DNA, 212 bp, Homo sapiens
  misc_feature (24)..(24): n is a, c, g, or t
  misc_feature (91)..(91): n is a, c, g, or t
  misc_feature (93)..(93): n is a, c, g, or t
  misc_feature (95)..(95): n is a, c, g, or t
  misc_feature (103)..(104): n is a, c, g, or t
  misc_feature (108)..(108): n is a, c, g, or t
  misc_feature (141)..(142): n is a, c, g, or t
  misc_feature (156)..(156): n is a, c, g, or t
  misc_feature (212)..(212): n is a, c, g, or t
gagacagagtctagctgttgcccnggctggagtgcagtgagtcgagatcgtgctactactgcctgggtgccaagggtgagactccatctcnananagaaacgnnaaanccgggaaagttttctttactgttggttaattannaaaaagccagaccntagtttgactggtggcatggaatttgtgtatcgaataaatgcattgctattgaggn

SEQ ID NO: 715976 - DNA, 149 bp, Homo sapiens
gactgtgaggccggtggctttgccttcgcacgggcctgtgaatgtcgtgtctggcttactcgttaccgtgacactgtcgagtatcggaatcgtttccacctcacgcagtgctcacgaggttagggacgcttgtccttggtcctatagcc

SEQ ID NO: 715977 - DNA, 631 bp, Homo sapiens
  misc_feature (424)..(424): n is a, c, g, or t
ctctaacttactatcaaacttacttcaacacaccatttacccaactattgactcagctatagaatttgcaacctaactcgatacatatcgcaccacatgtgaaacctcaagggttatatccaaacttattatcacacgtactatcccctatacttactgcattacctattaactaaagatttctctacaagtaactccacaactctatacacccaactatttagcagatttataggaagatgcatcagtcctaccgaccctcctaataactctgtgtacaacatataatcctagatcaactcttaattcaactacaaatccctctacataaccttgtaaattcaactgttaatccaactaggaacacctatatgaacactactatagacactaggaaagagccttataaatatagcacccatantaacactcatagcaggcatcaattcagacaccatttaagctaaacatccacttcctcacacactacctacatattactaaactcctgacatcacatttgacacctctatcaccctatctatcaacctatgttagaactactgacattataacatacatctcacatgatcctacgtatgattcaaactctgatcttaacactaacatc

SEQ ID NO: 715978 - DNA, 297 bp, Homo sapiens
ggatcctaataccgcgtatagagacacatcaaattatccaccatactctgtgaaactggggcaccccagacacctgaacagggggacattcaagagctggtgcgaaaagatctgccaaattttctcaagaaggagaataagaatgaaacggtcctagaacacatcatggaggacctggaccaccaatgcagacaagcagctgagcttcgaggggttcatcatgctgattggcgaggctaaccttgtgcctccccacggagagagattgcacgcgttgttaaacttacgggttacccg

SEQ ID NO: 715979 - DNA, 454 bp, Homo sapiens
atacctagatgaagttaaaggtacctatatccactaagccccaaacaccatatacattaagttcaatttataagcaaatgtagagaaaagcaacaagaaatagttaactatatattaagacaaagatgattcctcaaattacttggcatccttactctgaaagcctgaaattatgtaagattcaaggcacatagtaggactgaaagtcaaaatggaaatggatatatagttacagaaatcagtgtagacctgaatatcaccagcatctaacatatttcctgcctggctcatactaggtactaaataaatgtttattcaacgaatttagtctgctacagaacctgctgatagcacttttttttttttaaaactgagcttcaatcttgtggccaaggatggagtgcgatggcgcaatcatggctcactaaaacctccgcctcccgagatactggga

SEQ ID NO: 715980 - DNA, 112 bp, Homo sapiens
  misc_feature (17)..(17): n is a, c, g, or t
gattcttgtctggctgngttccctttatgtttgaaactagaggaaataggagtatgccggtcaacttgtctggagtaactccagacaagttgaccgagtgagacgctatctc

SEQ ID NO: 715981 - DNA, 859 bp, Homo sapiens
  misc_feature (859)..(859): n is a, c, g, or t
tggaaaaacgggctatttttttccaaaaaaaaaaaaaaaggggggcccgggaaccggggttgcccatccggccctccagggcccggggggggatttggccctcccgcgattgatggtggacaaggtgactctccacatgtgcctgtgaacactttgcatctcccgggctcacaacagacattacagacatgtggctgtgggagaagatgtggtttacaaacaggggtgactcgggaactccatgtgtgtggggctccccagaggggacctcacaatattcccgaaccatttttgtccgggcgaacagggtgccatgtagaccaacaaagttcatctcactaaccacccgaggggggcccacccgcgaagtgaggggttcactagagagagggagccacattggccagggggctctacagagaggggtatctacggcggagcccacaacccccgcggcacagagtgaagcggggctctcacagcgtgataaaagaaaaagcggggcgcacaaaacagcgcgtcttctctcaccataacacagagcagagggttgcgggccccaccatagtgctctcaccagtgaggggcgtaaataacaaggcgtgtgagagatctcttgggtcccgaggacctcattcctcatgcacaaatctacaaaaaacgagggtgtgtcacagcgcgcgggagacatctttggagcgcgctcctcctggggagcaacatgttgtgctctaggggagacgtgtctacagtggggagaaagcccctcgggcacaaaaaccccgagatgtttacaacaagcgcccgggtgtcccacctcatgggggggaaacaagatccctctccggggggaatgccn

SEQ ID NO: 715982 - DNA, 152 bp, Homo sapiens
tcgtaccgcatctcagctgtcttctctacatagttacccagttcccactcgatgagcacgtgttccacatcatgcagcttcccaggtacatacatagaactcgtcacgtgggacgagtaattctttccctggtgaaagcatatgaagacaaa

SEQ ID NO: 715983 - DNA, 130 bp, Homo sapiens
gtcctagtatttcagtgccaggataaacaggtaaagaaaggctggcagttccagagaggctcatggacagtccaggcagaggggagggccctctctgtcccccttcccacgctaaccgccgctcagtaca

SEQ ID NO: 715984 - DNA, 425 bp, Homo sapiens
  misc_feature (331)..(331): n is a, c, g, or t
  misc_feature (362)..(362): n is a, c, g, or t
  misc_feature (364)..(364): n is a, c, g, or t
  misc_feature (371)..(371): n is a, c, g, or t
  misc_feature (374)..(376): n is a, c, g, or t
  misc_feature (378)..(378): n is a, c, g, or t
  misc_feature (381)..(381): n is a, c, g, or t
  misc_feature (383)..(384): n is a, c, g, or t
aagcttgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctaccnccctgcctgtgcctctgctgctgcgcccacnancaccccnttnnncntcntnnccacggtcaccgtgcggccgatgcccaaggctgtcttggac

SEQ ID NO: 715985 - DNA, 450 bp, Homo sapiens
  misc_feature (356)..(356): n is a, c, g, or t
  misc_feature (387)..(387): n is a, c, g, or t
  misc_feature (389)..(389): n is a, c, g, or t
  misc_feature (396)..(396): n is a, c, g, or t
  misc_feature (399)..(401): n is a, c, g, or t
  misc_feature (403)..(403): n is a, c, g, or t
  misc_feature (406)..(406): n is a, c, g, or t
  misc_feature (408)..(409): n is a, c, g, or t
aagcttgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctaccnccctgcctgtgcctctgctgctgcgcccacnancaccccnttnnncntcntnnccacggtcaccgtgcggccgatgcccaaggctgtcttggac

SEQ ID NO: 715986 - DNA, 561 bp, Homo sapiens
  misc_feature (12)..(13): n is a, c, g, or t
aaagttgcaggnncaccatttaaagctaatacgttaatagccttcaccaagctattaggagctcctacacacatcctcagggattgtgtgcacattatgaagctggagctgttccctgaccaagcaacacagctaaaatggaatgttcagttttgcctgacgatccctcccagcgcgccgccgattgcacctcctgggacgcctgctgtggtgctgaaatccaaaatgctattttttcttcaactaactcagaaaacatcggtccctccccaagaacctgttagtattatagttccaatcatttatgacatggcttcaggtacaacccagcaggcagacattcccagacagcagaactcttctgttgctgctcccatgatggtcagcaacattctgaagaggtttgcagagatgaatccaccacgacaaggttcgatcaaggggactggatgcccaagtgattttctctaataatcgggttgggacttaactttaaggtgttttcaatgtgattttagtatttacagtaataaataaaatttatacaaagtttcagagaaa

SEQ ID NO: 715987 - DNA, 856 bp, Homo sapiens
ggatgaaggggtacccctagcgagatgtgaagtgtgggttatggttaagcgaaatgcttaccatcccccacccccaacgcaagttcttccagactaaaggaattaaggtaacgatcgaatatcgctaggcctgagaaataaccccatccttgattggagcaggcgtccctgctttgtcctgcactgaacacgagttgatgaacgtggggtgtgggcaacaagtggctttccttgcctacttatagtcacccagcgaagagccacgtgaagctgcgctagatccagcccagaccattggtgtcctgactcttccactaatgggactcctcacccttccactttcattgcaagaaggcccagttgccacagattatacaatccattacccaaaccactctgacaggtctcctccagttccaggcaatgcctacagacgatgctccctgcccgtctccatcagtgcatgctcccacatcactctagacctttcgttctggaaaccccagagagggctagggcgttgactcatctcagggaatgtagcccctgggcccctggcttaagccgacacgtcctgacctctctgttcaccctgagggctgtcttgaagcccgctacccactctgatggctcctaggaggtaccatgcttcccactctggggcctgcccctgcctagcagtctcccagctcccaacagcctggggaagctctgcacagagtgacctgagaccaggtacaggaaacctgtagctcaatcagtgtctctatactgcataagcaataagatcttataaagtcttctaggctgtaggggtggttcctaacaaaccacaggccataaacaaaaaaaacct

SEQ ID NO: 715988 - DNA, 171 bp, Homo sapiens
tcatcggctcggtacctacttttccacaggtgcattttagtcttcctcttctatttgtattcccttctctgacagtgaaaaacctggctccttttaccctccgtatctttacttattcactcaatcctagaatatgcagaaagtaatttgagaatgctaacccacaccacg

SEQ ID NO: 715989 - DNA, 375 bp, Homo sapiens
ctgcttgagaagcaggttgaacggaccttgcgtgccgccgccgatcacggaaatgcccaccgtcttgcccttgagatcggcaatcgtcttgatcgttgagtcatccatcacagcccagtagaccgaaaaaccgccgggcttctcgaagacgtgctgagccacgatgtaggccttgagattaccgccaaccacgccgttggcgagcgagagcggcgcctgcgtcgcgcaatcgagcgcaccggcagccaaagcctgcgtcatcggcgccgtgccctgaaactgggtccattcgatgttgtaggccttgccgatattgggaaattcagccgggggacgcatcatccagtacttggactcctcggccgggatggtcca

SEQ ID NO: 715990 - DNA, 162 bp, Homo sapiens
  misc_feature (112)..(112): n is a, c, g, or t
gtatccgctacacacacaggattcctaaagaacatgaagaggcctgaagatctcacctggaagctctgtaaaattatcagaaagaatagcaggtgctcctagggcaacactnactcaaacctattggtccacgcgatggacacgcattggcatcgtctgggg

SEQ ID NO: 715991 - DNA, 110 bp, Homo sapiens
actttaagttgctctaagaagtttcctatgtgagtcaccgtgcccagtcttttatatcattttaagtttattaaacattaggtagagtgttcaagtggacattattttag

SEQ ID NO: 715992 - DNA, 1116 bp, Homo sapiens
  misc_feature (427)..(427): n is a, c, g, or t
ggcgttcccctgcgctcgaggcgcgtatggttggggtcctcgctcaagccccgagactcgagctccgagcgggtctggcattctccagaggcatcatgacggaccgctcaacagctcgagtatcgatactgaaagtgcaacccagtggtccggacctaggatcgagaatatcatgtgccactagtatgcccgagtgggcaggaccatattgcactcatagcaagtccagaaactgtcgcctagcatactgtcggagcggtagtttcgcgtatatgaacatccaaactcaagatagaacatataacaatacaagtgggcatatattcattagtcatgctcagatcggaaagatccaacgtgtatgcatgatcgttaggacatcctaggctgcagtgcgtagggagcggggaactttggagacgagacnaatgaacaattctatcgcgaagatggcagtgaggatgcgccgtaactcggtgcgcgaggacaagtagatgttttcacaacctgtcgatatgccttcgtgagacggggagggtctccgggaagtgagacgaaagtatcgggcgatcagtccattccgtaggatggttccaggcgcccgaagggaaccaagcccctagaggcttgactccgaggtcaaacgggccaaactcagggcacggacaaagttcacaggggcggcatcacacgaacggggaaggctgtaaacagatgaaacacgtcctactacaatctttcagcccaagtgccccggacggggggcccttcgaatggccttcccccgtgtcacaaactgtgggtcacaaattttccacaacccggttaggccccgggcattcgcacggcttcacttggccggaagagggcccgaaggagaagtggcgcagaagtgacggcaaccaaaggtggctcagaaaagcacgattcaggcacatcatggcacggacacgggacggccccaaggaaccaggacccagggacgacagatagaagaaggagaacacggcgaaaccacgggcgcccgaaaggggacggagacggccaccacaaaccaggaaagagcacagaaaacagcccccatcccagcatcccaggtcaagcacgggacgaacc

SEQ ID NO: 715993 - DNA, 114 bp, Homo sapiens
ggaaacaaggcagaagtgatagttcaagtaagcaaggatgtgtttgagctgacagacgacagctttgataagaacgttctggacagtgaagatgtttggatggttgagttctat

SEQ ID NO: 715994 - DNA, 490 bp, Homo sapiens
ttttgcggtgccttttccagagaacaaaagaggcaggtgcagtgggtcatgcctgcaatcccagcactttgagaggctaaggcaggtagatcacttgaggtcaggagcccaagaccagcctggccaacatggtgaaaccctgtctctactaaaaatacaaaaattagcctggcgcagcagcatgtgcctgtaatcccagctactcgggaggctgaggcaggagaatcgcttgaacttgggaggcagaggttgctgtgagctgagatcacgccattgcactccagcctgggcaataagagggaaactccgtctcaaaaaaaaagaaacatagtcgtcagggaagaccttactgcagagacatgtgagtggagacctgaaggaactgacgagggaaggagtcgtgctgatatctaggaggaggaatatcccaggcagacggaagagaggcacaaagtcttcgaggaaagggcaccgccaaaggctaccgagc

SEQ ID NO: 715995 - DNA, 110 bp, Homo sapiens
ggctcggcaccttattcgtgttgcactgcaatctgccagctatcacactaaatgataatccaaactagaattaatattcttaaagtaccacaaaccagcattcaatgttc

SEQ ID NO: 715996 - DNA, 102 bp, Homo sapiens
ccttatgtttgacccacctgtatgctgccttcttgtgcgtttctcggagaagttcttatgcctgatgaaataacttggggcgttgaatgagctgtttaattt

SEQ ID NO: 715997 - DNA, 797 bp, Homo sapiens
gccaaccttgaccactgtgcctgggccggctctgggagcgcaccctccccaggggccctgctgcttccactggctgtgctctccctacgcaccctgttctgagggtgcaggtcccacaagcccgcaatggacagccagctcccctccttttgtggcccaccaccgggcagcccacactcaagggagaggtccaggcaacttccagcaggaacagaagttcgctatctgccttgcctgtatctggaatcctccatgggccagattcctggctctgctttattccctagttattgccctttggccagcaggtttctctcttgggcaggcaagacacagactgcacagattcccaaagcaccttatttttctaccaaatatattctccagaccctgcaacctccatggaacattccagatctgaccttctctcctccatcccttcccttccctctggaacactgggccccatagtcacggccagtcctcaagcccaaccctccctggggggaagaccaggtctgctcaggatgagactcccaggaagccacctccggggttggctgtctacccagggttgccaagctgggaagaacactccagccggacaggacacacacacacactccccacccaattgcagagactcgccaacccttcactgaagtggctctcctgtttggaatagcggggtggggtgggggagaagaaagaaagaaagaaaaaaaatttttaatttctctttttggtgttggttaaaagggaacacaagacatttaaataaaacatccccaaatatt

SEQ ID NO: 715998 - DNA, 540 bp, Homo sapiens
  misc_feature (283)..(283): n is a, c, g, or t
tactgctacctagtggtactgctacctagtggtactgctacctagtggtactgctacctagtggtactgctacctagtggtactgctacctagtggtactgctacctagtggggtactgctacctagtggtactgctacctagtggtactgctacctagtggtactgctacctagtgtgttcaaatgatccaacagaggaaatcttggaagtaagataatgctggctggcatcactcacttggaaaccttggcagtccagagttaagttctctcacctcaagnacccatttcacatttctaaaaatctccaggaggcagtatgtccccacggtttctgggggtcatgataaccgattttcctgaggtaataactgtgagtttcaactcaaatgcagcatcagtgtcctcactgctcgacgtgttctctctgcagtcccttccagctggctttattcaggcccacgtgtccaagcatagtctgggatagccttgtattgggaaacctggcccattctgtaaattaagggcccactaagtag

SEQ ID NO: 715999 - DNA, 297 bp, Homo sapiens
ctagaggatccccgtaagatcaacgcgaggatgagagagagggagatcagagaggacgaaagaacgacagctatagaaagagaagacagaggacgagcagatacacggagagatcgagacagactagagagacatcacaaactgggacctccaccacatctagcagtaagtgagtcgagaccatggatgcacgaaggagagagagtgagaagtctctagatcatgaaacagtctataaggaggaagattggcagtctccaacttctaagtctcgtaaatctgatcagcccctatagg

SEQ ID NO: 716000 - DNA, 230 bp, Homo sapiens
tactgctacctagtggtactgctacctagtggtactgctacctagtggtactgctacctagtggtactgctacctagtggtactgctacctagtggtactgctacctagtggggtactgctacctagtggtactgctacctagtggtactgctacctagtggtactgctacctagtgtgggtgctatagggtatatacggccctatttcaaagatttttaggataagctt

SEQ ID NO: 716001 - DNA, 269 bp, Homo sapiens
tactgctacctagtggtactgctacctagtggtactgctacctagtggtactgctacctagtggtactgctacctagtggtactgctacctagtggtactgctacctagtggggtactgctacctagtggtactgctacctagtggtactgctacctagtggtactgctacctagtgtgtactgctaggtagcaggtactgctacctagtggtactgctacctagtggtactgctagctagttggtactgctagctagtggtactgtta

SEQ ID NO: 716002 - DNA, 295 bp, Homo sapiens
cctattcatatcggttttttaccaggggtgctcatggctatacacaccctcccttcatagatcaggggtgtagacaccctctctccatcgctcagcggcttttaaaccctaaatacatcgctcaggggttttcacaccctctatccatcgctcaggggtgtggacaccctttctccatcgttcaggggtgtagacacccgcctttcatcgctctaaggagaggacaaaatttctatgtaacggggtgttgacatcctctttccatcgctcaggagcgtagacaccccctctccat

SEQ ID NO: 716003 - DNA, 210 bp, Homo sapiens
cagctgcaggctgccacctgtcatagtgggcccgcaaccagtccagcaggacctcctcggcgcgcaggcaggctccagtgctgatctggcctgggaaccgcgattaccgcaggaatggcggcgtcaatgcatttcagcacccgcgatgcgatgtacaccggtctggctggcgggcacgatccagcggttgacaagcacacgcttgaacgg

SEQ ID NO: 716004 - DNA, 349 bp, Homo sapiens
tagtatgacatgcctgagccaggatcaaactcatcaagcggcatcaagcagacatcaagcagacatcaagcagacatcaagcagacatcaagcagacatcaagcagacattaagcagacatcaagcagacatcaagcagacatcaagcagacatcaagcagacatcaagcagacatcaagcagacatcaagcagacatcaagcagacatcaagcagacatcaagcagacatcaagcagacatcaagcagacatcaagcagacatcaagcagacatcaagcagacatcaagcagacatcaggcagacatcatgcggacatcaagcagacatcaagcagacatcaagcaga

SEQ ID NO: 716005 - DNA, 343 bp, Homo sapiens
ggtagggcaacctcacgtcttccggcttgtgagcgtgaggtagatctcatagatcttccctcgggtatggcatctggggggatgaggaggctgattcctgtattagggatcatcagccgtgccccgaggaagttgaaggtcccataggtcatgttgctggtcgctcggggcagtggagctggaagtagttctagggtggagaggcgggcagagaactcctcgggctcagagggtgggagagctgtggtgcagtgtgtggcggacgccaacccaagggggctttagcaggtccccattggtgagctggaactttggggctgggcccatcctgccggggaccatg

SEQ ID NO: 716006 - DNA, 506 bp, Homo sapiens
ggggagcagactcatggaagagaagcagatcctgtgcgtggggctggtggtgctggacatcatcaatgtggtggacaaatacccagaggaagacacggatcgcaggtgcctgtcccagagatggcagcgtggaggcaacgcatccaactcctgcactgtcctttccttgcttggagcccgctgtgccttcatgggctctttggcccctggccacgttgccgacttcctggtggctgacttcaggcagaggggcgtggatgtgtctcaagtgacttggcagagccagggagataccccttgctcttgctgcatcgtcaacaactccaatggctcccgtaccattatactctacgacacgaacctgccagatgtgtctgctaaggactttgagaaggtcgatctgacccggttcaagtggatccacattgagggccggaatgcatcggaacaggtgaagatgctgcagcggatcgaggagcacaatgccaagcagcctctgccacaga

SEQ ID NO: 716007 - DNA, 293 bp, Homo sapiens
  misc_feature (119)..(119): n is a, c, g, or t
  misc_feature (136)..(136): n is a, c, g, or t
  misc_feature (145)..(145): n is a, c, g, or t
  misc_feature (165)..(165): n is a, c, g, or t
  misc_feature (170)..(170): n is a, c, g, or t
  misc_feature (226)..(226): n is a, c, g, or t
  misc_feature (283)..(283): n is a, c, g, or t
ctagggggagaaaaaggaagaaaggaagaaaaaaaaaagaagaagagtggacaacgaggcggggggaggaggggggaggtgagtggggtggggagactgaaggggggtatggggttggnggtgtggggcggtgtgnggtggaggngctaagaagcctagagaagnctgtnagccaaggaggcagggtcttcctttggcatgggatggggataaagtaaggacaggncctggaccccctgaaagctgattcactatggggggaggtgtattaaagtcctccagncaaccctcag

SEQ ID NO: 716008 - DNA, 879 bp, Homo sapiens
  misc_feature (780)..(780): n is a, c, g, or t
  misc_feature (783)..(783): n is a, c, g, or t
  misc_feature (785)..(785): n is a, c, g, or t
  misc_feature (791)..(791): n is a, c, g, or t
  misc_feature (803)..(804): n is a, c, g, or t
  misc_feature (811)..(811): n is a, c, g, or t
  misc_feature (832)..(832): n is a, c, g, or t
  misc_feature (868)..(868): n is a, c, g, or t
atggaaggagcaggctccatgcatgcatttgggctctgtggaaaatctggccagggatgcgggcctttctgaacgccgctttcattgtgccccctgcagcattatctcttcaatgcgatgtccctgctgactgaaatgcagagaagctactaagatccacacaccagttgctgcaatcggtgccctgctgtttgtcccccattcaccccaggtgattcagctcttctggcactcccagtgattcctgtgggacaggcccatagtggacttcccacgaagattcccagactgggggagagctctaagatccacttccaattcctttgtctcacctaggagactctgggtttatggaagttctctctgattagtgctgttgcagctgggtttgggggtcatgtagtctaaatgattgtttctcttactggtggtgatttttccagtttctgtgggcccagtggatttctctgcttctccttagagttctggtgaactcagaatgttagtgttattcttttctttgaaaatagtttccatttgtaatttgcttggagagtgattctgggggattctattctgccatcttgctgctgtcactctttaataagatttgtaactaattctcaaattgttcatagtcttaaaactacatagagttgatttcatacattttattatgagaacaataaaagtattttgtgtctttgctagtgagatttttagttatacagaaattacagtgtttcctgctatgatcaatcattccagattcatttactntgntnaaatgntatcatttggtnncatatgnatatttattttttttctgaanaccccaagcatatctcctactatccggataatatanattagtagttc

SEQ ID NO: 716009 - DNA, 506 bp, Homo sapiens
  misc_feature (53)..(53): n is a, c, g, or t
tggcaatcaactcattcctcccaatgcacaagtgaagaaggccactgtttttntcaatcctgcagcttgcaaaggaaaagccaggactctatttgaaaaaaatgctgccccgattttacatttatctggcatggatgtgactattgttaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccacatattcttatgccaaattgccattttaagggggccagtcccttcattgttcacggtcagggtaaaaggccacccttttttcaatcccgccttggtgggctttagagtcgtcgctaaagacgacgctggctttg

SEQ ID NO: 716010 - DNA, 582 bp, Homo sapiens
  misc_feature (53)..(53): n is a, c, g, or t
tggcaatcaactcattcctcccaatgcacaagtgaagaaggccactgtttttntcaatcctgcagcttgcaaaggaaaagccaggactctatttgaaaaaaatgctgccccgattttacatttatctggcatggatgtgactattgttaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccagtaggcattatgtaaacaaagctctgctctttcaagaagataggagtcctgaatttgagctttgacagtgattaataacatcattttgagcaaatagttgtcaagaagacccaaataaatggagagatagctgagagatcagttgcctgatggttaacgtaagctttgtgacacattggaggaagtcaataaataaatatttgttgcatg

SEQ ID NO: 716011 - DNA, 236 bp, Homo sapiens
  misc_feature (103)..(104): n is a, c, g, or t
caggtgcacccccccgggcctagggaattgcgggtatactcactgctattagaattgagtccggctgcttttagaagctgctcagtcccaaaagggtccgctnnggaagttaatgcggttcgacgagatgggggtttgcggcagtccgtaatacgcaacacggcgaggcatgcggtgagactcgcgcatcaatcgcaatcgaatctacgctatatctaatgcgctattctaatgca

SEQ ID NO: 716012 - DNA, 420 bp, Homo sapiens
ttagcgcagcctatataccagccatcttcagcacaccctgatgaacggctacaaagtaagcgcaagtacccacgtaaagacgttaggtcaaggtagtaacccatgaggtggcaagaaatgggtctacattattctgccccagaggacacctctacgggccctctcagccctcctaatagacctccggcctagccatagtgatttcacttccactccataaacgctcctcatactaggcctactaaccaacacactatccatataaccaatgatggcgcgatgtaacacgagaaagcacataccaaggccaccacacaccacctagtccaaaaaggccttcgatacggaataatcctatttattacctcataagtttttacttcgcaggatttatctgagccttttaccactccaacctag

SEQ ID NO: 716013 - DNA, 114 bp, Homo sapiens
cctgctattacagtattattctattatataaagttaagggactactgcctctgataacctgataaaaaaaaaaacaatttatcgatactacaaaatataaaatttcttacagtc

SEQ ID NO: 716014 - DNA, 236 bp, Homo sapiens
  misc_feature (70)..(71): n is a, c, g, or t
gcttggaccagcattatactgtggacatgacagaaactgagcactctatccagcacccagtcaccaaganntgccacggggcggcattcggtccattgcagggcctaccaggcccaattccttggttgaccccaggttcttgggaaccacttcctttggcccttttgcccttaaatttggaaccttaccggaaaccattcttggccttcattggttggcaagaaaaccaaaacggg

SEQ ID NO: 716015 - DNA, 796 bp, Homo sapiens
cccctgggaaggccagagacttgccagtgtcccatctagcgggctcttcgcaagaatccccccgggcccgtcgcagccaggcggagagccggcagagggcgctgctcgaggacaatggcggaggacgcggagcggtgggacctgagttcgagtcttgcggtatactgcggtcttcggtgcacggagcttgtggactccggagcgcgggcggccacggtgcagcaggcaccacacgttccgcctgacgagagtcgggggcgtcgagcatactgtccgctgtgattgcgcgagctgtgagctaacaccgcatttcgtagaccccgtgcgagtgccgctttgcgaggctgtcctgtggtcttcaatggcccaaagaccggtgggccgcggcccggggggaccggacggggaacaacgactagacaacagggaaccggcgatgagtgcactcgtgcatggggctcctcgcagggtgctggcgtcggccgtggccgggcgccgtgagcggctgttgactagccagggtctggagcggcacggaatcaggcgcgtgcgtaggggagccagttgtggggcccagaatagtggtagcccagaggccgaaggggaagacgatccggccgggtgagagcccagggctgggaggctaacgcccgtgctgtcctgccgcctgtgcctacgtgagcccggagggcgcccattctaccggcctctggctccggagctgccggccacgccagctggagctgggcgccgagccaacgcgttgctgcgtggacgctgctgggcagtgttctct

SEQ ID NO: 716016 - DNA, 147 bp, Homo sapiens
ttaggtgcatgcatgtgaaagggaagaggcgctggtggttgtgctttgggcctgagcagcagaagcctgttgcatcacctatgacaagggagacagcgcctgggtgagagcccaggtatggggtgcattcaggggtagactcaggag

SEQ ID NO: 716017 - DNA, 411 bp, Homo sapiens
gtgctttatttaaaaaaggggccaaagttcctggctttcgtttgctttgtcaaaaaggaaagctttgaaaaaaaaggggtaattgcctataattttccttgcttccggagggccattcatgaagtttttgaggggagaatgaaagtagtaaaatctcgaaaggttcagaatcggctgcaaaaaaaaaaaagagccccccctaatgggccccccaaagtgctgctgtaggtggggtttcaggaatgttttttgaaatcagcccttatccatgggggtgggggcccctgttgccctaaaggaaaaggaaaaaggggattgggccccaaccccttgttttgttgttaaaaaaaaaaaattcccgccccccttttgttttttttttttataaataaagtaagccctttgaagcca

SEQ ID NO: 716018 - DNA, 198 bp, Homo sapiens
catcgatccacataaattaccgattttgtcagctactcggaaaaaaagcgtacccgcggggaacgctttctcgacaagatcaagccgcgttctgctgccatgcgtaccacggtactggtggtttttgtggtctgttttagcctgttcatgtccttgtggttcttttggcgtaccctgtttttacctgaaatccagcaa

SEQ ID NO: 716019 - DNA, 292 bp, Homo sapiens
gctccccaacaagataggacaaacattcttgaactaatgaaaagacagaatgtctcagcaaagaaacagaggatataaagaagaatcaaatgaaaattttagaactggaaaatataacaaccagaacataaaaactcacttgatgagttcaacagcagaacagaaatgacaggggaaagagtcaatgaatttgaagtcagatcaacagaggtatcaaatgtgaacactgaatttcaacactaaaggaaaaaaacttctcctgtttttttgttttttgtttttttttttggag

SEQ ID NO: 716020 - DNA, 388 bp, Homo sapiens
  misc_feature (5)..(5): n is a, c, g, or t
  misc_feature (54)..(54): n is a, c, g, or t
  misc_feature (90)..(90): n is a, c, g, or t
  misc_feature (112)..(112): n is a, c, g, or t
  misc_feature (267)..(267): n is a, c, g, or t
  misc_feature (345)..(345): n is a, c, g, or t
gaaangcgaagaaggaagctcctgcccctcctaaagctgaaaccaaagcgaagnctttaaaggccaagaaggcagtgttgaaaggtgtcncagccacaaaaagaagaagatncgcacgtcaccaccttccggcggccgaagacactgcgactccggagacagccaaatatcctcggaagagccgctcccaggagaaacaagcttgaccactatgctatcatcaagtttccgcctgaccactgagtctgccatgaagaagatagaagncaacaacacacttgtgttcattgtggatgttaaaagccaacaagcaccagattaaacaggctgtgaagaaactgtatnacattgatgtggccaaggtcaacaccctgattcgggctgatgg

SEQ ID NO: 716021 - DNA, 437 bp, Homo sapiens
ctctcgagggtaaaaggacttgctgcctgcactgtgccatggctatggggggaaatttggggcggaacatgaccgaatggataagtcagctgtcgtccacgaatagcagtcgaaactttccaagcactgctcgcaggtggactcggtccgtggcttcggaggcaagtttggtgtccagatggacagagttgatcagtctgctggaggctttgaataccaggggaagactgagaagcatgccccccagaaagactactccagtggttttggcggcaagtatggcgtgcaggccgaccgagtagacatgagcgcggtgggcttcgactaccagggcaagacggagaagcacgagtcacagagagattactccaaaggtttcggcgagaaatacggtatcgacaaggacaaagtggataagagcgccgttggctttgagt

SEQ ID NO: 716022 - DNA, 202 bp, Homo sapiens
attccttccacgacagaaaaacatacaagacttccttcagccaacatgatggtactgaaagtaggaggaactggtcactggaaagaagaatggcaatggggaggcaggggaattcttcctgaggatttcagagatggagagtataaggctgctgttactttagagaggcaggaggatctaagacacttctagcccaccctgt

SEQ ID NO: 716023 - DNA, 420 bp, Homo sapiens
  misc_feature (115)..(115): n is a, c, g, or t
  misc_feature (219)..(219): n is a, c, g, or t
gagcgttatatagtgagaatcataatatggatcaaccattccctttctacttgttggtgtatagatcagttaaataaaagtcaactactggataatgttgtttacctgagcctgnctggaacattttccacatcctcacagactatgtttgtgtcatttgtttgactaaaaatacttagtttccctggggttcccatgtgacagtacgccagtgttggnctaagctaaactcactttctcaataggactgatggacgccgctggtcgttggcttctctcccttcctctggctatgggacaaacacacccagctctacggtctctgtaagtgcctgactttttttttttttcttttcctcaaaaaaaaggagttttaaaacgggcggtgtttcctctggggtggtccctgggtagggagga

SEQ ID NO: 716024 - DNA, 224 bp, Homo sapiens
tgaacttatgtaaagtctgatttactgagcatgagaagaacacataattgactattcctgtacctgctccatttctcctgcaacatgtggatacagtaatatgatcataccctcccttgttcccctctaggccactttcccctttaaatattaacaccatcataatcatctttggagaaagacacctggatctgtcctgaaccttggcaaaaaataaataaata

SEQ ID NO: 716025 - DNA, 931 bp, Homo sapiens
  misc_feature (374)..(374): n is a, c, g, or t
ggcgcgtttcccgtgatcagttcccggcgtcggtggatgatgggacgtgaaagaaatcgccatctcgtgtcgacgtgttggccggagactggatccctgcgctgcctggctggcgtccgtgggccgttctggaggctccctccgcgcggctgcacgagtggctgtgccgttgccccgtcctggggctcggaggctggctgatgtgcctcgcgtggcgcgtggggtagtcgtatggcgtatcgtgcaagacgcggtgccgtcgtgcgccgcgctgactagggtgtgggtccccggtgggtctgtgcgcgtgggtggtagcaaacaatgctcctgtcctaacggaggagtgctaagagtgcttacagcgcaccgcntgcccactcacgcatgaagactcaagggccgcagcagaagtaaagatttgggcctgcatgactactgtttgtattgcaggtttaccctttgtctttgactaacattcagagtaagtcgctcaagcataggatccaaggtacacagagaaccacatttcccttgagtcctttggaaggaactacgccagacattgagaggaaagaaaacgaagatccattccgagcgagaccattgtgtagggagatggcaccgcccaccgtgaggggatatacacatttgagagagcttaccctttaggattgggattggacaaggattattttcccttcgagtggaaacccctgttgtattagctttagagcggtcccgggtacggccgcctttgaaccgaaggaaacaagaggaagcaaagagggcgcccattagacgacaacggctaacttttcgacgtgtcacggaaagggtgccctaaaagggaacccttttcgcaaatgtagaacattacataaagattgccaattgacaaagacccgagaacaaccacaatggacacacc

SEQ ID NO: 716026 - DNA, 169 bp, Homo sapiens
ggaccccgggttaagccttttgggtttcctttgggccttttccccacaaaatcaaaatttaatttaaccccctttcccccttccccaagggttcccttttttttttttgggaatttttccaatgaaaataaaaaatcagctgggggggataaaatttagttgggtccca

SEQ ID NO: 716027 - DNA, 451 bp, Homo sapiens
tatggccccctatggcgcacattttgtacgaacacaacaattttaagcctctgtaatttttggccctgctctaacaaccggcgtaaatttaataaggttcggttttgccagtccccaaaagagttttttaaaaaaaaataccacccttttttgttttttcccccaactttagcaaaggagaatcttgacccctttatttttggggttttttaaaaaccccaagggatataaaccccctttcaagttgttccacgattttgttcccccagagggtctttcatcaaaaaccttattttacccatcaaattttttgtccccaggccgaaaagtaggtatttaaacagctcaatttcggttctataaaaaccgcaaacccaatttgtgtcctgggccaaagttacttaaaataaataaaccggttttttggtttgtaaaaaaaaaaaatttgtcc

SEQ ID NO: 716028 - DNA, 265 bp, Homo sapiens
gctgaccctaaggaaatagactgcagcaccaatgggccaactttggggcgatcatcttgcccagaaacatcatgttgaaactcttggtcagaggttggatgaaagctgacagggtccatccaggagcaagtttgagccttgccagttcattttgggtgctgagtgagtgcgactatagcaacctgtgatctctggctgctgctcagaagaacaggagggaaggatgagtatgttaactctgggtcaatattctgatctgggctct

SEQ ID NO: 716029 - DNA, 585 bp, Homo sapiens
gctgctgagctcctcacctggacagtctcctggacgaggagtttccagctgctggctggagtctcaggaccctggagggcactggactaagagtctagtggttccaggacccctgaccaggtaggtgactcaactaaatgtttgttgttgaatgaaaacaatagaaagaaacatgaaagaaagcccaggcgggcatctatctggcggggtggcgagggaacgggggtacctgaaggggcccatggtgtccttgaggggattcccctgaagccaatgtttctctgtgcgatccatagtgtgggccagatcctggcgcgcgggatctgctcggatataaggggagaagccggccactaattctcgtcagagtatcgccaggaggtgtagccctcggtggtctacggagaaccccgggggagaaatagccagccggagccggtatcggccaggcaagcggattaggacgacttgtacttcccaccccattttgggggacttggctggcgggcaactgctccgcggctgcgacatacatatagtgatccttggttttgcggacaataaatgataaacggaccatagaat

SEQ ID NO: 716030 - DNA, 1366 bp, Homo sapiens
tttttttttttttttgctttgtacttgagtttatttcacaaaaccacggagaaagatactgaaatggagctctttccagcctccaagcaaggaggccccagcagccagtctccagccccttgagccctttttgttaggcccacacccaaaagaggagaaccagtgtgtgcgcgaaggtacatggcaaggcacttttgaaaacatcccagtttaccgtggtgaaattgaacttactctgaaacagatgaaaagggacatgcaaatttgctgagcacatggaggtgtttgttagtaggtgaaaatcatgtcctgggtataacccagcttctccaggttagggtgagccgccgtctggatcagtggtggcgggccacacaccaggatgagcgtggacttcgctggaggaggaaggtgctccttgatcatgtcggcagtaacgaagcctgagctgtacttccagccaatgggaggcctgtccagggtgtaccacaggtcgaactggtctgggtgagtcctggcaatttcttcaagctcttttctgaccaagatatcctcctctgtctggttggcaaagatgagggacatcctggtcctgtcactggggtccttggtgatgtggcgaatgagctgcaacatgggtgtgatgcctgtgcccccagcaatcattcccaggtgatcggccagtgtttttttaggctcactcgtctggtctggtctgattccaagattccctggcccatggtaaaacaagcgtccccttggccctcgaaaaaagatggtctccccgattttcatgttctccaaatactgagtcatcttcccaccttcaggatattgggggtgtacatttttgaagtagatctttataattaggtccacaaagcctctgtcatcatcactggagacaggggtgtaagccctgaccaccaattcattatcgatttttgccaagagctggacatagttacctacaggaagccctaagacatggtccggcgaaggcagtccaaagcggaacctccgggtgttgtggctgattttctctttctcaatcaagggcagcgggtacttggcttcagggtcctgtaaggtgattggctctctcctcctggagttcatgctcttcaggaccaacacgagcacagtgaccccagtgacggtgatggtcaggagcagggacgggtccctacaaggccgccctgctcctctcccaactcaagcccgacagggaaagttgcctctcctcccgccgggtcactggagtctcagccttccggaatccgagccggcccgccccgctccccgcccttcgcggtcccgcccacgacctctccccacgcctcccgctccggcccccacctccgct

SEQ ID NO: 716031 - DNA, 169 bp, Homo sapiens
ttcacagatcagtctgcgatgatcatagtcagagaacagatgatagattaagaaatggtttttcttgaattcgagaagcatagatctgttctccatattggtatgttctccctcaaccaagatcttctaaaaagaaataatattttagtcttctgcttgaggaactgac

SEQ ID NO: 716032 - DNA, 1479 bp, Homo sapiens
tttttttttttttttgctttgtacttgagtttatttcacaaaaccacggagaaagatactgaaatggagctctttccagcctccaagcaaggaggccccagcagccagtctccagccccttgagccctttttgttaggcccacacccaaaagaggagaaccagtgtgtgcgcgaaggtacatggcaaggcacttttgaaaacatcccagtttaccgtggtgaaattgaacttactctgaaacagatgaaaagggacatgcaaatttgctgagcacatggaggtgtttgttagtaggtgaaaatcatgtcctgggtataacccagcttctccaggttagggtgagccgccgtctggatcagtggtggcgggccacacaccaggatgagcgtggacttcgctggaggaggaaggtgctccttgatcatgtcggcagtaacgaagcctgagctgtacttccagccgaggtgtgtgaatcagtacagccagctggagttgtccggcagggtgtggcctggtgttagtggaactgcgcagaattgctcagtagggtagcgccctctgccgaccagggaccaatgggaggcctgtccagggtgtaccacaggtcgaactggtctgggtgagtcctggcaatttcttcaagctcttttctgaccaagatatcctcctctgtctggttggcaaagatgagggacatcctggtcctgtcactggggtccttggtgatgtggcgaatgagctgcaacatgggtgtgatgcctgtgcccccagcaatcattcccaggtgatcggccagtgtttttttaggctcactcgtctggtctggtctgattccaagattccctggcccatggtaaaacaagcgtccccttggccctcgaaaaaagatggtctccccgattttcatgttctccaaatactgagtcatcttcccaccttcaggatattgggggtgtacatttttgaagtagatctttataattaggtccacaaagcctctgtcatcatcactggagacaggggtgtaagccctgaccaccaattcattatcgatttttgccaagagctggacatagttacctacaggaagccctaagacatggtccggcgaaggcagtccaaagcggaacctccgggtgttgtggctgattttctctttctcaatcaagggcagcgggtacttggcttcagggtcctgtaaggtgattggctctctcctcctggagttcatgctcttcaggaccaacacgagcacagtgaccccagtgacggtgatggtcaggagcagggacgggtccctacaaggccgccctgctcctctcccaactcaagcccgacagggaaagttgcctctcctcccgccgggtcactggagtctcagccttccggaatccgagccggcccgccccgctccccgcccttcgcggtcccgcccacgacctctccccacgcctcccgctccggcccccacctccgct

SEQ ID NO: 716033 - DNA, 205 bp, Homo sapiens
acgacacactaaacataaacatctctattatcaaaagcctagacagtcatttctgcagctgtatggcaacttctacctatgatcgcgatataaacggtaccgatacacgacttcgtcttcgtatacagaggaatatgtcgtgaagaacctgtgtagcttacttacaacaatggttttggcctttactccactgggtaccgagctc

SEQ ID NO: 716034 - DNA, 110 bp, Homo sapiens
ccaccggcgattgaagcccagacctgcagggttcgtggataataaactcaagcagcgagtcatccagtaccttaccagtaacaaatgttggcaaatatgttggacattgg

SEQ ID NO: 716035 - DNA, 2492 bp, Homo sapiens
atcctaccactgcaagctcagcaggaactgacctggttggcaaagatgagggacatcctggtcctgtcactggggtccttggtgatgtggcgaatgagctgcaacatgggtgtgatgcctggaacacagtgagcgagcagccagctttctccctgtctctgaagcccacagtccctgacctgcagcaagcttcataccttcccccagcccaagttatccttttctcacttctgtccccaaaactcaaagcaggaaacagcccttcattttggttttcctttctaatgcaacagtaagtcaggtagtctttctcattttcatatggcaagatggaaagaacactctaagttcttcagtgtcctcattcatcaaacaatgacgggtaaatgtgatcgttttaagaatgcctattacagtgcctggcacattgtatgtctccttcaaagactgctctctttcttcaggcagtcattttcaagggatggggagagtcaggcttgaactggatctaggagcccctgggacagcatgggtgggcctgcccagcttgcccccaagcctgacctgaaaggtccccataaggctcctgagcagccaccatattggttaggggaagcagggtacacagggtcagtttcaagacctgtcactggttcatcgttcccaccttctacagctggaggcgaaatctctcatgttgtcccttcgaggatcaaatgactcccaagtcagaatgggtctcggggctcactctctggatggagcccctagaagcctcttacctgtgcccccagcaatcattcccaggtgatcggccagtgtttttttaggctcactcgtctggtctggtctgattccaagattccctggaaacacagagaatgcttatgacctctgcagttcttgcctaaagagactgcaaaagatcactgacattccttaggactcccaggaggcacgtccagctaagggactgtctgcaccattttaagctggagaagcaggccagggcagtctcctcagctagccctggtgctccagtgcacaaagtgggaatagagcctgggcttggtcggggaatcgccgggccttctgttctgaggaaaaagaggggcaagttgaagttaacacagagactcaaagagcattctcactcacggaggtgaaccagtgagtaaacaatggctatgtgagtaaccaaggagcatggactccctccatccatttttcagtattagcaggcaccatttatgtatcaggcattgtgctggagattttgatacaatgacgaggaaacaccaagtcattcccctaccttacaaaagctgacaacctcatgaagtgggtgtgtgaatgtgtaacaagtgtgatcattatgcattgtgtgtgaatgaatgaagactaagaacaaccccatgtgactcaaatctgaggagtgtacgagaacaatggaaccattgcaggaatcttcctcccagctgggagcccaagtattaacccctccagtacctggcccatggtaaaacaagcgtccccttggccctcgaaaaaagatggtctccccgattttcatgttctccaaatactgagtcatcttcccaccttcaggatattgggggtgtacatttttgaagtagatctgaaaagcaaggcagcactgctttcacattcccagacacaatgccacagccacgtacaactagaaaatgcatttactgctggaagctttgcagagaaagtgttctcctctctgaattgctgtacgcaatccctgaagatgaagctgccacaaggttaactgtagcttcactgctggaaagccctgcctagggcatatgtgccctcagagaaaaagcactgcccctccaccccaccaccctcagtaggcttggaagcacgagctagccagatatggtgggcactatttacctttataattaggtccacaaagcctctgtcatcatcactggagacaggggtgtaagccctgaccaccaattcattatcgatttttgccaagagctggacatagttacctatagaaaaggcatcaagcactgagtcaaagcatatttagcttaaataaggcccaggaataaaggactgagcttcagtgaagggagcaaatactgggggcacaacgttaagaggggtgggaagaagagagcagggaaggagcccaaatatgggatgcccggatcctaggcctgccctgcctccctgtgctaccctaggcaagtcacttcacctctctgggttttggtctcttcatctgtaaaatgggggtgatatgtctgcccacctgtgatcttagtgtaactgctttttggagcaggaaaagatcattaaagttggagagtgagtattaaaaattacagaaaggggtcagacatggtagctcacgcctgtaatcccagcccagaggcgggtggattgcttgagctcaggagttcgagaccagcctgggcaagatggcgaaaccccatctctac

SEQ ID NO: 716036 - DNA, 695 bp, Homo sapiens
tttttttttttttttgctttgtacttgagtttatttcacaaaaccacggagaaagatactgaaatggagctctttccagcctccaagcaaggaggccccagcagccagtctccagccccttgagccctttttgttaggcccacacccaaaagaggagaaccagtgtgtgcgcgaaggtacatggcaaggcacttttgaaaacatcccagtttaccgtggtgaaattgaacttactctgaaacagatgaaaagggacatgcaaatttgctgagcacatggaggtgtttgttagtaggtgaaaatcatgtcctgggtataacccagcttctccaggttagggtgagccgccgtctggatcagtggtggcgggccacacaccaggatgagcgtggacttcgctggaggaggaaggtgctccttgatcatgtcggcagtaacgaagcctgagctgtacttccagccaatgggaggcctgtccagggtgtaccacaggtcgaactggtctgggtgagtcctggcaatttcttcaagctcttttctgaccaagatatcctcctctgtctagaaaagaagcaacactgaaaaagctcctccagggccatcctcttgttccctggactgactacaccggtcagcatactcctggccaaagctgccaccactccagctggagtgctcgctgccaactcccacgg

SEQ ID NO: 716037 - DNA, 1174 bp, Homo sapiens
tcggagggccttttcccgggagtaagttgtttctacaaccagagaacttccccggttttctgtgggatggtctctcccccacatttgtccccgagttcttttttggtgtggttggtctcccccttagagcggtcgttttccacgcgttcatataggagaaaccacccacgggcctcgggttaaaaaatgttcttcctccgttcaccgaatttcccgcgcccaaagggtccaactgttgccccacttcactcgtgtccgggacccacgtgttcttttctttggggaatacccacgggagctgtggttttttaccccacaggggtaattcccgccccccgcgccattgtttacccctttgggtcctcgctgtgcggtatttcctccggtgttcggggattcccgcctggcccccccagaccccccgggggcctaatttgaaacgccccgggttaccccccggggtacccccctggagagccttgtgaaaatgtggggctccacgtgttttccttgagggtgttgtctttgacctttttgtgcccccccattttcggttttctgggaccctccggatgttctgccccacctttccaccacacccttttgtggaggtttcttgggccggtgtggtgttttatacctggaggttgcgctgtgagagccacagagcacccaggttattttttctccactgggctatttggaagaacacacaaggtgggcctgtataattataatgccgggggtgatataagggagaatattttcttgagtaaaccctggagacgcccacgccacaagagttaccacacaggttttgagagagaatgccttgtctttgtgtcttcacatgttctgtgtcaagccagcgcacccacaagccccttgttgtgggcaccttattcacggggccgtgagtgtggaaaaagagattctcaagaactcacatatcaagaagtcccacacaagctgaaagagattgtgacaccaatatttttggctgggatattgaagctttaaactcctcgtgggatatccacacatccaaataacccagtgtccagtgtttgtccattggtttttagtaaatattagtgtcccatttgtaaaagggttactttcatactccttatgtacagaaatcacatgaaaaataaaggctccataaagcata

SEQ ID NO: 716038 - DNA, 682 bp, Homo sapiens
  misc_feature (569)..(569): n is a, c, g, or t
  misc_feature (584)..(584): n is a, c, g, or t
  misc_feature (594)..(594): n is a, c, g, or t
  misc_feature (597)..(597): n is a, c, g, or t
  misc_feature (615)..(615): n is a, c, g, or t
  misc_feature (636)..(636): n is a, c, g, or t
  misc_feature (638)..(638): n is a, c, g, or t
  misc_feature (646)..(646): n is a, c, g, or t
  misc_feature (657)..(657): n is a, c, g, or t
tttttttttttttttgctttgtacttgagtttatttcacaaaaccacggagaaagatactgaaatggagctctttccagcctccaagcaaggaggccccagcagccagtctccagccccttgagccctttttgttaggcccacacccaaaagaggagaaccagtgtgtgcgcgaaggtacatggcaaggcacttttgaaaacatcccagtttaccgtggtgaaattgaacttactctgaaacagatgaaaagggacatgcaaatttgctgagcacatggaggtgtttgttagtaggtgaaaatcatgtcctgggtataacccagcttctccaggttagggtgagccgccgtctggatcagtggtggcgggccacacaccaggatgagcgtggacttcgctggaggaggaaggtgctccttgatcatgtcggcagtaacgaagcctgagctgtacttccagcctgaaatgaaggagatgcaggagcaagctgagggatgccaggtggagttcctgatcccaggccgcctgcacacccaccctcagccagggaggaggtgacaagctgctnttacaaaggcttagnaagtctgtantantgcaccctgcaaaaagcntcagaattagttaaacagccntntgcagcantcaccccaggncccaggttcattgcagggaccttga

SEQ ID NO: 716039 - DNA, 2503 bp, Homo sapiens
gatagatttgagaccctggaacctgaagtatctcatgaagaaaccgagcatagttaccacgtggaagagacagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaattaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagcaaaagtaagttttgctggatttttgtagaactctggacgttgaggattcattatgctgtggttaactttaaatatttttgaattccaaatatctgaattaatgagccttgtctttacaaatatgtgccattgtgcaacatcggtggattttctaaaaataatgtaaatgtcttctattaaatgttgagtgcaataaaatacagaagaattctcaaaaaaaaaaaaaaacaataaacagaaaaaaaaaaaataataacaaaaacaagaaaaaaagaaaggggggggggggcgcgcagaaaaattttccccagggggcgccccacgttacgggctacccgcatttttctgcacaaggggggcccaatatgagggggggacaataaaataaaacaacatagggcggcgggggcgcgacttttaaacaacaaccgctgtgtcatgggggagacaacacaggtatgatgcggggaactttttggagagaggaccccctaccgctgtgggggggcgaaatatatggggacaacacttccctcgaagtaattttataaggccctcgaggggaaactaaacaaccttgaggggttttttgggtgtaacacacgcgatattttgcgcgagaaaaatttgggccagggatattttattaaaaagttatagggatatttataaatt

SEQ ID NO: 716040 - DNA, 2461 bp, Homo sapiens
gatagatttgagaccctggaacctgaagtatctcatgaagaaaccgagcatagttaccacgtggaagagacagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacatttttgaaattttgtagcttttagctgattatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagcaaaagtaagttttgctggatttttgtagaactctggacgttgaggattcattatgctgtggttaactttaaatatttttgaattccaaatatctgaattaatgagccttgtctttacaaatatgtgccattgtgcaacatcggtggattttctaaaaataatgtaaatgtcttctattaaatgttgagtgcaataaaatacagaagaattctcaaaaaaaaaaaaaaacaataaacagaaaaaaaaaaaataataacaaaaacaagaaaaaaagaaaggggggggggggcgcgcagaaaaattttccccagggggcgccccacgttacgggctacccgcatttttctgcacaaggggggcccaatatgagggggggacaataaaataaaacaacatagggcggcgggggcgcgacttttaaacaacaaccgctgtgtcatgggggagacaacacaggtatgatgcggggaactttttggagagaggaccccctaccgctgtgggggggcgaaatatatggggacaacacttccctcgaagtaattttataaggccctcgaggggaaactaaacaaccttgaggggttttttgggtgtaacacacgcgatattttgcgcgagaaaaatttgggccagggatattttattaaaaagttatagggatatttataaatt

SEQ ID NO: 716041 - DNA, 844 bp, Homo sapiens
catcacaaaaattcttctcttggccaagtatctcatttccctatatagtatacaagcaccatttcttctcaatttgtaagaagagaaattagtccattaccacaggggttcttgtcactactaattatacaacaagtcttttcccaacaagacaagatgtcctccacaaccttgttttcaaagcagacgagcatctatgtgggccaagagtatactttgcggttgttcttgaggatactggtcttgggctgatgactatggtgggcagacatggatccatagggctccttctgctaaacagcacacatttgaagatggtttaaaagcgacgtcagatcaggtgatctgtactaattgtatttatctgtacatgtatgggcttgtgattcccaccaaggaaatgagagaaagttatctgtttgagtataaaaccaaatttcagctttttcaaaatatcttccaacttatgtattggttgtcactcaatgtgcctatatatatatatatctgtgtgtgtgtgtgtgtgtcgcgcgtgagcgcaggtgtatgtatgccgtgcgcatggtgtgtgtagtagtgtatttatcagaccagttgcgtgtctaacgtgccgagactatgaaagagggacgcaaaccttctactgcgccatactgtggcgttctacaacgtggtggctcacattctcagacctatagtgattactccatgtagtttagcaagaaggagttcctataaatatcctatgtggcgagtatttaccctttggagggggtggcgggacaacgtgttgaactattcgtgggacacagcagattggtgacaccccgggtgctaggaggta

SEQ ID NO: 716042 - DNA, 2292 bp, Homo sapiens
  misc_feature (2027)..(2027): n is a, c, g, or t
  misc_feature (2029)..(2029): n is a, c, g, or t
gatagatttgagaccctggaacctgaagtatctcatgaagaaaccgagcatagttaccacgtggaagagacagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaattaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagcaaaagtaagttttgctggatttttgtagaactctggacgttgaggattcattatgctgtggttaactttaaatatttttgaattccaaatatctgaattaatgagccttgtctttacaaatatgtgccattgtgcaacatcggtggattttctaaaaataatgtaaatgtcttctattaaatgttgagtgcaataaaananagaaaaaaaaaaaaaaaactgtgtgtcgggccgcgcctggaggacccacagaaaaagtttcaaaaacccgagcggttgggggcggcggggcaccagtgaggtaggcgaacgggcgcaacacgcggcccacaaggaaaccgcgcagagaactaagtgcgtgatctcccacaattaaaagcggcggggcacggggttctgacacaatcaggagggtcgaagccatacggctctacaggatcaaggagcaatatatagcgaaggga

SEQ ID NO: 716043 - DNA, 215 bp, Homo sapiens
gttgttgtatgtatagtaagatgttgagacaggttctcccagagctgctcaggctggtctcaaactccaggcctcaagccatcctccgaccctggcctcccaaagtgctgggattacaggcgtgagccaccgtgcctggctgaaacacaagaatttaagagaattcttgttatctgaaaagaaagatgatgtctcatacgcccaggtgagcaggc

SEQ ID NO: 716044 - DNA, 1532 bp, Homo sapiens
tttttttttttttttgctttgtacttgagtttatttcacaaaaccacggagaaagatactgaaatggagctctttccagcctccaagcaaggaggccccagcagccagtctccagccccttgagccctttttgttaggcccacacccaaaagaggagaaccagtgtgtgcgcgaaggtacatggcaaggcacttttgaaaacatcccagtttaccgtggtgaaattgaacttactctgaaacagatgaaaagggacatgcaaatttgctgagcacatggaggtgtttgttagtaggtgaaaatcatgtcctgggtataacccagcttctccaggttagggtgagccgccgtctggatcagtggtggcgggccacacaccaggatgagcgtggacttcgctggaggaggaaggtgctccttgatcatgtcggcagtaacgaagcctgagctgtacttccagccaatgggaggcctgtccagggtgtaccacaggtcgaactggtctgggtgagtcctggcaatttcttcaagctcttttctgaccaagatatcctcctctgtctggttggcaaagatgagggacatcctggtcctgtcactggggtccttggtgatgtggcgaatgagctgcaacatgggtgtgatgcctgtgcccccagcaatcattcccaggtgatcggccagtgtttttttaggctcactcgtctggtctggtctgattccaagattccctggcccatggtaaaacaagcgtccccttggccctcgaaaaaagatggtctccccgattttcatgttctccaaatactgagtcatcttcccaccttcaggatattgggggtgtacatttttgaagtagatctttataattaggtccacaaagcctctgtcatcatcactggagacaggggtgtaagccctgaccaccaattcattatcgatttttgccaagagctggacatagttacctacaggaagccctaagacatggtccggcgaaggcagtccaaagcggaacctccgggtgttgtggctgattttctctttctcaatcaagggcagcgggtacttggcttcagggtcctgtaaggtgattggctctctcctcctggagttcatgctcttcaggaccaacacgagcacagtgaccccagtgacggtgatggtcaggagcagggacgggtcccggagtgagacgcccaacacgtcgtcgaactggggttggccgggggccgctccccgccgcgggcccgcagactcgtggcgtcgccccgcagctccgcctggccgacggggaaccggccgagacccggacacgcacgcccgggaggacaaaagcgcgggcggaccccgcaggctgggaccccggcggctggcccgctccccgagaagggccgtggtcggggggctctcactcacgagccgctggctctgggtcagccctgcccccagggcagcgctccatcatgaggctggcggggcgctgagccgtggcgtcctcgctcctgcgctgcccctctgcaccctccgct

SEQ ID NO: 716045 - DNA, 885 bp, Homo sapiens
gtgcatgctgtgacggtgggatgtgctgaaggctacctgctgcttgattgtcgagtgttataatatcatagtgagttcttgcttactgcaagcatcgattgcagatagtccagttgcgccagccaaattttttctcttgatcatcctagcgatcataggtgctagggaacagcataccagacagcggatagcgctgagaaactcgcgtcctggataaagccgtcacgatcaaaaccgagggcgagagacacaacttgggaacgcaacaacttggcagtccagaatgaatgtcgacagagggacgggagcgaccgtgatgctcatgcacttgaccatctgtttgacaagtggggcagggcacggcgttggtaccagaatcttcggtgcagacctcaggtcgattaagacaaataacgtaagtaaactaatctcccgtgatgtagcactaaagatgaaccagagatgacctcactggtggtagctcacgattgttattccaccagtaaatccaacaaggtggcacggatcggaaatcaatctctgagtaaccagaaatagtttcacgtcgaacgatgtccatcgatagaccattggtctccccaagatagaaatacgaagcaggaaatttctggcaaggtacacaaaatggtaatataggaactaaggtagaattgatgtcgatgttattgtataagatactaattgtattggtaagaaagtgttgttgaaattatattgcaaagtgaagaagaaataacttagagaactggatggtggtaacataccattaaaaataagtgtgaacaagagtgagattgggatacaaagaaaaacgatgagagatataaagagaggtaggtgagataactagggaaagaagaaatg

SEQ ID NO: 716046 - DNA, 116 bp, Homo sapiens
acgctgcaccgcgcgtccaaagttaagaacgggaagaatgggtggcaaggtggctcctggagaagctcacccagcacaggctgccctgagctcggagcctttggttttctgtccct

SEQ ID NO: 716047 - DNA, 1894 bp, Homo sapiens
tttttttttttttttgctttgtacttgagtttatttcacaaaaccacggagaaagatactgaaatggagctctttccagcctccaagcaaggaggccccagcagccagtctccagccccttgagccctttttgttaggcccacacccaaaagaggagaaccagtgtgtgcgcgaaggtacatggcaaggcacttttgaaaacatcccagtttaccgtggtgaaattgaacttactctgaaacagatgaaaagggacatgcaaatttgctgagcacatggaggtgtttgttagtaggtgaaaatcatgtcctgggtataacccagcttctccaggttagggtgagccgccgtctggatcagtggtggcgggccacacaccaggatgagcgtggacttcgctggaggaggaaggtgctccttgatcatgtcggcagtaacgaagcctgagctgtacttccagccaatgggaggcctgtccagggtgtaccacaggtcgaactggtctgggtgagtcctggcaatttcttcaagctcttttctgaccaagatatcctcctctgtctggttggcaaagatgagggacatcctggtcctgtcactggggtccttggtgatgtggcgaatgagctgcaacatgggtgtgatgcctgtgcccccagcaatcattcccaggtgatcggccagtgtttttttaggctcactcgtctggtctggtctgattccaagattccctggcccatggtaaaacaagcgtccccttggccctcgaaaaaagatggtctccccgattttcatgttctccaaatactgagtcatcttcccaccttcaggatattgggggtgtacatttttgaagtagatctttataattaggtccacaaagcctctgtcatcatcactggagacaggggtgtaagccctgaccaccaattcattatcgatttttgccaagagctggacatagttacctacaggaagccctaagacatggtccggcgaaggcagtccaaagcggaacctccgggtgttgtggctgattttctctttctcaatcaagggcagcgggtacttggcttcagggtcctgtaaggtgattggctctctcctcctggagttcatgctcttcaggaccaacacgagcacagtgaccccagtgacggtgatggtcaggagcagggacgggtccctggcagacacaatgtgaacagagcacctcaggtcttgcccgccctggacagggcagctctcaggcgcagaacaccctccccacaccaaaggcacaggagctgagctctgcctgcaggaaataggcaaagagaacagtagtgacacagaaggcggctgggagagcctgtggtggaccagagggtagggaggggtcagctgcaggtcacacaggaaggatgtttcaggcccctggagcaggcagcacacatggcctggggtgctcaggtcactaggcccctcctggctacagccaaacgttcatacactggaagtcccttccttgaggtgaagggggaggacgtcacccctaacacacaatccggaatgaggggcccagtccctaaagacagaactagggtgcgtagctctaagaggtgccccgtgacttagggcctggggactccccaacagtctcctggacagggcgaagggggcctgggcactcaactgccagagactcgggagcctccccgcatctgtccctaccctacaaggccgccctgctcctctcccaactcaagcccgacagggaaagttgcctctcctcccgccgggtcactggagtctcagccttccggaatccgagccggcccgccccgctccccgcccttcgcggtcccgcccacgacctctccccacgcctcccgctccggcccccacctccgct

SEQ ID NO: 716048 - DNA, 796 bp, Homo sapiens
  misc_feature (213)..(213): n is a, c, g, or t
  misc_feature (224)..(224): n is a, c, g, or t
  misc_feature (305)..(305): n is a, c, g, or t
tatgtaaagcttatcaagacatatgaagtgtcaattgactccatctacatcccacaaaatgtgtagctataaactgctcgattctactgacaaccgtggaactcacctctctcttgtgtgcgttccttgacgtgtaataaagactcatgacttcagcaagtttaggtctgttgctgtgatactgcacatatcgcaactagctgaatgtataanaagtgatgccncttgtagtagcacaccttggtgatcttgccacatgaacatatgctaggctgtaaggtccacatgctacaaggatgtgatgntatatgctttctgttcaactactcaataggcctaattctctagtaattccctaaacatttagaccaagcgatagaggcatgctactcctttctggcattgtctatatcatgagagccatggccttcctctcacgccaaattattagcacctgttctatatcaacacagcaacttctatgtatatcctttcactggttcctagttctatcggtcttagtgcagtcaagaaatatttgacatattatcctcttagcgatataacaactaagtgatataactgttcacttttcagactgtacatggcacaacaattgttacaaaagtctattaacttgatgcacgagaatttgccctggactatccctatcccagggagggaaacaagaaggttaggacggcaaccttgggataggtgctagaagcataggaaaagcaccagagaaattggacaaaccaggtcctatttcctctttttctcctgatgttttaac

SEQ ID NO: 716049 - DNA, 404 bp, Homo sapiens
caaaggctgaggcaggagaatcgcttgaacccagaaggcagagatggcggtgagtcaagatcataccattgcactccagcctgtgtgacgtgaagactccatctcaaaaaaaaaaaacggggggaccaggttgccttcattgaaaaggttagatatttgaggaaaaccctgaggggggtaaagaatttagccttggggctatctgagggaagagtattctgggcgggggaaacagccagccctaagactgcaagccggaggaatgcctgttccattcagggaagagcaacagggccatcgtgcccactgcagagtgagtagggccgagaatgggggaagatcaggcctggcctactttttggcctttgtaaggactcccttggctttcactctgggggaaaaga

SEQ ID NO: 716050 - DNA, 367 bp, Homo sapiens
  misc_feature (57)..(57): n is a, c, g, or t
  misc_feature (74)..(74): n is a, c, g, or t
  misc_feature (100)..(100): n is a, c, g, or t
cccaagactggatatcactgtgttgcccaggctggagttcagtggctattcacagangcaatcatagcatgctncatccttgaactcctgggctcaagcngtcttcctgctttagcctcccactgtgtttggatggtaaggggtgaagaagactgagtaaagaggctgttgcattcagcattaattatgcatatttcccacgtagctaggactacaggcatactccaccactcctggccctatttttaactgatgctcatttcaaagtgagagatatgtcttaggatatcagattttttgaaaccataacattgactaggaagactagttaggaagtacttttcattttaaaatacacattagcaaa

SEQ ID NO: 716051 - DNA, 285 bp, Homo sapiens
  misc_feature (16)..(16): n is a, c, g, or t
  misc_feature (45)..(45): n is a, c, g, or t
  misc_feature (135)..(135): n is a, c, g, or t
  misc_feature (238)..(238): n is a, c, g, or t
aacccactgaagcatnggcaatggtggctcatgcctataatcccnagcgctttgggaggccaaggcagaactatcgcttgagaccaggaattcgagagcaacctaagcaaaatggtgagaccctgtctctccaangtaaatggatcaatcaataaaacgtggtggtgctatttgacaagctgaggcaggaggattgcttgagcccaggagtttgaggctgcagtgagctatgattgtnctactgcactcttgacctgaatgacagagcaagaccctatatcttaa

SEQ ID NO: 716052 - DNA, 383 bp, Homo sapiens
  misc_feature (9)..(9): n is a, c, g, or t
  misc_feature (81)..(81): n is a, c, g, or t
tctgctttnctgtgtaaaaactggccataaagaaattatcttaccctaccttgtttaactgaaggtcataagatcctcatncccagagaggccctgccacatagccaaaaggaagaagtgcatgctcagacaggtcaagaagaatctagacagacaggcctttctgggtttccctactcaatctattagtattaggtcatatcccttttgtccagtcatatttcttcatgactgttcataccttgttgaacctaaggattaaaatggtcaattttccctgtgtctttggtcttcattctgaaggcttatgttggaaatgtggtgttcaaatttcatgtaaagcttatgatcaaataaatttgtatgccattttctccgtctta

SEQ ID NO: 716053 - DNA, 111 bp, Homo sapiens
aagtccacggaacggggtgagatcagccccagagtagtatacatgggaacaatctgtctaaaagatgagcctggggcattccaacatttagagtaggatacagtagggaga

SEQ ID NO: 716054 - DNA, 1628 bp, Homo sapiens
  misc_feature (22)..(22): n is a, c, g, or t
  misc_feature (30)..(30): n is a, c, g, or t
  misc_feature (237)..(237): n is a, c, g, or t
  misc_feature (1046)..(1046): n is a, c, g, or t
  misc_feature (1054)..(1054): n is a, c, g, or t
  misc_feature (1059)..(1059): n is a, c, g, or t
  misc_feature (1072)..(1072): n is a, c, g, or t
  misc_feature (1082)..(1082): n is a, c, g, or t
atgtcttcaccagtcctcaggnactctccngtctgtcccagctactctccaaccacgcccacatttcagctggagtccgttccaggcaccccggaatcaccaccaaactcaccaatttcactcagttactccccagtctctctcatgtcttcacccatccctcagggactctcctgtctgtcccagctactctccaaccacgcccacatttcagcgggagtcagttccaggcacccnggaatcaccaccaaactcaccaatttcactcagttactccccagtctctctcatgtcttcacccccagccccctgggactctcctgtctgtcccagctactctcccaccacgcccagatttcagcgggagtcagcctcccacactccggaatcacctacagactcacagacttcactgaggtcctccctggtctctctcaggtctttgccctcagcccacagggactcttgtgtctccttcagctactctcaaaacttctctagattccagctggagtcagttccaggcacccacgatacaccaccgaactcacgaatttcactgacttactccccagtctccctcatgttctcacccccagccctcagggactcttctgtctctctcagctactctccaaccatctccagatttcacctggagtcagcttcccgcacccaggaatcacctacaaactcacggaccttactgcaaccctcccccatttctttcacctcttcaccccctgccttcagggactctcctgggtctcccagcttctctccagccttccccagatttctgccacagtcagccccaggcacccaggacaaccctagacactcacaggcctcacgagactatctccctatgacctgtacctatacagggattgctcccacgcatccctcagtgaccccaaacccatctccacttacactcaggcactcccagggcctgacagctactccccgttattgtccttcagttcgaagccctggccaatctactagcccacatgacgcagttacctggccgtttctccacngttcccgngaggnccccacacccagncgcacaagancccctcctgcattccgtcctcacacgcaggcctgtccatctacttgctactgtcacactcttgccagcagaagaggcccctgtaatggccgatatcaccacccagtctatcctcaccccacagctgtgcagcgggaacctcctgctggcccacgtgctcgccacagcccatgctggcacgacgctccagcaggccggcgtccctgcgggccacactaccggtgacatggctagcatgaccctccttcctggcagtgacactgttgatgtgaaccccagtttcacatctgtcatttgtaaataggaccattttcccttttcgctctcccttccattcacagggcttttcattctctctgtttctgcctccgtttcagatatttactcacctttttctctctcactatgtctgccgtggtctccatgagagtacgccacgtaagattcccccattaaaggtcatgaatgagtgcttttagtatacctgtgttgtgcacattctattttaattcgcaatccattgtagacgtctagatcctctagagca

SEQ ID NO: 716055 - DNA, 520 bp, Homo sapiens
gctgcatcagaggcaggtcaaacacagaaatgatactttgttccataatttgagggaagaaaataccctgcaagtttgagagctagttttctatgacgagtgcacgtgacggcgtggtgtaaggtaaccggaggcgatgccagaggcggcgacacgcccgccccttccctgaagctcaggggctctaagataggaccggggctccctgtgcctgacccactgggcggccccgcctgctctctggaaactgggtcctgcctgtgacttaattacaaggaataaaataaaagtaacagcatacaaggtaataccacaaggaagtttagattacactcataccattgtatcatcttgctataaaaagttacttaaaactatttcttttgcatataaatgaaaaaagattagaatatttggtcaactggaaatattgctaggcacagacgtctgcaactgcaaagtatataatacagagattatgtcgaccagctccgcagctggagcagcagggacccactcg

SEQ ID NO: 716056 - DNA, 171 bp, Homo sapiens
ttcacatgcccaaaggctggaagcagtgggatcagcttggtcccctgtaggagattgaggatgcccggagaaaagatgttcaatacagtcatccagtctgggcctcagcgccacaattacgggttctaaataccccactcgtcgcccgtgcgggccatgtccagcatctca

SEQ ID NO: 716057 - DNA, 1779 bp, Homo sapiens
  misc_feature (22)..(22): n is a, c, g, or t
  misc_feature (30)..(30): n is a, c, g, or t
  misc_feature (388)..(388): n is a, c, g, or t
  misc_feature (1197)..(1197): n is a, c, g, or t
  misc_feature (1205)..(1205): n is a, c, g, or t
  misc_feature (1210)..(1210): n is a, c, g, or t
  misc_feature (1223)..(1223): n is a, c, g, or t
  misc_feature (1233)..(1233): n is a, c, g, or t
atgtcttcaccagtcctcaggnactctccngtctgtcccagctactctccaaccacgcccacatttcagctggagtccgttccaggcaccccggaatcaccaccaaactcaccaatttcactcagttactcctcagtctctagcacgtcttgatctccaaccctcagggactcgcctgtctgtcctcagctactctccacacatcgcccagcactgtaagcgggctgctcgagcagacaccctgccatcaccgcctcactcaccgatttcactgcgttactccccagtctctctcatgtcttcacccatccctcagggactctcctgtctgtcccagctactctccaaccacgcccacatttcagcgggagtcagttccaggcacccnggaatcaccaccaaactcaccaatttcactcagttactccccagtctctctcatgtcttcacccccagccccctgggactctcctgtctgtcccagctactctcccaccacgcccagatttcagcgggagtcagcctcccacactccggaatcacctacagactcacagacttcactgaggtcctccctggtctctctcaggtctttgccctcagcccacagggactcttgtgtctccttcagctactctcaaaacttctctagattccagctggagtcagttccaggcacccacgatacaccaccgaactcacgaatttcactgacttactccccagtctccctcatgttctcacccccagccctcagggactcttctgtctctctcagctactctccaaccatctccagatttcacctggagtcagcttcccgcacccaggaatcacctacaaactcacggaccttactgcaaccctcccccatttctttcacctcttcaccccctgccttcagggactctcctgggtctcccagcttctctccagccttccccagatttctgccacagtcagccccaggcacccaggacaaccctagacactcacaggcctcacgagactatctccctatgacctgtacctatacagggattgctcccacgcatccctcagtgaccccaaacccatctccacttacactcaggcactcccagggcctgacagctactccccgttattgtccttcagttcgaagccctggccaatctactagcccacatgacgcagttacctggccgtttctccacngttcccgngaggnccccacacccagncgcacaagancccctcctgcattccgtcctcacacgcaggcctgtccatctacttgctactgtcacactcttgccagcagaagaggcccctgtaatggccgatatcaccacccagtctatcctcaccccacagctgtgcagcgggaacctcctgctggcccacgtgctcgccacagcccatgctggcacgacgctccagcaggccggcgtccctgcgggccacactaccggtgacatggctagcatgaccctccttcctggcagtgacactgttgatgtgaaccccagtttcacatctgtcatttgtaaataggaccattttcccttttcgctctcccttccattcacagggcttttcattctctctgtttctgcctccgtttcagatatttactcacctttttctctctcactatgtctgccgtggtctccatgagagtacgccacgtaagattcccccattaaaggtcatgaatgagtgcttttagtatacctgtgttgtgcacattctattttaattcgcaatccattgtagacgtctagatcctctagagca

SEQ ID NO: 716058 - DNA, 203 bp, Homo sapiens
tgggcttggagcatagcgtggtcacaaaagcctggataacggaacggtattggacggtaccagcctcttgaagccagtggcagtgcagtagcagtggcaaaagccaggagcaggtacgtccaggagcctggagccattgccactaggtgagcttgtcctacagtgtaccctgagtggttcggggggccattcaacgcctccgg

SEQ ID NO: 716059 - DNA, 542 bp, Homo sapiens
gttccgtcatccagggtatgtgaccacgctatgctccaagaacatcgcgcgcacagcatggcattgacacctaccagtgagttctcgaatgaaaccgtatatcccaaaggaccagaagtattcattcctggatgactcccagacctcccttctgcttctcagactctattccgaccccctccaccatggaggaaacgcaacagacctccaatctagagctgctccgatatactccctgctgctacatcgagtcgtgtgctggagaccgtgcggtccctcaggagtctgttcgcccaacaaactggtgtatgacacctcggacagcgatgacgatacacctcctaacggacctagaggaaggcatccaacacgctgctggggaggctggaagacggacgccgccgtgactgggcacgatcctcaagcagacctccagcccctctgacacaacctcgcacaaccatgacgcactgctcaagaactacgtggctgctctactggttcaaagaggggcggacagcagcaaggggcggagcaggtgt

SEQ ID NO: 716060 - DNA, 879 bp, Homo sapiens
gggcgggctgcgcgatcaatccgcaagctccctgtgatgcaaatgggaaggcagttcccgggccaagtccccaacgtggttctggccagtttaaagcccactgcgaaccggggaagtggctatattcctgtgacacggggtgaaagctgaagtaggtctcggtccctggccgacagggaggttgcgaatgcaaagctaccactactggaagacgctccaggcccgaccgcttgtgggtcggtgactcggggaaaggatcccatctcggccttgcgtaccttctactacaacgcagacaggaatacgacaactgtctcacgcctgctctgtcgcctcccctgagctatgaccctgtgagattctgggacattgcaagtcaatctggtagtgggggacagacgttccgagaatgggccccgtccgttagaattcccgtgcccaaatccccagaagcctgataaatatgattatctcagctatgaagtagttactgctagcatggttgaaagggtgtgcgcggaaatacatttcgggttactcattagtctgatcttggctataggatatgattctggattatgtgggttaggtccacaggctatcattacggggtccttatatgcgcacgaaggaggaaggtggaagaagcttgaagtcaggcagaacgcggttccagaggctttgaaggtagagaggtccactgagaagaccatgcggacacggacgaggttgccttggtgcacgaatctgagcaagaggctggatcaacagcgcgcaccagaccagatctcatggcccggaggcgtggctcatgcctgtaattcccacgacttgacgaaggcaggcggggtgatcaggcagggaaatcgaggaacaccg

SEQ ID NO: 716061 - DNA, 331 bp, Homo sapiens
taatcatagcagagctgctctgctcgctctacaggcctctttgagaggaaggacagtatccaaagggacactgaacgagtgacattggttgggccgtgcccctcctcaggcagacagaatcaagccatggacctgtacaaggggtccacagaccagtaatcatcatcccagccaaggaaccagcccacaaaggagggaggctcaaagccttgcttcaccacggtaataagcgtacgccgatcccgattggctgggtccgactcgatataccgcttagcagaagtcaaggcttctgtcttatctacttcttgagaatcctttccaacccaga

SEQ ID NO: 716062 - DNA, 726 bp, Homo sapiens
  misc_feature (10)..(10): n is a, c, g, or t
  misc_feature (36)..(36): n is a, c, g, or t
  misc_feature (92)..(92): n is a, c, g, or t
  misc_feature (105)..(105): n is a, c, g, or t
  misc_feature (121)..(121): n is a, c, g, or t
  misc_feature (129)..(129): n is a, c, g, or t
  misc_feature (148)..(148): n is a, c, g, or t
  misc_feature (160)..(161): n is a, c, g, or t
  misc_feature (165)..(167): n is a, c, g, or t
  misc_feature (176)..(176): n is a, c, g, or t
  misc_feature (178)..(178): n is a, c, g, or t
  misc_feature (183)..(183): n is a, c, g, or t
  misc_feature (190)..(190): n is a, c, g, or t
  misc_feature (201)..(201): n is a, c, g, or t
  misc_feature (214)..(214): n is a, c, g, or t
  misc_feature (222)..(222): n is a, c, g, or t
  misc_feature (224)..(225): n is a, c, g, or t
  misc_feature (234)..(234): n is a, c, g, or t
  misc_feature (241)..(241): n is a, c, g, or t
  misc_feature (247)..(247): n is a, c, g, or t
  misc_feature (267)..(267): n is a, c, g, or t
  misc_feature (272)..(272): n is a, c, g, or t
  misc_feature (278)..(278): n is a, c, g, or t
  misc_feature (282)..(282): n is a, c, g, or t
  misc_feature (290)..(290): n is a, c, g, or t
  misc_feature (293)..(293): n is a, c, g, or t
  misc_feature (297)..(297): n is a, c, g, or t
  misc_feature (300)..(301): n is a, c, g, or t
  misc_feature (303)..(303): n is a, c, g, or t
  misc_feature (306)..(307): n is a, c, g, or t
  misc_feature (310)..(310): n is a, c, g, or t
  misc_feature (312)..(313): n is a, c, g, or t
  misc_feature (318)..(318): n is a, c, g, or t
  misc_feature (323)..(324): n is a, c, g, or t
  misc_feature (328)..(328): n is a, c, g, or t
  misc_feature (334)..(334): n is a, c, g, or t
  misc_feature (337)..(337): n is a, c, g, or t
  misc_feature (340)..(340): n is a, c, g, or t
  misc_feature (344)..(344): n is a, c, g, or t
  misc_feature (354)..(354): n is a, c, g, or t
  misc_feature (363)..(363): n is a, c, g, or t
  misc_feature (365)..(365): n is a, c, g, or t
  misc_feature (368)..(368): n is a, c, g, or t
  misc_feature (373)..(373): n is a, c, g, or t
  misc_feature (377)..(377): n is a, c, g, or t
  misc_feature (379)..(379): n is a, c, g, or t
  misc_feature (382)..(382): n is a, c, g, or t
  misc_feature (388)..(388): n is a, c, g, or t
  misc_feature (397)..(397): n is a, c, g, or t
  misc_feature (403)..(403): n is a, c, g, or t
  misc_feature (407)..(407): n is a, c, g, or t
  misc_feature (419)..(420): n is a, c, g, or t
  misc_feature (423)..(423): n is a, c, g, or t
  misc_feature (426)..(427): n is a, c, g, or t
  misc_feature (440)..(440): n is a, c, g, or t
  misc_feature (442)..(444): n is a, c, g, or t
  misc_feature (446)..(446): n is a, c, g, or t
  misc_feature (450)..(450): n is a, c, g, or t
  misc_feature (452)..(452): n is a, c, g, or t
  misc_feature (463)..(463): n is a, c, g, or t
  misc_feature (466)..(469): n is a, c, g, or t
  misc_feature (531)..(531): n is a, c, g, or t
ggcacgaganaacaatttctgaggattctgaaactngatttctagcctcagcatctctactgattgacttgtaattttgactctcaactttnctatttctagctncagcatctctactgantgacttgnaactttgactctgaacttntctatccttgcnnaaannnttaattatnanatatnatctgcngttaaccttgnactggtgattaanacagttgngnntatatatgncttaganctagtnaactcactctgctataaaanaatcntgattngacntgcatganaanggtnttnntnaanngtntnntgganaaatnntaanccatanatngtntaantagttgcctnttagctaantngancaatntccntnaanttccantactgattncccacnccancaccattagtannttnganngataatcactatntnnngngatnantgaatgaaacnatnnnncttcaagcatgttgggagcattgccctatatttaatgcagagtgtaaacttatctaccagtngatgaaacaatgatcataactcaacgttatgtaagtatccctagacctcctgaagacacagttccactgttatcaatgatttgacagaagctcttggccatggcatgatcgtagctcttcaaccaagattctaactgtcaaggtacctccgaggcctttatgtcatagtaatgccaatctcttgagattattccc

SEQ ID NO: 716063 - DNA, 176 bp, Homo sapiens
cgtcaccggaacagtataaccatctccagagtatccacgctcgcggaagactgatgttcgcgttgtcacgcactccagtgctggaacagcctctaagagtgcatcacttcctttctaccctgcgtcctttgtcttacgatttaagcagcccgtgataccatcacagtatgcagaga

SEQ ID NO: 716064 - DNA, 692 bp, Homo sapiens
  misc_feature (10)..(10): n is a, c, g, or t
  misc_feature (36)..(36): n is a, c, g, or t
  misc_feature (92)..(92): n is a, c, g, or t
  misc_feature (105)..(105): n is a, c, g, or t
  misc_feature (121)..(121): n is a, c, g, or t
  misc_feature (129)..(129): n is a, c, g, or t
  misc_feature (148)..(148): n is a, c, g, or t
  misc_feature (160)..(161): n is a, c, g, or t
  misc_feature (165)..(167): n is a, c, g, or t
  misc_feature (176)..(176): n is a, c, g, or t
  misc_feature (178)..(178): n is a, c, g, or t
  misc_feature (183)..(183): n is a, c, g, or t
  misc_feature (190)..(190): n is a, c, g, or t
  misc_feature (201)..(201): n is a, c, g, or t
  misc_feature (214)..(214): n is a, c, g, or t
  misc_feature (222)..(222): n is a, c, g, or t
  misc_feature (224)..(225): n is a, c, g, or t
  misc_feature (234)..(234): n is a, c, g, or t
  misc_feature (241)..(241): n is a, c, g, or t
  misc_feature (247)..(247): n is a, c, g, or t
  misc_feature (267)..(267): n is a, c, g, or t
  misc_feature (272)..(272): n is a, c, g, or t
  misc_feature (278)..(278): n is a, c, g, or t
  misc_feature (282)..(282): n is a, c, g, or t
  misc_feature (290)..(290): n is a, c, g, or t
  misc_feature (293)..(293): n is a, c, g, or t
  misc_feature (297)..(297): n is a, c, g, or t
  misc_feature (300)..(301): n is a, c, g, or t
  misc_feature (303)..(303): n is a, c, g, or t
  misc_feature (306)..(307): n is a, c, g, or t
  misc_feature (310)..(310): n is a, c, g, or t
  misc_feature (312)..(313): n is a, c, g, or t
  misc_feature (318)..(318): n is a, c, g, or t
  misc_feature (323)..(324): n is a, c, g, or t
  misc_feature (328)..(328): n is a, c, g, or t
  misc_feature (334)..(334): n is a, c, g, or t
  misc_feature (337)..(337): n is a, c, g, or t
  misc_feature (340)..(340): n is a, c, g, or t
  misc_feature (344)..(344): n is a, c, g, or t
  misc_feature (354)..(354): n is a, c, g, or t
  misc_feature (363)..(363): n is a, c, g, or t
  misc_feature (365)..(365): n is a, c, g, or t
  misc_feature (368)..(368): n is a, c, g, or t
  misc_feature (373)..(373): n is a, c, g, or t
  misc_feature (377)..(377): n is a, c, g, or t
  misc_feature (379)..(379): n is a, c, g, or t
  misc_feature (382)..(382): n is a, c, g, or t
  misc_feature (388)..(388): n is a, c, g, or t
  misc_feature (397)..(397): n is a, c, g, or t
  misc_feature (403)..(403): n is a, c, g, or t
  misc_feature (407)..(407): n is a, c, g, or t
  misc_feature (419)..(420): n is a, c, g, or t
  misc_feature (423)..(423): n is a, c, g, or t
  misc_feature (426)..(427): n is a, c, g, or t
  misc_feature (440)..(440): n is a, c, g, or t
  misc_feature (442)..(444): n is a, c, g, or t
  misc_feature (446)..(446): n is a, c, g, or t
  misc_feature (450)..(450): n is a, c, g, or t
  misc_feature (452)..(452): n is a, c, g, or t
  misc_feature (463)..(463): n is a, c, g, or t
  misc_feature (466)..(469): n is a, c, g, or t
ggcacgaganaacaatttctgaggattctgaaactngatttctagcctcagcatctctactgattgacttgtaattttgactctcaactttnctatttctagctncagcatctctactgantgacttgnaactttgactctgaacttntctatccttgcnnaaannnttaattatnanatatnatctgcngttaaccttgnactggtgattaanacagttgngnntatatatgncttaganctagtnaactcactctgctataaaanaatcntgattngacntgcatganaanggtnttnntnaanngtntnntgganaaatnntaanccatanatngtntaantagttgcctnttagctaantngancaatntccntnaanttccantactgattncccacnccancaccattagtannttnganngataatcactatntnnngngatnantgaatgaaacnatnnnncttcaagcatgttaaaagatttaaagcctaataaattcatacttcccctgccttcatcatgactgcaactcttcctttattatgcctgattaaccttataaccgtgttaaaaaatgttatctatcaaagttttcatctcccctaaattcttaaaaaccattttcatgttatttactaattaaccaagcatttgccacgcctaatgtacctttcacccttttct

SEQ ID NO: 716065 - DNA, 529 bp, Homo sapiens
actggggatgccagactgtcctctgcagcagctttatctcacagtggactgactcgctttgtgacatgttcatcctcaagtccccctgccttaccaccggtgtggggggcatcacaactgcaggacggagggacgaagtgcagcacccctctgctgtgggcttgggacacgcttaggtgggcagcttcccctgccgtgggctcgggacactcttaggtgggcagcttcccctgccgtgggctcaggacacgcttaggtgggcagctccccccctgccgtgggctcgggacacgcttaggtgggcagcttcccctgccgtgggctcaggacacgtttaggtgggcagcttcccccactgtgggctcaggatgcgcttgggtggggtgcactggcgttaactgcatgtttagcactcagcttatctgcaggtgggtagcggtgcacgtgcttttgtttactctgggctggccttggtcaaggacgggttcccaacaagaatgcgtgtaatggacgcttggcaccgcggccg

SEQ ID NO: 716066 - DNA, 337 bp, Homo sapiens
ccaacactgctttttatctttttttttttggacgcggtttcactttgttgcccaggctggagtgtggtgatgcaatctctgctcactgtaatctctgcctcccaggaccaggcgatcctctcacctcggcctcctgagtagctgggaccaccggtgcccaccaccatgccacattaatttttttttttagttttgttagagacagggcttcaccacattgcccaggctggtcttgaagtcctcggctgaagcggtccacccgccttggcctcccagagtgtggggaatacaggcgtgagccaccacacttgccccctgcttctttaaaaaaaaaaaa

SEQ ID NO: 716067 - DNA, 136 bp, Homo sapiens
gagggtgcggtggcacagactgcacacagattcgccatgcatctgtcagggctgtcccagacacagattcacctctcctacaaaatgtgtgcttgcattcattttaacattaagatggcataacaataagcgtgct

SEQ ID NO: 716068 - DNA, 176 bp, Homo sapiens
accggggaagcactgccctctttcaataatagacagctatcttccttgtcctgtgatagagttgctcagcgtgtaagagctaggcggtaagtgccatttcgaacttcatcaatgactgtgggttccaagtctacaaacactgcccggggcacatgcttgccaccacccatcacctg

SEQ ID NO: 716069 - DNA, 174 bp, Homo sapiens
  misc_feature (23)..(23): n is a, c, g, or t
acccctagtttgagaagttcaantagcatttattatcagaggtacatgagcaggctcagcctaggggaataatgccaacaaacactttggggaagcctgggaccatggctttgccaggaatctgtgacagtctccccctgacagtcatatgctgttttgccttcttagtttagg

SEQ ID NO: 716070 - DNA, 439 bp, Homo sapiens
  misc_feature (135)..(135): n is a, c, g, or t
  misc_feature (367)..(367): n is a, c, g, or t
aggtcagcagggagggaatattttagattgagcggaaagaggtaagtctctctaagaagtgacatttgcagagacctaagtgaacaaggaagtaattcatacagatacggtaaggaaggtaaagggagcaacaanggcaaaggccctgaagtgggaatggctttagcatgtttaaagaacgaaaagatggttgttatgtttggactgacctgttggcaagaattgtgatagatgaaattagagagatccccaggccagattatttaagatccagtcaaccacagtaaggtttttggactttattttgagtgtgataagaaacctctgagctgggcgcggtggctcacacctgtaatcctagcacttngggagccaaggcaggcagatcacctgaggtcaggtggccagcatgatgaaaccccgtctctactaaaaatac

SEQ ID NO: 716071 - DNA, 229 bp, Homo sapiens
  misc_feature (45)..(45): n is a, c, g, or t
  misc_feature (207)..(207): n is a, c, g, or t
gctgtatattgtgatatactacatgactattcagtgtggtgtggncatagttgtggtgagaccatagaagaggaagaagacagtgttttttttccatattcagggtgtgcacccatgtgccaggcgtgctgaccatgggtgtgggatatgcatgccccacttgcactcgtggtcccacccatgtctcacattggtcacccccatggnttcaatggcggaaccgtgtgtg

SEQ ID NO: 716072 - DNA, 543 bp, Homo sapiens
  misc_feature (6)..(6): n is a, c, g, or t
  misc_feature (61)..(61): n is a, c, g, or t
  misc_feature (64)..(64): n is a, c, g, or t
  misc_feature (74)..(74): n is a, c, g, or t
  misc_feature (99)..(99): n is a, c, g, or t
  misc_feature (106)..(108): n is a, c, g, or t
  misc_feature (127)..(128): n is a, c, g, or t
  misc_feature (134)..(136): n is a, c, g, or t
  misc_feature (142)..(142): n is a, c, g, or t
  misc_feature (144)..(144): n is a, c, g, or t
  misc_feature (159)..(159): n is a, c, g, or t
  misc_feature (185)..(185): n is a, c, g, or t
  misc_feature (192)..(192): n is a, c, g, or t
  misc_feature (197)..(197): n is a, c, g, or t
  misc_feature (236)..(236): n is a, c, g, or t
  misc_feature (243)..(243): n is a, c, g, or t
  misc_feature (257)..(257): n is a, c, g, or t
  misc_feature (400)..(400): n is a, c, g, or t
  misc_feature (519)..(519): n is a, c, g, or t
atcccngccccggggagccttgccccccagagggccccgcccagtgcagtcggggggaccnganagggaggagncgggagcacagcggcggcgggaaangcggacnnngaacccacacaagcgaatnnctgccnnncgagcncngcagcactctaatcnacaaaaggaggaagggaatccggagngagcaanggagnggcggccagggaaggaagaaaagcggccattgcccttcnggacacngagagggacaatcnttgcctttatctctgaggctatggagggtcctcctccatctttctacagagattactttgctgccttaatgacattcccctcccacctctccttttgaggcttctccttctccttcccatttctctacactaaggggtatgtnccctcttgtccctttccctacctttatatttggggtccttttttatacaggaaaaacaaaacaaagaaataatggtcttttttttttttttaatgtttcttcctctgtttggctttgcnattgtgcgaattggaaaaaccact

SEQ ID NO: 716073 - DNA, 754 bp, Homo sapiens
  misc_feature (40)..(40): n is a, c, g, or t
  misc_feature (67)..(67): n is a, c, g, or t
  misc_feature (81)..(81): n is a, c, g, or t
  misc_feature (110)..(110): n is a, c, g, or t
  misc_feature (150)..(150): n is a, c, g, or t
  misc_feature (156)..(156): n is a, c, g, or t
  misc_feature (169)..(169): n is a, c, g, or t
  misc_feature (192)..(192): n is a, c, g, or t
  misc_feature (195)..(195): n is a, c, g, or t
  misc_feature (197)..(197): n is a, c, g, or t
  misc_feature (210)..(210): n is a, c, g, or t
  misc_feature (226)..(226): n is a, c, g, or t
  misc_feature (254)..(254): n is a, c, g, or t
  misc_feature (268)..(268): n is a, c, g, or t
  misc_feature (270)..(270): n is a, c, g, or t
  misc_feature (286)..(286): n is a, c, g, or t
  misc_feature (303)..(303): n is a, c, g, or t
  misc_feature (305)..(305): n is a, c, g, or t
  misc_feature (333)..(333): n is a, c, g, or t
  misc_feature (375)..(375): n is a, c, g, or t
  misc_feature (382)..(382): n is a, c, g, or t
  misc_feature (395)..(395): n is a, c, g, or t
  misc_feature (470)..(470): n is a, c, g, or t
  misc_feature (472)..(472): n is a, c, g, or t
  misc_feature (539)..(540): n is a, c, g, or t
  misc_feature (545)..(547): n is a, c, g, or t
  misc_feature (552)..(552): n is a, c, g, or t
  misc_feature (555)..(556): n is a, c, g, or t
  misc_feature (562)..(563): n is a, c, g, or t
  misc_feature (594)..(594): n is a, c, g, or t
  misc_feature (668)..(668): n is a, c, g, or t
  misc_feature (673)..(673): n is a, c, g, or t
  misc_feature (679)..(679): n is a, c, g, or t
  misc_feature (681)..(681): n is a, c, g, or t
  misc_feature (702)..(702): n is a, c, g, or t
agcacatattagcacagcccaggccagaaggttgggcttnttgtctctgggaaccatcatacccttnccgccaaagaattntaaataaggcaggttaaaaaattggagtncagtgggagctgggtgcctggtcattcctagaagacaggnagtgtntttttgatggttngacttttagcaacactgggattnttntntgggtcctatggnctgctatgttgagagntggcagaaggatggggacctggtagaangaactggaagaaantnataggttcttgggtgnacatgaacgtgtgtttnanagggcaaaggttgtgcattttacttgtncttgatgcctccatctgccatcctctccctgacagcagcctnatacttnacacctacatttntttctgtggctctggatccggaaaccaagcgtttctccaacagaactgctgtgatttggcaacattgcaaaggtnantgctgtgatttggcaacactgcaaaggtaacagctagtaaacaaggagagaaaaaaaaaaaaaaaannaaaannnccccnccnncccccnntcctgatattctttgattttttttttctctntttataagcaacagggctgtgtgagcaggtatttgtgcgctcacagagtgggcatggcttcccaatctatgttnattancgctcnanagaggctcccccttacctgancctctgcagagtaccaaggcttttcaacagcacagaggctcattgcttgcag

SEQ ID NO: 716074 - DNA, 163 bp, Homo sapiens
gatggacttgtggtggtcgttgactttttttttgtgtgtgatgttcaccctcacgggcgcacgactcactcgctccatcttctctgttccccttcctcctcctcttcactataacaacacaagaccaggcgagaacaaagctctttttacggcttcctcttgt

SEQ ID NO: 716075 - DNA, 105 bp, Homo sapiens
tatcaaggggaactccatgtttccacagcagcttggtcacgatataggtatcaggccgggcgcagtggctcacgcctgtagtcccagcactttgggaggcagaga

SEQ ID NO: 716076 - DNA, 394 bp, Homo sapiens
cgtcgacgctgcatctctgatcagtcttctccttgtatgagctgaaagtttagagggacagccaggtcttggtagatttgcagtggtctgatactccttccatttcaatattatcgcttgcacagtgctccttgggatgtttaaagcttgggaaatctttttgtatccaaatccggctttaaacttcttcacaacagtatctcggacctgcctggtgtgttccttgttcttcatgatgctctctgcgcttttaacagacctctgagactatcacagtgcaggtgcatttatacggagacttgattacacacaggtggattgtatttatcatcattagtcatttaggtcaacattggatcattcagagatcctcactgaacttctgggtcgacgc

SEQ ID NO: 716077 - DNA, 561 bp, Homo sapiens
  misc_feature (532)..(534): n is a, c, g, or t
  misc_feature (542)..(543): n is a, c, g, or t
  misc_feature (561)..(561): n is a, c, g, or t
atgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcagtatgcctccaccatgctaacctcccaagttcttaaagccagaataacaaagagcaaatgatctctaatggtaaaacaattgataccataaaagatgtgcactaagggatggggcactcataaaccaacgaggcaaccattgaaagaaagataaataactaccagtaaagtggccgaccaagcgacagacacaagaaccatggggtgatgcagcatccctccaagaaagtagcgacctgtctctccaaactctatgggccactgtaacaagacaagagtgggcacagagagagtggagatctcaagtggaaatagtgcagtgttcaagacaagaactcttctccagcctgcnnnggcagctnnggggatcagaaaaaaaan

SEQ ID NO: 716078 - DNA, 177 bp, Homo sapiens
cccaggtcaagcaattctgttacctcagcctcctgagtagctgggattacaggtgcatgccaccacgcccatttaattttttgaattttattagacgatgggatttcaccactgctagccagagatggtcctagatctcctagacctctgtgactctgcccacactcgggcctccca

SEQ ID NO: 716079 - DNA, 824 bp, Homo sapiens
tccgtcagccaggcgggagtgcagtggcgagaattgttaccggaaagggatcccaatccagtaccctcaagaggattcttggatcttgagtaagaaagaattcagagagtatggtctcgctatgttgcccaggctggtcctgagctcctggtctaaagcgatcctcctgcctcggtcccccaaagtgctgaaattacaggtctcaagaagaaaagtcgtggaacctgggattctttgtagagatatctggctgtgctgttggtattatatgaaccagagaaaataatcttgcagtatgatattgtgtgtcagtatagtacctcaaccctaatttgcctggtaagcctttatccagagagctttgtgttcaacttacagtcttattctggggtgggggatgtacaggctggctgtgtggacttgcacggagagatttatgggttctaacttgcttcttactgactttcaaccgcaattctcctgtattctagtgcttatacagagcctccacttatactagagtaggctggtagtaagccaaagcctgtcaatagaaagtctattgggagtctcaaggtgcaagtagagtggttctctggacgtttcatgccctgtggggtataagaagtcaggctttcacaaagcctgttaaggtcagtgtgttatttatactgcttttctagccctttcaagaattttacatgaaacatttacgttgttgaattgagaattatattattatgggatcactatgaggttggaggtatacatgttgcttgggaggatattgagcgatagcatgtaaatcaaaattttttggtgga

SEQ ID NO: 716080 - DNA, 180 bp, Homo sapiens
cgagcagtctcgttcagtggcgtctcagctcgcgctgagtttcggcggagcgttgccgtggctctcttcggctctcactgcgttgactgtcagggggtaatccttgtcggctgtcttgtactgctcgggtctccgctcgtcatccactgcagcagcaatccttcagcttcttctcggtcc

SEQ ID NO: 716081 - DNA, 359 bp, Homo sapiens
acagaaagacccagtccagctgtcaagagtagagagggaatggggcttgacacccttagtagtactgcctgtcgacacaaggcacaggacgagggaaaaaaacactagacaccagcgagggggagccaggctgggacagggcgcactcgcacggctgcgagtggtgacgcccctgggtgacacatatacaatgggcacaatgttttccaagctattgaactcctaactctaatcgacttcttccatgacgagacgcatccgtcatcgccctcgacgaggggggatctcatcaggaactgcagcattgggttcctctgctgccacttcatcttcatcaatacctagacctagcttgatca

SEQ ID NO: 716082 - DNA, 309 bp, Homo sapiens
ttccagtcgaggatcatcgattaaatatagatgcatcaaagtcctctgagacaaaagaaatatttgtcatacaccaggaaggtggaggcaggcttaagggctggccatgggtggtaaggatctaccagagggtaatcttcatccctttgggggaggaagtggaaggggcagctctgaggttcttgtaagagctgcagagtggtagacgcaggaagctggcatgcatttctaggtgccatgggtcttcactggtgaagcagtgacagagagaaagggaattgcccagtggatgagggcatggggtaccga

SEQ ID NO: 716083 - DNA, 289 bp, Homo sapiens
aaggcaggtttgtgtgttatagtgttgaagcagaattcctgcttctctgggaaacctcagtttttgttcttacggccttcaactgattggaggtggcccacccatattatggtgggtaatctgttttacctaaagtcaactgactgtcagtgttaatcacatctatgaaataacctcccagcaaggtattgacaagtatttgaccaaacaacggggcaccagagcttagccaagttgacacataaattaaccatcaggaacgagtagaatatccaaaacagccattagg

SEQ ID NO: 716084 - DNA, 325 bp, Homo sapiens
ggcccggttatagcacaataaggaagggtccccagcgttgtagagagcccaagttgagaacaataatgaacaattattgtatgaacaattgttagagacagctaatcacaaacaacctgcgggcacaatgacctcattccacatgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 716085 - DNA, 252 bp, Homo sapiens
  misc_feature (148)..(148): n is a, c, g, or t
  misc_feature (193)..(193): n is a, c, g, or t
  misc_feature (250)..(250): n is a, c, g, or t
acctgcatgataaaaaacctggtcttcacaaccccttatctcaacccagttatgtgacttgaatgatatctgctgagaagagaagaaacacaagattctacaaagcgccagggaagtttacaaaggctaagaagctagagggtgtcanggccgtgcgtcctgatctgatgatggcagccaagccatgcttcangagtcaccgtgctgagacccaacatgttcctggagattccaattgtgggggggtacnca

SEQ ID NO: 716086 - DNA, 270 bp, Homo sapiens
tgagtgacatcgcttaacctgcgtgcatcctgacgaccgcgtgatgccagggaggcaggcgactggagtccactactccttaggtcatccactatggatgatatcgaatgttcatgtggagcagcaatgtggctccagagtgcagcagtccgatgtcctcgcggaagctgtgtctgatggcagacacatgatcgaagccatccaggcactggaaccaaccagctttgggaactgctgcttattcggggattggccttggttacagagcct

SEQ ID NO: 716087 - DNA, 767 bp, Homo sapiens
  misc_feature (327)..(327): n is a, c, g, or t
  misc_feature (336)..(336): n is a, c, g, or t
caggtttctaccattcggcattgtaggattggtgtaaaatcaccttgtctgtggggccccaagttttgtagttcgcccttagtaagcccgtcctttgctccagtagtaacgtttcgttatacacctcgggcccctgcttgaatgaaagtgtatctttcgcctcgccaatggttgtacttctgcagtattcttatgggctcttcatccgtgatgactgtgctctttcatacaagagggtcctctgtattgtaggttttggtctcatgttcaatggaggaacagtcagatccagaaaggtttcctcattcctcacaccattcaggcttntagggcctntgcagcccatgctggttcccaaccggccattgagtttctcccccccgagtatgttctgcacgcaagatatgttatcaggcaagcgcctggcctttatcttttcatagggctgaatcgtgtcttcacggggtctgtggattcttcccctatccacacaaggccccttttcttgccagatgctatgaaatagcttccgcaatccatccaggtcttttgtggtgtgctcatattcatgtgatgatgctgtggtcagcctctctcttgtgtcgcttcttcacagatctctccagctcgtgccgacatgacttcttgggactgagaagcgccatcttggttccccgctgagatagagtgatcctgatccagtgacagatagagagagagagacagagagagagagagagagagagagagagcgagacagagagagc

SEQ ID NO: 716088 - DNA, 937 bp, Homo sapiens
  misc_feature (52)..(52): n is a, c, g, or t
aacgagcttcgtaacccccacacccgccaacacccccttctaggaaaacttncgagaaggatttaaagctgcgttctcttgctgttgccttggagttaccatcgccaggaggatcggctgggcaggggacgaactagcacagagagccggaagtccttgaccactcaaatcagcaactttgataacatatcaaatgtttctgagcaagttgtgctcactagcgtacgcacactcccagcagccaatggagcaggaccacctgcacactgggagaatgtttggggataggacaaggatacctgagtcaaactatcctttctataatccccgggaacagaaatcttcattatgctatgatgcggaactaaaagcactgcgggatattatttctacccaacgttccgcgtcctgactcagaactcaggcccagatcagaatgggatcccagatttgtcttgaaaagatcgagaataacaaagtgcgcttgcagttagaaaaccgctcgagttcttcgcgacgaagagctgcaccggcggcggatatgtctcccgacatatcgaacacagcaacctacccaccccgcaaacacaagctcgaacccctacctagctaccgcgccgcgccgccaacacgcccctaggcacaatagacaccaactcggtctcacaacacggagccaccgcgtcgagcatcgcgcgggcccggcacgtcgtcgcgctccagcgacacacgcccccgcctctgtctcgaacgacacgctcttgtcaaccgcgcgcgcactgctgtaactacatacccccacacagacaatcacgcatctggcgctggacaccagcgcaaccgccggcgcgcctcggccccgatctcgccacgttaaggccaccccgcgattcattatgctacattaaccggcagcacgcctgcctagacgtatatg

SEQ ID NO: 716089 - DNA, 234 bp, Homo sapiens
atagttgtcataagcacctccggtagcccccaccctggttgccatatccaggtcctccaccaacatatcctcctcttcctcctccataaccggggctacctccacaattgccacctccaggtcctcctccatacccattggagccatccccaaatccacgtccacatgccatatacatcagatcctcatctaaagttacttcctggtcctggtccgagcagcagggacagacac

SEQ ID NO: 716090 - DNA, 265 bp, Homo sapiens
agatgtgcgagaatgacgagaggagaaagagaaaagagaaaacgtggagagaacgatgggagatgagaaagcacaccacgatgggatggagaaaaattcagaaggggcttttatcttagtcagcatatttcttgagctgtggccaacggcaccccctttcagttctgattagttttctcagcatttaaaagctcattggttgttttatctaaaagagtagttcctataaaagaatagtctcacctaaggagtgggagattgttct

SEQ ID NO: 716091 - DNA, 897 bp, Homo sapiens
agggataggcgacgcgtagcatgagtgggtgttgtggtgtctgacgtggtcgcctacatggccgcaccgggtcctggggctgcgccgtggtcttgtgaacgctttctgtgcgggtcgccccttaggggccctctttccgttacggtcccgccggagtctcttcggggcccccggcctttgttcattcccacgggtggtgaggactagtcgttggccccaggcgaaaggttggcgtaccccaaggagccaacgcgcacacgggtggttgttccgagagccgcctcacccggtggggttcgagcctcaatgtccccaccttgtcggagcccggaagtgcggcggaccctgggggttgcagtagccgcgcgagcatgggttctcaacttggggggcattactcaagtctgtttcgcaggcccacgcagagcggagggagatttggttccccaccaggggcgcgccctacctaggtggtctttaagggggcggctcctagaccccacgggcttgggacccgctccggggtgcccagcccccgcgctagacccgggcccatggtttacaagcccactcatagtcctaagtaagtacagcgcgtctcatcttcacaccggggaaagaaacccgctgtaacctccccatgttcgggtcctatgccaacaccaggctcccattcgtaacccccttaaatattaatatagtgcgatcaaatgcccccctatttaagagcacccacagcgtgacgcacaattggggcgaagagagcacaaagtccacatgcgattaatgcttatgttcagggagagctctattttcacgatgcacgaaaaaccaccccccggttgtaaaaaaaaatggggcgaattttttcaacccataaccaaacccaccaaatca

SEQ ID NO: 716092 - DNA, 556 bp, Homo sapiens
  misc_feature (386)..(386): n is a, c, g, or t
tgtgcttttgagacaaggactttggtccctctatgatagtgctaatctagagtggccaggtgctggtggtctcacgcctgttaatccctagacatcttaggagagtgccgatgggtagaagcggatctacactgaggtcagcgagtctttggatgacacagccctggtcgctaaccatggtagatagtcccgtactctactaataatcattataatattggagcccggtcattgattgtggtgggcactctggtaatgcccatgctatcttggagtaggtgctgaaggcacgtgatgaatcactttgaacccacggaggcatcaggttcgcaggtggagtcgtgaagtatcatagctcacggggtcaacttcctagtcgctttggnagctgtagcagagccgagggctactgatattgtaataataatcaatagattgggtgagtgagggggatagattcgaaagttctgttaacgcagctagggatgggaattcttggacaagcattgcacttaaattaaaagtgttggggaggaataattggcttgttattaac

SEQ ID NO: 716093 - DNA, 1151 bp, Homo sapiens
gggacacacacggcatgttatcgcatctggatgtgcaatgtgacagagctccttcaacacaatgccagaaatcaacgaccaaggtggctgaatccacagcaggcagccttgcctgggttctaatcgcgcggacagatatcctgcagcgattcctcaacgtgatgagcttcacacaggccaaacggggaacgtatctatcgagaacccttcttcttcgccctgagatgggcaaaacaccattcgatcacagggccctgaacaagctagcaccagaccagggctattatccaaatggccctgagggatcccctggatattcaacactcacgagataaaacaacaaacgcccataactgcgacattggacacttttccaagaccatcataccagttgagacattaccaaggcaccaagcaactcattacgttggcgatcgagacaaggactactctaaacaatttgccacactaacttaatcaaggcccaaggacccaacgttggcactcgcccacttccaacgacgggtgcccatctgctggatatccactagccccaaatcgcataactgcttgcaacccaaccatgaaagcgaattacaccacttgggatggaggttacatacagtgggcatacaccgtgggcctatcgcaaacagggcaaccaccccatataaattaccccaccaaaacaatccaccaaggacatctcatcacctcagaggcctatttggaacaacaagaacacccacagtacccattggtacgccatacagtatcccaacgaaacacactatggcgcaatagtggcataccccccattcccgacaaacggtgttggagactaacatgagctcactcacaaagatgtacctcccttttgggatgaacaacgccacaccaaaagtattcatcacaggacgaaaaatcatcaattgagacaccgggcgaacttacgaacacgctttcgggccaccaaaccacaaccacgtgctatgaggacgcaccaccaattaaaacttaacggtgaaggcgggcaaacaacggcacacatcggaagattctgagacatgtgtgacaacaactggctcaaacagcaacttatgcacgagcaggcaacattacgtgccggtttacgacagacacattgtggg

SEQ ID NO: 716094 - DNA, 422 bp, Homo sapiens
  misc_feature (14)..(14): n is a, c, g, or t
  misc_feature (27)..(27): n is a, c, g, or t
  misc_feature (151)..(151): n is a, c, g, or t
  misc_feature (161)..(161): n is a, c, g, or t
  misc_feature (188)..(188): n is a, c, g, or t
  misc_feature (237)..(237): n is a, c, g, or t
gaaaacctcccggngttaccagcctcnggaaaaagccctgctgaatttatgttgtaagcattaccttaacacagtataaagatgaaaagacaacaaaaatatccttcatacttccctcatcccctcattggaacaaaaccttaaactgggngaaccttagncccctccctttccccctcccccctccnactccccccttattgtccccttgtaatattcagagagcacttggattanggatcctgaatagagaaatgcttacagataatcattagcccacatacccagtaacttaaagatgggatggagttgtaaagtgcttttataatacaatataattgttaaaggcaagggttgactctttgttttattttgacatggcatgtcctgaaataaatattgattcaatatggcaaaaaaaa

SEQ ID NO: 716095 - DNA, 328 bp, Homo sapiens
aggcccatggcgagcgcgaagtggcctatcccgacggcagcaggaagctggtcaagtccggcgtcagcaccgtgcagaacggcgccgggcagaagaccacccatctgatggcgctcaacacgctcgcgctgcaggtgctggcgaccccggtcgaggccgacgaggtcgagctgcgcttctgcttcacccatgatccggtcgcacccggctcattcgaggagcagatgatcaaggcgcagatcgcgggcacctgcgggcagaccggggtcgaaggcgacatcccgatctgggcgcacaagatccaccgcgtccagccgctcttgtgcga

SEQ ID NO: 716096 - DNA, 913 bp, Homo sapiens
ggaggcttccccgcgccggccgtgtcccgcccgttcgccgggcaccagaagttcctctgcgcgtccacgggcgagcatgggcgtgcccacgggcccggaggccgggagtgtggcgcgggggactccctgctcttcgctctcttcctggctgtgtcgcctaggctccggtggaaggagcttcaagggtcgcgcgacgcgcgtattccgcgtgtatgtctgtcccgaggggcaaaactgtcacccatcatcgcttggcatggactcttgcggcgcactgtgagacaagatcgggcgacgaatgctgaaccgttcgatacagagaacggtgcgtgtaccaagccaagcgtctgcaaggcgagcagatgcgtgtgcacgaccttgcgtcgaagatgcggccagagcccgatgcctgcaaactgcacggtacctcagggaccattgcaacctggccacgcatggcgaaggccaaccaaggcatgccgaacaaccagcctacgaacctggctcatgcgccaggggctggagtcggacaccgaccaccaagggaacaactccaatcaccatgcgcaacctgaccctgctggatagcgggctctactgctgcctggtggtaggagatcaggcaccagcaatcggagcacagggtccatggtgccatggagctggaggtgcagacaggccaaagatgcaccatccaactgtgtggtgtacccatcctcctcccaggagagtgaaaacatcacggctgccagcctggctaagggtgcctggcatcggtaagaatcctctggcttcccctcatcctggtcctgagtctacaaggcaaggcacggagcttcaaacggcgggcccaggaacttggggcacgatggcacggcacttccagggaatgaaaacccggttgaaacctaaa

SEQ ID NO: 716097 - DNA, 359 bp, Homo sapiens
  misc_feature (74)..(74): n is a, c, g, or t
  misc_feature (85)..(85): n is a, c, g, or t
  misc_feature (89)..(89): n is a, c, g, or t
  misc_feature (343)..(343): n is a, c, g, or t
gtagtgatactgtctcactatgttgcccaggctgttctcaatttcctaacctctagccaccatgtttgttggtnaggttttttgngacnctcccaaaacttaactactattattttaccactgaccagcagccttaccaatcccagttgattaacatatattctgtatgttgtgtgtattatttactatactcttatattaaagctagaaaaagaaaatgttattaagaaaaccataaggaagagaaaatatatttactgttcattagggggaagtggagcccagtaaaggttttttgcgtggcatcttcacattgagtaggctaaggaagaggaggaggaanaggaggggttgggctt

SEQ ID NO: 716098 - DNA, 190 bp, Homo sapiens
tttaaaagaaggtcctcgtacataacaagacagcatctgctctccagtggcccgggactggcagcggggacctcaggcaggcaggcaggcaggccgaagcgctcgtgtgaagatcatgtggtttggcgtgagacatgtcatgctgcacagaaaggtggccatgtcactgagcaccgcagctgaaacttca

SEQ ID NO: 716099 - DNA, 616 bp, Homo sapiens
gtatcccctagtcgaacgcagtggaaaattgttacatgaatgaacaatgtatatgtctgccagtatccttgttaggagttacatgccaatatatgtttatattaccttaatttgttctcttcatctataaataaatcttgcctacttctgtccgcagggtaaaattaaggtgattttcttctacaacatgattgagctagcatactctccaggagggaacagacaggcattctgaaaggatgttcggtatttttagagccttttatacatttgtttctgctgttgtgctaatatgctaatgtttatcaaggttgtatttttttccctcccttttctttcttgctgctggcagagcagcattatagagttatgcagcaaactctcctttgggcatttgtcattactacaaagtgttttacatttctttgctccttaaaatatatgctgcttttctgctgaacctaggataaaaagaacaaggcagtatctttgcgaatcttaattctttcgagttagggaaaccgatccagcaacctctctttcacaccttcccattttcccagtgaaactcatattcggtacagctctgtaacttcctgcagtgaaatctataaac

SEQ ID NO: 716100 - DNA, 366 bp, Homo sapiens
aggcccaccccctcatgatgaggaggcatgtgacaggaggaacagaccatcaagggagggctgtgcgttctcccaagggagatatgcttcctggacaccttcctcatcttctgtgcatgctcatgaagttgatgggctgagcactcctgagcttaagcatttgaaaaaacagacgaggagtttccgcctgtaaatattatctgtaaaaccgtgaggctggatgggaaagcccatatctcaggccatggggtctgcgtctcccctcttgaggtgacgctggacaaaagtccccagggtccgccagggggatagcacatggtggatgagtgccacaagcatgccgatgacagccagagcatagtccgg

SEQ ID NO: 716101 - DNA, 854 bp, Homo sapiens
gcacatagtgagaccttgtctgtacaaaaaaataatttaggctgggcgcggtggctcacacctgtaatcccagcactttgggaggccgaggcgggtggatcatgaagtcaggagttcaagaccagtctggccaagatggtaaaaccccatctctactaaaaatacaagcagagaattgcttgaacctgggagggggaggttgcagtgagccgagatcacaccattgcactccagcccgggtgacggtgcaagactgcatctcaaaaaaaaaaaattaaattagctgggcctagtggtggacgcctgtggtctcagttaatcagaggctgacatgggaggatcacttgagcccaggaggtcaacgctgcagtgaggcatgatcataccactgaactccggcttggatgacagagtgagaccctgtctcaaaaaaaaaaaaaaaagaccacccacaattcttatcttaaatagattccaagaccatagtggagtagaacgcacttgaaacttgtctctcatcagtcaacctaccggggagccctggcctttcagatcggggcataaccgaggcactgtcatctgcctgggtgacagcttatcctcatgggtgtaaaagcagagggcgtgactgaatacaaaggcttgccgggtcccagactccgtggacacaactgtgccacccaaaacccaaagattcatcagcagcccctgtcatcacttgacatatgccagacttcgtgaaggaaggaagggcttggggcaccccaagaagggagaacagactcgaggattaccactatggctatcacgccaggcgtcctaagagaggcgtttccagtgtcatagggcacagc

SEQ ID NO: 716102 - DNA, 405 bp, Homo sapiens
tgatctagagctccccctttctacgtctcatcactgtaggacatttgggttggtccaagtcttatgctattgtgaatagtgccgcaataaacatacgtgtgtatgtagtctttatagcaggcatgatatataatcctttgggtatatacccagcaatgggattgctgggtcaaatggtgtttctagttctagatccctgaggaatcaccacactgacttccacaaaggttgaactggtttacagttcccaccaacagtgtaaaagtgtacctatttctccacatcctctccagcacctgttttttcctgactttaaactgattgccattctaactggtgtgagatggtatctcattgtggttgggatttgcatttctctgatggccagtgatgagacgtagaagg

SEQ ID NO: 716103 - DNA, 221 bp, Homo sapiens
  misc_feature (40)..(40): n is a, c, g, or t
  misc_feature (49)..(49): n is a, c, g, or t
cccaggattagataaaaaccacagagtaaaagttggcccnatagtaacntttttgatgtcccaaattggagaggaatcccctcaaatgttcaaaaatataggaatgggtcgggtgtggtgctcatgcctgtaatcccagcactttgggagccaaggcaggaagatcacttgagcccaggagttcaagacccagcctgggcaacacagtgagaccctgactc

SEQ ID NO: 716104 - DNA, 228 bp, Homo sapiens
atctcgaggatcccgtcttacacaggctcggtaggttgtcgcctctacctataaatcttcccactatttagctacatagacgggtgtgctcttttagactgttcttagagtagctcgtctgggtttcgggaggtcttatgctttgggtctccttgcaaaagttatttctacgttaattcattatgccagaaggtatatggggttagtccttgcgtatagttatgcttg

SEQ ID NO: 716105 - DNA, 983 bp, Homo sapiens
  misc_feature (13)..(13): n is a, c, g, or t
  misc_feature (923)..(923): n is a, c, g, or t
ataaaataaaatnaataatagaatatttgaaataatttggggagggaaggaaaggctgctagaataccacctcagaacgattccagtgcctgacacgcatccgctaccatggcagaggtcgctttgggttcatggagaaggtttattcttattattttttgaaaaaccgctccatcatcattcagcaataccaagagcaccaatcatacactgtgtctcttttcctcatttgtgttttgcgtcgtttgatgattcgtattagtatagatggccgattgttagtgtcgagttatgcctctctcttccagtctcgttcacacccggcacgcaagaggcgacgaacacattcaatctgcgaaaaatcatttctagacgccagacgtgcggtcgctaactacgctagatgtgttatattgttgtaaacaaggccacgccaaactccgacacccccgagcatagcacagttcctctcatccattacttcacatgactcgactttaaattctccccacccccccgcactcacctcgcccccgccgccgaccatcacctccgcccctcctccagctttctcacccacccttaccacgccgacaacaaccgcagattcacaggacgcgccgtagctccagtgccaacctccaacgtcatatcgacgcgaccacatgactatcgtagcgcctcgccatcacctgtattcctgattatcacacacctactaacacagcattctctacttataccctaagatctctcccctcttgtccctcacctccctcaccccgcctctaacccgcgcacccctcccgctaactatctcgcctccgacacctacccatcttaacgtcccccccacccacccctactcagcctatcccctcccgcgactcttgtccatcgaatctaccatcgagtctcccttntataattaggatactcactgctgcgagcaccatccatcacactgagtacgccagtcccgt

SEQ ID NO: 716106 - DNA, 2007 bp, Homo sapiens
gggaacctacaactcggtaagttaactaaaatgaatatatctcttgatggcagaactgtctgaaagacaagcacaactaataaccacatatattcactctcttactccaaccttaccgcatcactcgggaaccctacacaaccaaacacaacaacaaaacacacccacacacaccacaaaaaaacaggggcggcgcccctctgctaacagcagatatctctcccgcagaagaggggcgccacaacgcgatagatcacacgcagtatacacacagggctatcacagtgatgagacaaaaaagaagaggagccccacctataacacacgagagagcgccgagacacataatacaccagcgaccacagacgagacgcgagcgcccacgcacagcacaaataacagcaaccaccagccccccacacaacaccgtgacccacacacacaggcagaccaacacaaccgttgagaggcacacaccatccaatcatgaggagagacaaagacgagaaaaccaccatataaaccaatagaacacgtgctgaagaagtagtggtcgacgacaagcacatcacatactgatgcggaacccacaaaacaacaaccgcactcaacaactcaacgagaagagaggacaaatatcaccaccagactgcccactacacataagcgcagcactaacacacaccctctcaaccaaacgccaccgtactgcacaaaccaggcgcgcggattaccaacccacgcgacgtagtaacaacaccaaacacaagaacgagcgcaacacaaactaccagcgccaaacagcgacacaacgcaacactgcccaacacacccaccccactgccgcgacaccaaccacacagcacagccgacctcacagccaccagccctcccatccggccccacccacacacccctgactcaacacacccacgcccccagcgcacgcccccccaccgccagagaaaataaaaaagcagcatccgccgcccggccgccgctccgccatcgaccaaccgcacacaccaccaagactgaccacccacggagcactgcagagccactcacaacagcgacagtatcatagagcggagcccacacacagacggaacatccgagcaaccaagagacacggcgccgcatcactaacgccagcctccacgctcgtgacgaccgtcatcgcacgacagactcgcgcaaaccgggcagagcagacgagcgccaccagagcccaggcgtccgcacacacccagcgcggcgcgcaccgccgcacaccgccgcgcacagcagctaggacccacgcacacgccgagcgctcaggacggccgccagcaccgacgccgagcccgcccacgcacctgctcgcgccgcgcgcgcgtccacagcagcgcccgccagagactagacgagcacacgcgcgcccggcgagccgcacgcgaacaccacggcaatgcggcacaccgcaccacacacagcacaccgcaaccggcgaccgacgcagcagccggcagcgcagcccaacaccacccaccgcacgccgccagccgcggaaggtgcagcaacacacactcacgtgagcggcagcgggcaacaacagacggcacgagaagacagcagcccacgaccaccgctgcacccacagcgcgcgacaccagaagacgagcgacggcacgacacgggactcagagaaagcacaagaaggaagacaaggaccacgcgacgcgagagcagagagaacacccgaggccgacgccgacccagcagctgcgccgcaggaccaccgcggcgccgcgcaagccccaccacacaccaacaagggcccacccaagccacgacgacgcaccgaacagcacccagaccacccctgcacgacgcgcaacacagacacagcggcacagcagcacgacagccgccacgcgacagccgaacggccaaacagcaagagacacacgcacgaacgacacatagcaaccgaccacacgcgccgcacagcccacccgcgagccc

SEQ ID NO: 716107 - DNA, 341 bp, Homo sapiens
gcagggaagctaggaaggaataggacaactgagggtctcgcaggaacaccatcaccggcatgactgccaagtcccaggtctgtctggaagccagcgggaggatcagcatcctgccccctttggtccatcctgtgggctgtggggaccaggcccctctcctcaagcccaaggtagcaaacagtctttcccgttttgtgcagggtcgtaaccagagtgtccatgtagtgctcggattcagtacaggcattcatgttgggctcggtcaatgtcacccttaactcctacgagcctattgagagccccatacccagcttcagctcagcctccccaggtcatgtcca

SEQ ID NO: 716108 - DNA, 518 bp, Homo sapiens
gctcaccagttttacagaaccagcctggtttatgggtgaagaaacaccttctcacagaacttatggggcctaagcgtgtttcagtaaagtactgggcagtttgcctgagggccccagcatgcctaactctcacccagcgtggatatgaagcgaggaaaacctgagctcacagcccaggcagcctcaaggacataggcacaccctcagcagtgtctacaagatgccctggccaccaggcaatccagccatctccctgggtagaatccttcacactgcatgtctgattgcatttttcattttttaattacagccgtagactcatatagactctgactgccaatctaaagcacctagagagtttttttaaattgttaatgttttgctaaattcttaataattatacaaaatcattatgtagaccaatagatattattgaccaagatatagtgatgcttaaaacaaagtcctctgtaatcagtacaacatgttggtagaatttaccctaaatgttaaatatt

SEQ ID NO: 716109 - DNA, 184 bp, Homo sapiens
gtgtatgcgtacaccctttcttgacaaaacctaacttgcgcagaacacaagatgagataggcatggctttatttgtttattttgtatagtataggttttactatttatcttggggctggcctcaggattaaaaaccgggaagggggaaggtgacagcagtcgtttggagcgagcatcccccaaa

SEQ ID NO: 716110 - DNA, 224 bp, Homo sapiens
taagggtcgaaagcagccgctcgcgagtgactgatttcgacttgtagccatcgttcgagatgggtggaaatcggcgaaaagtggcctactctctcaagtcgttttgaagcggatacgactaatttcaactggcctctgctaatgtagatgcgaaaggaaaattatatgaatctcgtagatttacagccggcaattgaatccgtctctgcaagtcttgtggtgac

SEQ ID NO: 716111 - DNA, 309 bp, Homo sapiens
gtagtgtgtagcatcttatccatgtagctggtctctgtgcttgggaacctgcttatcatcctcactatcacctctgattcccacctccacacccccatgtactatttcctctcccacctgtctttttccgatatttgtgtcaactcctccgtagttcccaaagtgctggtgaacatccagacagagagcaaagccatcacttatgcaggctgcatcacccagatgttttttttcctcagcatttgtgtgttaggacaacctcctcctgagtgtgatggcttatgaccgctttgtggccatctgtcaccc

SEQ ID NO: 716112 - DNA, 1321 bp, Homo sapiens
  misc_feature (275)..(275): n is a, c, g, or t
  misc_feature (514)..(514): n is a, c, g, or t
  misc_feature (1066)..(1066): n is a, c, g, or t
gagctggaagatggcggcgtccgtggtctgtcttggccgctaccggcggggcacatgtgctagttgctgcgctcgccgctcgggcggtcccatgctgcggacgcacagctcttggtggatgtactggcagatcttcgtctcagtggcagctccagagttctgttgccggagatcgcagcggttacgtcgtgcatggacaatcgtggctgccgctgtggccttccggatgcatgtcctcttcgtgctccgagctgtcgcagctgcgtggtgaagtngtaggagttgatgcgttggtgcctgaccgttgtttgatgacatgagaacatgaataagtgcgtgtgcgccaaggcatacatgtgcttgtgggatgccactccttgggcttcctccatacgagataacgaaacaagacattcggcgcccttgaccatgtggcgccattgggacgcacaccgatgcgttgcgtatgatgcgatgcgcgcggaagccacatcgtgtgcattggcgccttacnaggtagggactcgtgccaatcgacttgcgatgcaatgttagcgtgagccagtgccagaggggaccggccttagctcaccacaaggtggagttcctttggcgctgaacaccaaggcgtttggtagggcacgcccgtccttgtgggccggtcgcaaccgatcttgtggtcggtccatatacacccttcggttaacccctttgtggggcatatgggaaccgttcggacaacagtaactatcggaagcaacaaagcgagcatcgcgtagaataagttttgatcgctaattgggcgggagggatctagacacccagttgaacctttgagctgctagtgcgtgaagaacgcggaagaagatttttgggccaacgaatgatagaacgttatgcgccccttgggacttcgcaccacaaagggggaaatcttcgccaaggggttcgacacacccaattcctagggctcgccaaaagtccataggtgcgtatggtgggaagctgctacggttgaaggacaagttcgtccaggcgtataagccatttgaaccccacctgtggngaccttgtcgtaacgctgcattggttacacgtggacgcctttggagcactctaagggagaggttccacggccattcaggaacatttcgatgacgtgtggtgggaagccccgactctgttgtaggacgcctcgcgaaacgccagggggaaagccaagggtggttcccatggattgccttcgttccgtgggaaattggcattcagtaagggcagtgggttacttctggagagagcacattggtaatgttctgtagtg

SEQ ID NO: 716113 - DNA, 1091 bp, Homo sapiens
  misc_feature (230)..(230): n is a, c, g, or t
tctcgggctcggtaacgagactgcaccggtatgttttaagaaaatggcagagaaaccagacatgggggaaatcgccagcttcgataaggccatgctgaagaaaacggagtacgcagtgagaagaagcaccctgcgcgaccaaagagaccattgagcaggagaagcggagtgaaatttcctaatgatcctggaggatttccgtacgccccggtccgtcttcgagaccccangtcgtagagtgtggaggaagagccacgctgcaatgatggacacgagccacaatggctgcactgtgaagcctgggtcatctccgcgccgagtgccaccgggcctgtgggtctctgaagggtaccccgccgccccaagtcggcactgtccgaaagtgtctccggttgtggcccggggatagttcataggaaagattgatttgtgatgcaattgatgaagatataatagacgacacctcgtggacaaatagagaaatcagaagagacaccagaaaaaagaacatacacttaaaaacaaagacattaaagggtaattcaaacaaaaaaaaatctcacagggagacgagcgcgggggagggtcctagagatgattgttgcaaggctggatcacagactggagaccaacacgctcggggaggcctatgtagaaaagccgcagaggcgctggccatgataacaagtgggtcacaacaatataatacaccacgcgtttcataccattttggggcgcatggattcaaattccaaagcacgggtgggtatcggaccgaacaatgggcacggcaattcgtaaggaaaccccttgaaaaggacgcgatgggactatccaccacgaaggggagaagattccgtgaacaatatctaggggcgataacataggtacccggaggataccgcaaaagggctcgcccacggggagctagtcttgacacacacttggggaatcgcaaatatgtgtggcgacacagagcgccccatttttattcctatcacagaggcggaaacaaatgcagctcccgggagccgctgattagtggaggattataccgtgcgcatgccatcagccactccagctacaaggag

SEQ ID NO: 716114 - DNA, 347 bp, Homo sapiens
gacaggagcagcagacgagacggcagatcctgagattagctgagtaggagtaagacctgaaattctcctgggaccttggggaaaaccgagatgacaaggagaaattcaagattgaagccaggaggacaggtccaggggatcagtattgggatgctgagaattccaggacaaaagaacagagaagagggagaaggagaagagatgttttttttacagtggaaggaacctctgtaaacagaaggtagatttgattctgcaagtagggagggtttgccggggtaggtaaaaataatgaaaggggccgacacgcccacattttggtgacatttttgaatttcaaaaacaag

SEQ ID NO: 716115 - DNA, 892 bp, Homo sapiens
  misc_feature (24)..(24): n is a, c, g, or t
  misc_feature (38)..(38): n is a, c, g, or t
  misc_feature (96)..(96): n is a, c, g, or t
  misc_feature (139)..(139): n is a, c, g, or t
ctaacaggtgaccaagctcctggnttcagtgccatggnttcatggcattcagtgattagtggtaatggtaaacactggtgtgttttgaagttgaantgtgcgataaaattattagccttaagattggtaagctacgcantgaatgctagggtgggaagctggtgagccagtggccatgtagataaatacctttcaagtgtgagctgtagacgtcaatccatagaaatacttaaccgtaatgctaattgtgatcagttatgaagtcccttcagtcacattaggggtgaagagtagattggcgtagtaagtacgtcagttcttagtccatgtcagtcttaagaaacatcttgggttagccactctgtccactcccagtaggctacagaaaaagtcacaatgcgcatggttgccaaccatatgtgtattactgcgagtgtatttactctatgtctctaggcgcaaaggaaccctaaaaatccttaccattccacaaagttggagccatcgacgttgtgcagcgccactttgactaatgagtatacacaccatattgcatttctgtttgcaccatgtcttccaggagactagactactgtagtccagggtcaatttgagtgtacagaaaatgtagacaaggaattgcccaattgttaaattctgacttgctgacttaatttaagatgctcgttctggaaccaattttctccgtatcttctctaggggttgcaaaagactcagttaattgatttccaggacagtactcatagcaagttcataaaagtgtcttgagagctaaatttcttgacaaaaaagggataagatcttaagtcatacattttaattggtgtagaaggttgttcaactgaaggtaataaatgtctattaaataaaa

SEQ ID NO: 716116 - DNA, 331 bp, Homo sapiens
tgagagatgacacgcacatcaggtctgataagtaaaccttttaacaaactcttctatcatgaccttaaaaaatataggactaaagtcccagcgcgctggctcacgacctgtaatcccagcactttggaggtatctgacggttggaggatagcttgagcccaggagtacaaggccagcctgggcaacatagtgagccccatctctacaacaaattaattacctggctgtggtgacgtgtgcctgtagtcctagctacttgggaggctaaaggtcagaggattgttggagtccaggagttcaaggctgcagtgagctatgatctcaccactat

SEQ ID NO: 716117 - DNA, 196 bp, Homo sapiens
catgcttgcatttcccccacccagcatgctgcctgtccttgtgcatgtgccctgtccctgtcacttgtctgttcccacgttcatctgcctactgtcttggcccatgcccacagccctgtctgggctcagtctggggtggggcatccgtctcagcagtctgcacgtgcctggccatgccctgctttggccacttggc

SEQ ID NO: 716118 - DNA, 654 bp, Homo sapiens
  misc_feature (146)..(146): n is a, c, g, or t
acgccctcataatcattttccttatctgcttcctagtcctgtatgcccttgtcctaacactcacaacaaaactaactaatactaacatctcagacgctcaggaaatagaaaccgtctgaactatcctgcccgccatcatccgtagntcctcatcgccctcccatcccttacgcattcctttacataatcagacgaggtcaaccgagtccctccctttaccactcaacatcaagttgggccaccaactgggtactgaaccctacgacgtacaccgatctacggtcggtactagatcttcaatcgtcctagcatagcttacgccaccattattcctgagaacccaggcgaccatgtcgaactgccttgacagttgacaagtcgagtaagtactcccgacttgaagcccccaattcgtataagtacttaccactcacaaggacgtctgtgcactccatgagctgtcccccacattaaggcttaaaaacacgatgcgagttccccaggacgatcataagaccaaaaccacttatcacccgctatcgacgaaccggggggttatacatacgggtccaatgcgtcttgaaaatccttgggggagccaaaccacaagtttcatggccccatcggtccctagaaatttattccccctgaaaa

SEQ ID NO: 716119 - DNA, 1079 bp, Homo sapiens
ggcggacgcaagaggaggcgcgagggcgcaaccggaagacgagagttgaagaccagggctacactttcctaccagacttgggcctccctttgttctcctgtattcgctggctcccgccctgggtttgtttgtggtgggggtgtagcttgctcctgggtctgcgcccccttttgcggggcctggggccctcggcccccccacgccgagggtgttcccccactcaggagatctcgcgcgtggcccacaatgggtcagaatcaaagggccccatgctcatgtggccggcttccctccggccccccgcgatccccggccgctggagagaaggagtgttgtggcacacagaagtcaaaccagggtgggaccaaagtccggcaagggtataatagttcctgtgtgaaatggttagggctttaataacagtacaaggttctggacttttaatcccacggcatgtccctccgtaacgttttgctgttgtgcacgcaggttctggttatcgctctatccccccggggaatccacccccacgcccggcttccccggagctaatggtatgagcgttccctgaggctcccttaattcggtcacattcagcacttttattgtgcacacctaactaatgtggccgcggcactgttgggatatcccacgatataattgcacttgcggcactggccccaacgcccatgtaaggaaactttaaccgcctatgtgtccgcagggacaccacttataacgcagcaccgcgatgggccggcgcaccgcgtggctctacgcctgtttatcccccgcaccacttgggagcgcccgaggcacaggtggactcacctctgaggtcacacgagctttgacgccacgcctggcccacaccatggtgagaaccccactctccacctataaaaatatgagacaaatttataggcccggccactggtgaacaacagcccgtagtcctaggctacttgggaggctgaggccgcgagaattgcttgaattctcgggaggcccagcgtttccctgagccgagattgtgcccttgccctgccgcctggatgaccgagcgagactctattctc

SEQ ID NO: 716120 - DNA, 296 bp, Homo sapiens
gctcgacatgagtgctgctgcaaggaggggtttccctgagtgacaatcagcacacctgcattcaccgctcggaagagggcctgagctgcatgaataaggatcacggctgtagtcacatctgcaaggaggccccaaggcgagctgtcgcctgtgagtgcaggcctggttttgagctggccaagaaccagagagactgcatcttgtactgcggatggcagctgcactctgggccatcgctagtatcgtcacaggagtgctggcacccaccgttcccatggttacaggtcaagtcgacg

SEQ ID NO: 716121 - DNA, 1972 bp, Homo sapiens
  misc_feature (444)..(444): n is a, c, g, or t
  misc_feature (453)..(453): n is a, c, g, or t
  misc_feature (1666)..(1666): n is a, c, g, or t
tggcaggttaagcattttattaaattaaaaacgggaagggaggggtgccttacccacccctgtgccgtgctggtggcgtcgtgaggggcactccttcaaatttccccaagaaagagaggacgcgttctcgtgacacgtggtgatctctgtgacgggggtttcaaacagaaagagtgtgcctgtggcgccctctcctttcttaagtctctgtggtgtctcaccacaaaagagaggcaacacacacgaacgagagatatctttctctggagattcacaaaatcctgtgggacagagggcagcacttattacctgtggctctcttgagcgccatagagtgtgagagagaggtctctatctcacctctcgcgcgggacaacccaaagagcgatatatgtaacaaagagggggcttcttccaataattatactacaggctgtgtgggcnccgcgagtngataatagcgttggggcaacgcacgtggcgagacaaggtaatcacaacatataagatgaggaagaaatacgatgtgctgcgagaaccccactctcaataatatcatcccccaccgaaggcgtagctcgcccctgctcacccaccagcgaggccgagcgcaacatacgaaacgaagacaccgaatggacggccaccgtgggcgcgacagaaacaacgaggcaccacccgagtggtgacacaacacctggtgggcgatccccacaacaccccgaggtgtagacggcgccaagctagaaagcggcagactaggggcgacaccaaaagacaacgaggctagtggacaacctgccgtgaggcacacccaggagggaaagaccacacacaactaaagaaagcaaccacggcgtgaaacacagcaacgcaatagtggcagacaaagaacgaccgcactagggagcaagccatcctgcgcgaggcgacgaaggcgagccatgaagggacccacccaatcactcaacacaccctaaggtcataacaggaggccgaccacaaagtcgggatagaagcgaaacccccaccccgattcaggccgaccacgctataaaaagtacaaagcgaggtgctgccccacacaaccaacaatcgtccacgacccgcgagaggaacaaaggattacacatataccccacatcacgaagcaagggaacaaaacatgtaggctacccagagagaacacaagacgcactaaacagaggcgggacagtggaggactgcggacacccccccaaaaagagcactagcacatgctgacagcagccacaccacggatggtgtatcgacacagatggcgcacacaccacacggcgggctgccaacccaaagcgagaacaagaggaggaggtgactcacaaccatgtacacactggagcacgaagaacgcaaacgaggggcaaacacaccagagggaccatcacgaaaaaacacccgcgcggaatcacagaagcacgcagaaagcacacacgaaacacgacgaggcgcacatcagcgggcaccgagaaagaggacaccacaccaaggcaaacccacaccggcgtgtgtactgcgtagaagaaacaccaccagtaggaataaaccacagatgagacaatcacaccaacgcaatctaataagcaggggagcagacaatgagacaaaggagcaaccagccaaacanattcactaagaaaacacggtaaggggagacaccacaccagcgagacaacagaggacgagatgcacaacctccacatagcaagcagacaaccagaactatcgcgcaaacacgggcaataatatagtggagaggccccccacgagcgacagagacaaccaagaccacaaaaccgccgccaccacgacgtatagagtgagacaacgcagaacagggatggaaacacgcaacaccaagtcgtgaaaaacaaacacagcgccccaaagatagaagaaagaaaaacaagcagagcaaacaacagcaacgatc

SEQ ID NO: 716122 - DNA, 314 bp, Homo sapiens
tggtgatagacaactaggtcagtttgaggtgtagagcatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 716123 - DNA, 1415 bp, Homo sapiens
  misc_feature (395)..(395): n is a, c, g, or t
gagtggcgcagtcggagccctgttgctggccctgaggaagcgaggagtgctgtctgtgcgtcgtgctgagtgctgggctgtgacctggcgagtgctgatggctgtgctgtgccccagtgccctgatgtgtgactctgtgtgatgctcgatgcatgctgtgctgtgctgtgcaatgaccctctcccccactctgtgatgtgctgtgctgtgtgctgtgatgtgctgtgctgtggatgctgtgtgtgttgcccgccccctgtgtgcactgtgtggccattgtacaactgtgtgatctgtgtgcttgcctgactgcccctgtgtgtgcaagctgtgcaccaagctgtgcatactgtccatgctgcaaaccattgtccactgtgttgcatgtgtgtgcnctgcctgagtgtgttgatgctgtgcctatgactaccaatgtgtgatgatgtgattgtgaacctttgctgtgctgccattgtgacgtgcattgcccttgtgttgacatgctgtgccctcaattcctttgcaccatccattgtgaaccaactgatgcttgcaatgctggctgctgtcttgatgcattgcagattgccgtcggcatgctttggatgtgacgacttgcattgcgcacaggcatcgcacggcgtgttacctgatgggcagaccacgcgcaagactttccatgtgaccaacatatgttgtgcctgagcccttttctggaacttcaattggtttgccttgtgacaggactgctggactttgttcgcaacctcatagcgtgctgtgccacgcctgcgcaggtgacggacccaccacatgtggaacatgatgggcccagctgggtccacctgtgaggaccttcaacccagagtatgggcacgacattcacacattgacgacggacagacattgacactgcacttcctgttggcttgccttttatgggccaaccaagttggatttctttaccgttagcattgggcacggcgctcctttttcggaagtccttcgaggcggctcggagacccccgaagacaagattaagacagagccgaggcgtccttggaggcactacccagaaccttttacaggcctttgtttcccgggaggctctaggccaggttcatccggctcgccaaggcgccaaaagggcaaagagacacacacactacctacagcaccaccaagccaccacaacaacaacagagcagaagacaaacacaacgagccggcaacgaaccacacaaccgagccacccacgaaacgagagagctaaacgacacgggcgcagcacacacgatacacacgagaagaagacagcacaggaatacgacgcaccgcatgagacaatcaccacgggccccacacagacaggcaaaaaaaccaacgagcagggagccgacgaagcacgacacagg

SEQ ID NO: 716124 - DNA, 753 bp, Homo sapiens
tccgaattaagcgtcaattggaacaattacaacttgcggacaaacccaggaaaatgagcaattctagggtccctacccacccggttgaaaaggggtggccccaggggccgaatgcccagccccggagggggccctatcctcctcctttccgcgaaaactctctctcaaacctgtttaggccatctgaacgacaaggcgtcgggctttttgggaggacaagggggatgcccgggtcttacaattcctcaaacgcccaaaaagctgaagggttcgaaaagcaggggggttcatgtccctcgcaggttctgtgtgagaacgcaaattgacaaaacttggtcggtctcgaaacgttgctccctcagcagaactccaggacaacctgtgcaaacgttgtcccttgctccccctcgggaaagcgcgcccgccggggatcttctcgatttgataaaaggctgtgcccgccacacttcacgaaacgtggttccgcccagctacaatgtgcgttgagggcggttctgtggaagaccccctgtgagactgggacggttgagagaaatctcctctcgctactagctcggttgggaacgagtaaagtacccctcgtgtaccatttccagccggaactatctcgagcaggtaagaactataacgtttaccgcctgacaacgcattctgggttgccgccccctcgtgaaccattctcccctcgccccaccccagggacaattcatacgagggggttgtgctgtgaag

SEQ ID NO: 716125 - DNA, 245 bp, Homo sapiens
ctctgcttctgccaggatcttggtgaggagtaagtgagacaatgcatgtggagcataacaccgtgtctggcccagaattcatgcttgtagaatggttgcagctcttcttaattattacatgatagcacatagatgccacacggctgcggcgagtggcaatagggccacttgaggctcactcactagctgcttcctgcttctgccagctgacatttaaaatctgtttttaggcaggctctggtgag

SEQ ID NO: 716126 - DNA, 439 bp, Homo sapiens
gcagctgagctcccaaagtgctgggattacagatgtgacacgtgcccggcaacagatgctatcattcttaggattaagacaggctgaggagtttgcccagccgtctgttggtggtattggggtcgtattcctcgctcctctccagttcactgcctttagaagctgctttcaaagaagacggctttcaggacaaggcatcacacttcttctccagcacgtacagtcctgaaacctccaggaggaagctgccccaaggtttcctgtgtcccaagcttgctgggaactcctcatccttccattcaccctattctcaatatccctgcccctccaatcccttggcatacttgacttagccttggccaccctggctagggacattgatcaggaaggagtacagcgtatagaatcatagaggaattgaaaggaactttggaatata

SEQ ID NO: 716127 - DNA, 499 bp, Homo sapiens
gagaatggaggtaaagtgtctggatctgggagctcgttaactatgctgggaaacggtccaaaagaatcagaatttgaggtgtaattgtatacatatatattatttcaagatggacagatctatggagataattatcttaccatcaaatagatgagaaaaaataaaaaccagaaaggagaaatgaatgtaaataaaaaactcataaaggaagaagcagaagaaggaaagagcatgaatcatatctattataaattaaacaaaacaaatagaacaaacagaaaagacaaggaaagagaaatatgaaacaaaaaataacaaaagggaatataaagaaataaaaaaataaagagaaaatggaaaggaagatatgaaatatagaaatccaaaaagatgaataaaaaataaatgataaataaaaacatgatgaggaacaagatcttaaatgaaaatggagaagaaaaaaaaaaataacaaagcaaaataaaatcaaaatttatat

SEQ ID NO: 716128 - DNA, 179 bp, Homo sapiens
  misc_feature (41)..(41): n is a, c, g, or t
  misc_feature (49)..(49): n is a, c, g, or t
  misc_feature (107)..(107): n is a, c, g, or t
  misc_feature (129)..(129): n is a, c, g, or t
tgtaccaggccccatagatatagatttgtaatgtttttaanggctgtanagttttgcattatacctgaatcttgatgtttaagagctatgtatattgaggacattanttctttgtcttgtgttgcaaantttttaccatgttattattagtcttttaaccttatttatagtttttttgt

SEQ ID NO: 716129 - DNA, 181 bp, Homo sapiens
caatccaacagtagactaaaaaaatcaacttgagctaacatctaaatatagatagcacagccagagctaccaaaatgaatactggattctagcaaataactaactacagtaatttgcattgtaaacaggaacatactcacttggacattttcagtagcaacattgctcaacacggaaggag

SEQ ID NO: 716130 - DNA, 362 bp, Homo sapiens
  misc_feature (115)..(115): n is a, c, g, or t
cctctttgtcatcaatgtgtatgctctgtccccatccttcactcctcctcaagctcacaccaattggtttggcacaggcacagagctggtccctagttaagtggcatttatgttncaaaaggggagttcccaatttcggccatttatgtgtgtggcccagcggtttctccaccgaaatttggtccctggttttttagcccgccacacaaagagggaggtccccggcgggtgttttaaaaggtcttattggggggcacaacgcgttttgggcttttcccaccggggggggtgttttctggatatgttgtttccaccggttttcccaaaattatttgtttgaggcccgggggtgggctgttaga

SEQ ID NO: 716131 - DNA, 289 bp, Homo sapiens
accaacattaagtgacgaagaacaacttccatctatatcatcataaaaatgtttaagtaaaataaaaaaagaaaaagaaagaacaagaggaggtaacgggggtccccgatggaacaaaatcctcacatttcatctattacagtctcaatctctggactcacagtataaccaacagtgttaaacaggcattactactatatacataaacttcccactaacagttcacgctgtaacactacctaatgttcccatgtccccacccctaccccctcccagttgcttccacagt

SEQ ID NO: 716132 - DNA, 1066 bp, Homo sapiens
  misc_feature (501)..(501): n is a, c, g, or t
tgccacctccacctctcgggttcaagagattctcctgactcagcctcctgagtagctgggaatataggcgcccaccaccatgcccagctgtaatatttgtatttttagtagagacaagaatttcaccatgttggccaggatggtggtttcaatctcttcacctcgtgatctgcccaccttggcctcccaaagtgctgggtttacaggtgtgagccactgcgcccagccaacattaacttttaaaagatgtagtagaagctgtgcctagaggaacatttatttctttatattaggaaaggagaaaggttagaaatcagtggtccaaacatctttctcaagaaattagaaaaacaacaccaaattaaacctaacgaaaaaggaaataataaaagcaaaaattaatgatgtagaaagtacacattagtgagatattcagcaatgtcaggtggttcttagactaatgagggctggacctggtgtctcacgcctgtagtcccagcngttgggagtccgaggtgggtggatcacttgaggtcaggagttgagatcagcctgaccaaaatggtgaaaccccatctctactaaaaataccaaaaattagccggctgtgctggcacccatttgtaaccccagctacttgggaggctgaggcaggagaatcgcttgagcctgggatatggaggttgcagtgagtcaagatcttgccactgcactccagcctgggtgacagaaggagactccatctcaaaaaacaaacaaaaaaaaaaaaaaaaaaaactttttgggggcgcctctgggcccttcgagaaaaagtctttaaaacacacattcggtggggcaacgagggggcccaagtagtcagaagacgacgcacgttggggcaacagcggggtccccaaaggaaacaccgggggcagcagcaaaggtcgcggggtccccgccgaataaaacaagcgcgggggggacaccagagccggtgtcgaacaaacacaaagtggacgccggagagcgctacagggagtctacaagggaggcccaagcagagtgaataaattaccgcggcagg

SEQ ID NO: 716133 - DNA, 588 bp, Homo sapiens
aggagaggctgagatggaaggatagtttgagttgaagagtaagagagcagcctaggcaacatagacccgaactctaccaaaaattgaaaaataagccaggcatgatggtgtgcacctgcggtcccagctacttgggaggctgaggtgggaagatcacttgagcctgagaggtcgaggcagcagtgagccgtgatcatgcccctgcactcgagcctaggtgacagagagaaagaaaccccagtctcaaaaacaaaacaaaacaaaacaaaacagccatattggttcagggaagcagaactcaaagaaaacagagaatctgaaacaaatctcatagctgcagaagttgcagaagaatagaaatgacaaaaaattaagtgttgaaataaatgtctttccatatatggggaaaaatagaactagattcctatcttatactatatataaaattaattccagatataccaaagacccagttctgaaatactttaaaactttaaagctattaagaagactcaggagaatatctttataaaaggctcaaaggcggggaagattaaagggggaagaacatcatagaccggggcagta

SEQ ID NO: 716134 - DNA, 626 bp, Homo sapiens
  misc_feature (54)..(54): n is a, c, g, or t
  misc_feature (69)..(69): n is a, c, g, or t
  misc_feature (82)..(84): n is a, c, g, or t
  misc_feature (103)..(103): n is a, c, g, or t
  misc_feature (149)..(149): n is a, c, g, or t
  misc_feature (244)..(244): n is a, c, g, or t
  misc_feature (253)..(253): n is a, c, g, or t
  misc_feature (389)..(389): n is a, c, g, or t
  misc_feature (399)..(399): n is a, c, g, or t
  misc_feature (401)..(401): n is a, c, g, or t
  misc_feature (478)..(478): n is a, c, g, or t
  misc_feature (598)..(598): n is a, c, g, or t
gcctactatgtgcaaggaatgtactagacccccccagaagaaaaaacaaaaaanaagaaagaggcagcnaaaacaaatactnnnggagaggaaaggggcagtngagtaagagggctaagggaactgagaagcctgaggtgatgggggcnctgccttaggccttctcttcggcctcctcaccgaaatcctcctcctctcctgcggtggcatcctggtactgctgaaactcagagacgaggtcgtncatgttgcnctaagcctcggtgaactccatctggtccatgccctcgcctgttttccagtggaggaaggccttccggcggaacagggcagttaactgctccgagaagcgcttaaagagctcctggatggctgttctattgccaatnaaggtgactncnatcttgaggccacgaggtgggatgttacaaaaggctgttttgacatttttggggatccatttcacaaagtagctgcngtccttgtcctgcacgttaagcatcttctcatcgacctccttcatggacatccgaccacggaagatagcggccacggtgaggtatcggccgtggcgggggttacaggcagccataaagtncttggcatcgaagacctgctgggtgagt

SEQ ID NO: 716135 - DNA, 975 bp, Homo sapiens
tctgtcaaaaatcagttgactgtaaatgcatggattcacttccgggctctctattctgtttcattggtctgtttgtttttatgccaataccatgctgttttgattattatagctttatagtatattttgaagttaggtagtgtattgtctccagctttgttctttttgcttaagattgcttaggctatttaggggtctttgtggccattactgacagttaaaatggccctggctcatgtctcctgggcctctacagtactttaggtggggaagtactgtggcccacatgtcccaacaggctgtgtgtggcacctgacagtgctttgtgccactgtggagcaggtgttactccctcatacgaattttaggattattttatttatttcagtgaaaaatgtcaatgaaattttgatagggattgcattgaatctgtagattgtttggggttgtatggacattttaacaatattaattcttccaattcatgaacatgggatgtcttttttttggcacctgatctcagatatgggacagctttctaattatttgtatcttcaatttctttcacaaatgttttatagttttcagcatacagatctttcacttccttggttggatttatttgcaagtattttttgtagctattgtaaatgacattgttttcttgatttctttgttagggtatagaaatgctacagattgttgtatgttaattttatatcctgcaactttactggatttcatttattctaacatcttatcggtggaatctttagggttttctataagatcatgtcatctgtaaacagggacaatttaagttcttcctttccaattgtggataccttttatttcttcctcttgctaattatttgtggtgagggcaacttgtggggttgcggaggaggaaaggctggtctaggggtacggttgctgggttccagcacacagtcacagatattgaggcagaagaaa

SEQ ID NO: 716136 - DNA, 137 bp, Homo sapiens
aggatccccccctaattgctgttttggtgtcacaaaatgaaatgaaatattttatcctttggcaaataagacccgtacaccaaacttcattttacatgatgtccagaattagaactcaaacactttgatttattcct

SEQ ID NO: 716137 - DNA, 154 bp, Homo sapiens
caagcggagatgctgtgagactgatgttgccagctgatggtatatcgctgaaggcgaactcagccaggttgggaggtgatcttgttgaagcgttgggtgatcctgatcatggtgggatgtatctgtcttctgggcagcatctccgctttggaaa

SEQ ID NO: 716138 - DNA, 702 bp, Homo sapiens
tgttcctcatccgcctccttgttcgcagctgccgcctccgccgcgcgctcctccgccggcgcggactccggcagctttatcgccatgagtccctgagactctacgctttcttttgaatcccctgcatcggatcaccggcgtgcccacaccaagtgtcgagacagcagcccgtagacgaccagctccgaaatcaccaccaaggacttaaaggagaagacaggcaagttgctggacagcacggcaggatatacatggcaaggagacgcccctgcataacgggcaatgctcaccatgcatgggcacccaatgggggcaagcccaagcgccagcgtctttggcaaccacactgtgccagcgtaaggcaccgccacaggcacaacgcagggccacagcacaagcggtagcgcgcgcacgggcacagccaaggcaaggcagcgcacagcacaccacagcgtcgcatgcgtgcaggcgggaccaatggcaaacgccggaccaccttggcgggggcaaacgcacaaactttcgggaacacacggggaaaccactttcggcaacctggtggcgaaacacacgaggcgcccgattagggaatacggagctttcccaaacaggcacccctattcaacccccctagggcaagcgacccaacaaaggtcacggtggcgacacaacgggccacttgggcacaacggacaagtagga

SEQ ID NO: 716139 - DNA, 102 bp, Homo sapiens
atgcagccaaaacccgggtttccccaggttagaggtaggtttgaagtgagggctgtgtcactgtggtattatgattcgttgggggtaagactacggtatggc

SEQ ID NO: 716140 - DNA, 1213 bp, Homo sapiens
cctactcctcattgtacccattctaatcgcaatggcattcctaatgcttaccgaacgaaaagattctaggctatatacgaactatcgcaaaggccccaagcgttgtaggcccctacgggctactacaacccgttcgctgacgccagtaacaactcttcagccaaagagccccgtaaaacccgccacagtctaccatcaccctctacatcaccgccccgaccttagcatctcacgcatcgggtcttcgtacttgatgagcccccactccccaatacccgaagccccctggtcaacgttgcgaagcttgagggctcctatttattcgtatgccagccatctagcctagccagtttattcaactccgtctggatcagcggatgtagctactcgaacatctcacatactacggcgcctgtagtcgcgcgctactgcggtagtcagtagcccacaaactacagctcaatatgacagtcacactctacgtcatcagttcctatctatcgaagcattacataactacagtgggcctccctgttgaagccgtgcgtcctaacgccttagtcaggaatcgacgaaagaacatccgtccgtggatgcacgtccgtgcccatgcatttgacccttttcgcctactacctatggactacagcctccaaaacgtacgctagagaccaggcggaaaccccacggcgacactacgcccgaagcgggaagtgcccgacactagcacaccaggcctacaacatccgaatccagccgcaaggcccccttcggccacctactcccacaaccacgcccgaagtaccatcgcaacagataccccactcacccaaaacgccgaaaaccactaacgcaggcatcggaggaacaaccacaacgacgcccgctccccggaacccacaacagcacatccgcgacgcaaacccacccctaaccacccggacaaccgtcaatccgacagataacccggatacgccccaccatcgtacccccgccaataaaaaccgaccgagcccccccggacatgactacggctccccacccgcaacacacaaaacccacacgcccaccaaaaaagggcgccgccatccccacggaaacgagcccacacaaaccaacacgaccaccaaaactacacacacacacgacaccgcccagaccacccgccacaacccccccaccacaccccacatcgcgcaccaacaacgaacca

SEQ ID NO: 716141 - DNA, 418 bp, Homo sapiens
cccaggttcacgccattctcttgccttagcctcccgagtagctgcgcccgccaccacacctggctaatttttttgtatttttagtagagatggggtttcaccgtcttagccaggatggtctcgatatcctgagcttgtgatccgcctgcctgggcctcccaaagtgctgggataacaggcgtgagccaccgcgcctggccgactctgaggttttcttgaaactcctattttatgagttgatagaggtggttatggggctgggttaggaaggtcgttgtgaccttgaactcctttatgggttgatttgccaattgatcccagtgggattgacagtgcatttggggcttgatggattctgctgcactggctcacgtggacttggggacacaggcgtagtggcctctggccttgtgtgcct

SEQ ID NO: 716142 - DNA, 354 bp, Homo sapiens
tgcctgagactggctttccgtactacgttgaataacagtggtggaagtgagcatccttatgtgttctagatcttagaggaaaggctttcagtttttccccattcggcatgatactagggtatagaaggtatgttccttctatacccactttttttagagttttcatcatgaagggctgttgaatttctccttttttctagtttgagtgttcaaatgatgattttaaatgtggaaaattctgtgtttcctttccttatttcttattctccctatgacccccgctgtccccgccaaggccatagctttttacatgatgtaacaaatacttgctgaagaaagcacccatgacttcag

SEQ ID NO: 716143 - DNA, 192 bp, Homo sapiens
cggcccctgcttgtgtcgctaacaatctacacacaagtctccatgcaggacgaatgggcctgagcatgagcgtggtgactgcacactggatttggaatgcaatgcagctccatccactttctctcagcaagacgactaactctagagccagatactctaaaaagcgccctgtaaagtcccatgtgcttatgg

SEQ ID NO: 716144 - DNA, 255 bp, Homo sapiens
gcgccagacacaggtgtcgtgaaactaccctaaagccaaatggaaggaaagactcatatcaaccattgtcgtcattggaccacgtggattcgggccaagtccaccactactggccatctgattctataaatgcggtggcatcgccaaaagaaccattgaaaaattttggggaaggaggctgctgagaatgggaaagggctcctccaaggatgccttgggcttgggtaaactaaaagctgaccttcacgttgggat

SEQ ID NO: 716145 - DNA, 358 bp, Homo sapiens
  misc_feature (358)..(358): n is a, c, g, or t
gtaacctgtatttcccttctttttctctttagctcggcttattccagcggtgagtttcgccgagatgctcacaggagtgaggtcgctcatgggtttaaagattcgggagtacataatttcacagccttggtgttgatctgcctttgctcagtatcttcacctgatgaccatttgaagatcatgtaacattagtgaatgaagttactgaatttgcaaatacatgtgttgctgatgagtcacctgctctcttcgggaaacctatggcgacacggctgactgctgtgcaatgcgggaccctgttacagatgtgctccttgtcacacacagatgacagccgcctcccccgattggtgagccn

SEQ ID NO: 716146 - DNA, 801 bp, Homo sapiens
cgctcagctcagcccgagcctaacccagttctccccacgctttccataggaatctatggggttggcaagagccggcctgctatcccccagccgctggccgtcaactcagaccacaccccagatggagccacgcaggaccatacgcctggtgtgggcaaatggcaatcgtctatgacactggaggcctcgatcatcaaagggaagactaccatgccgagtggatgaacgcgagactgctggtgggtaggctgcgagcctgtccttggagggccttcaggagccgcaatcaagcaagggtttcaaagacaagcctccacgctagtgcttcgtgcttgtgactgacgaatctcgcgtggggcccaaatgcgaacaaggaccaagaatgacattccgacctgctgtactcatgggtaacatgacggtgtgaaatcaacaagcacggattgccgaggggcaggcgtggttgctggcagactgggcgtgtccatagtgcattgcaaggaccatgggggccgacagtcaatccatgggacattggccactccatgaccggggcatcaagggcagttgccatcatgggaagttaaccacagccgcggtgcttcaccaaacagacgctgagctggagaggcgctgccttgtagtagacgcgcgggcagagacagtgtaggggcgacctggtgctaacccgctggtctaactagccaccgagctgccacttcagcgacgttcagcctcagcttgttggcgtacattgaagaagtacagtaggaggaccgagacaacaagccccagctcccg

SEQ ID NO: 716147 - DNA, 117 bp, Homo sapiens
gactgcacgttcagtggtgggcaggtgctggcagcacacctctttgttctctgggcattggctccagcggagttgaaaaatgccaccatggcctcccggctctccaggtcccctggg

SEQ ID NO: 716148 - DNA, 555 bp, Homo sapiens
tcggcgtgaaatgcgggaacacgggaatcacgtgttcctgggtaagaggtaggtcatatataacgggagaatccaggttatagttgaattataaatccaacagaacagtattaaaaactcgggcatatgtatccacatatttactattcccagcactcttcaattcttcctacggattcaaattaatatctggcgttacttcctttcagcctaaatctcgttgataactctaagactgtattcaactctgagataaaaatacaagttcacttttttgttattcatatgctatacatagacatgtagttatagtaagccagagatattagacttagcttcatttattttttgttgttgctggagaaaactgattttttttgcatacatgtatggtaggcagaaggagctgagtaggtctctacatccatactataaagaagctgctaaaatgtaatacaatcataagtaaaatcatgctaataaactatatctatgcagtccagacaccacagtatatgagggacactgataacctatagtacataagaattatac

SEQ ID NO: 716149 - DNA, 485 bp, Homo sapiens
cacaagtgtcataccagctgtgcagagcgcagcacacaaaatgaactctgtcagctttctgagagtaagctctatcaaactatgtcatgcggacatgagatggaggctcacatattgtaagactcctggaggcgcagaacgtcctctgagttcgatgctgccccagcctgaggcgtagcaggtggtccccagtgctggctcctgggtgggcaggcccaggaccttcacaacatctgtgatcttggcaggctctgacaggcggagcagcatgaggtcatggctggagtctgcatctggtctaaggctttgatgcttcagaaggctcatattgtagagcgggtgtgggaagctgtggctgacagggaccctctggcctgtgtcttcaggctcaaacaggttgtgccgacccagccagacctggctattcctggggaggaagggggtggatgcatgaggagagagaaaatggggaaagggatggatcg

SEQ ID NO: 716150 - DNA, 475 bp, Homo sapiens
  misc_feature (58)..(58): n is a, c, g, or t
cacgaggcggctggaggcgcggctctcggtgcggcctgagctcatggccaccaacggntttctccacgcggcgacggtgatcgccctggcggacacctcctgcggctacgcgaccctggcccacctgccggagggggcgagcagcttcaccaccatcgagctcaaggccaacctcctgggcacggtgcgggaggggggcatccgctcggtcgcccaggcccagcacctgggcaagagcacccaggtgtgggacgcggtggtgaccgatgagggcaccgggcgcaagatcgcgctcttccgctgcaccgagatgatcctctacccgaaggaatagcggtagggtgcgtagagcgaagcgaaacgcaccgaggggcgccggtcgacggtgcgccctgccgcggaagcaatcctgagtcaggtttgaggctcggtgctcgccatggaggggctagcgtcttggaccgactatacccgg

SEQ ID NO: 716151 - DNA, 955 bp, Homo sapiens
  misc_feature (638)..(638): n is a, c, g, or t
actaactattgaatttaattgttgaactagtcctaattaatcgatacacgcatgtagtatgtgtcacgaagataattcacataaggcaatcatgatagtctatagcaacagacttacgtaggattatcactagtccattggattacagtagtcagctgtgtccttccacactaacaagctagaagccggacatcactatactactaaaacaatacgttcataactgtacgtacagaactcagtgtacatttagtggcctaaaagtggtagaaccaccgctgtgttactggtgctaagattgactaatcttagtctaagaatattcatgaaatggtatcattgaggtcctctatgattgtaatgggttattccttgtgtaacagctcattactcagcggtatcacatctcagatcgcttcctcacgtcgcgcaacgcatccttctcaagacaacacataataatagtaatccatgtcgcaagtttgcatcatcgttgcatatatttgatgcaatgccattgttcggtgttcctatacggtggcataagataattgcatcgtagctacctttgctttaccatggtcagcaatcattgtgcataccacagacgttagcatgactactcgtccgctcctggnctcgtccattgggaacggagacgtgactccaagatgaaaccacgcaagaggaggcgcacatttagtaataaattatgtccatttctacatcgaaccacattgatataatacaaggtagtactcctagctagtgttaatacgggctcatactggatcgcgcactgtgcattataccgcgagatgatggtcctgttggccgtttaatgtggtatcactgaattcacacacccgactagtgaaggtggccattgtcactttgtccacatttcgggtacacttattcccatgaatcaaccgcgttagctcacaaaggctcc

SEQ ID NO: 716152 - DNA, 530 bp, Homo sapiens
cctacgcgttattttctttgcactgactatctattatctggatatacccgggttatattgtccatttacttactgaaggacatctaaggttgctccctagtataggcaatcgtgaataaagctgctataaacaccaaacatctgtgtgcgtgtcttttgtgtggacataatttttcagttcgtaggggtaaatcgcaaggaacacagttgctggatcatatagtaagaatacctttatttttgcaagaaacctctaaactgtctttcacagtgatggtaccattttatattcccaccagtcatgaatgggagtttctgttcaccttctcaccagtcatttgatattgttcattgttaatgggtttaggccattctattaggtgtgtagtgctatcgtttttaattggcattttcctgatactgtcacttttttctcatatgcatattctccatctttatatcttctatagtgaggtgtccgttaaggtcattgtcctgttcttaaagtctggttcttcgtttacttattg

SEQ ID NO: 716153 - DNA, 264 bp, Homo sapiens
tctacaaaaaaaaaaaaaatcaaaaaattagcggggtacgggggcatacacctgtggtcccagctactggggaggctaacgtaggaggatcactgggagaccaggaagtggaggctacagggagccaggatctgggtcacggctctccagctcggggcaactacagtgagaccccatcgtcaaaaaaaaaaacacgagagaaaaaacgaaaaacacccaatatcaaaacccagaagggaaacctcggaaatcccacaaaagaag

SEQ ID NO: 716154 - DNA, 1920 bp, Homo sapiens
gtggcacagtgcggtcactgcaggtgctcaggaggcggctcctcggatggctgaacgggtgagtggaaccacccctagtcggcacgagcgcccgctaggcgtacccattgtaactctcatttggctgcatgcctatccggtatgtacatctcgcagcgccaacaggatataagagaaaaataatagcgatcatacgcctatctgtgctcatctcatattcatcattagtttggcgtgcttataagtgcagggccatacagcatatattgaatgctacagttcaccatatgtgatgccctaactaacctggcgcactgattactgagcttgtaatatgtgtgtgctacttaagccacagcgatatgctcaatatacccacgaatagacactctctatactagctaaagctacgcacgtgaaattgtgcctctaaaaggtgtgctgaacctcctaaagcttcagagaggaccccttaaaacgcgagggcgaatcttatcacgtgcatctgccatatgatcccccaaagaaaacgatgtgacagaggccggtgggaataaagctacaaatcataatacacgtcgtcgagaagtcgacgagtctcaacttcttataggcgccgaatggcgcgtagaggcaccccccacgagagggcgccacacgtgaagtattatctagtagcaacaacgttgcggtgtatatgagcagcgaagagtgtgacaaacgcaggcaacacagcccagaagacgcacgcccatgaatactaccccgactaaaccaaagggcgcctcgtgtcgccaagaagagagcagcgcctcgtagtcaccccacgagtagtgtgcgccacgaccaggcgatgacgggatatggagagataaccacccgggacatgcacgaggagagatgtacttcccccccccacaaggaaaggcacaccaccaagggaggctatgtagggatgtgttccccccctcttaaacgtatacatacctataatacaccacgtattaagaccagtccctctgaggctaggaacacttcggcctttcggagcgccaacactcatatacggacaattacctttaagaacatccacagagggggggcagccgacaggataatacgacccaacttcatactatcacaaggatcacacggatatttggatcacacacacacagcacatacagaataggatacacaaatcaccactcgaagacgagcccacattgttcctacagaacagcaaagaatgcagacaccaaactcctttttgtggccacatcaaacctgctccaacgttgtaaacctcaacactagttcatctcgtcacccttgatcacatctaaacacacccgaacgcagtcatccatgtatccacaacacgccagacaagtcaacaccaccaacccacgagacagaatccaactgatcgtgtcaacacgacacagaaacagagcaccccgcccaaccacaacagactcgctcaaatcgaccagcgcgcgcaaacacaaagaacgccatccatcgggccacacacgcctatgcaactcaaaacgagaacacatagaacgaagaacagctagcaaacacgacaaccgaaaggcaggatagacagtgagagcacaacagagcgtgagacaagtagatagcatacaaagatatgtagtcaacagacggccaatcaaacagaataacagcccaaaccagacccgaatgcgcgatccgaagccagcacacgaagcaagacaagatcgatcagagacactcgctacacggcaacagcgcgaacgacgacaaacgagagcatcgacacgcacgcaccgagcagagcacgatgagacgatccaacgagacacacaacgcagccaacagatacgcacacagactcagatccgacagaacaccacaccacagaattaa

SEQ ID NO: 716155 - DNA, 123 bp, Homo sapiens
tcatcatcatcatggatttgctggtgcagtacaactaggcttaatagggactcgaattcgagcgaattcaagcttctaacgttagaagcttgaattcgagcagtagtagtagtaggcggccgc

SEQ ID NO: 716156 - DNA, 171 bp, Homo sapiens
tcatcatcatcatggatttgctggtgcagtacaactaggcttaatagggatttggatttgctggtgcagtacaactaggcttaatagggaaattcaagcttctaacgttagaagcttgaattcgagacgttagaagcttgaattcgagcagtagtagtagtaggcggccgc

SEQ ID NO: 716157 - DNA, 817 bp, Homo sapiens
tggtatagcatttcaaggtctatgctctaacacgcaaccgcgcccaactgtggccggtacacaacaatccacttttctgataggactcgctaatccactgtctgaagtctcagctaagaagactccaaggcctggtctccaggctggaactgcctggggctatctccaccacacaacacactggtaccttggctggaccaccagcaggcttctacatgccccgtgtttctctcacagatttgtcagcttgggctgatttgaggattgctcacagaagtatcagccaagatcccaagatcaagtatccgaaagagaacaccaggtgggacttatatgttcctttgtatggccgagtcactggaatatgtggcatctctctgtccatagtcacagagggaagaaacagatggcatctctcagatgggcgaaccagaatgtatatggttaaaagaacacatgggatggaacaggttgccaccatcgttggcagtacacttaataaagtctgccatgggccgggtgtcggtggctcacgcctgtaatcccagcactttgggtggcagaggcgggcggatcacgaggtcaggagatcgagaccatcctggctaaaagcggtgaaaccccgtctcatactaaaaatacaaaaaaattagccgggcgtggtagcgggcgccaagtagtcccagcaactcgggaggctgaggcaggagaatggcgtgaacccaggagtaggagctcgcagtgagccgagagtggggcagcaaaataaaacgacccgggggggatgctcttgggcaagccaatgagcaaggctcgt

SEQ ID NO: 716158 - DNA, 298 bp, Homo sapiens
ggtccgctggccacccagctgagaggagaggcgcccccggggacgcactgagattatgaggctctggtcctccactggccactcactcgtgaccctttccatccacggcggagccttccaaggcctacctcctgccgtgtggtgatctacctgcatctggtaaatgtcgcgcagggacaccgtgcgatgatactgaatcggcagtggtcacaagaaagagacatcacgtaacgtggagacggacagaaggaccaagatgaaaagcagtggacatccatgacccgatgaaagtacacca

SEQ ID NO: 716159 - DNA, 155 bp, Homo sapiens
tgacaataatggccaagggtgcctgcctgactgtaggggcccccaacccaacccctgccccaaaagtgccccgccaaccttgggatttactttttaaacaaatttcctttaaactgtttcaggccgcctgcggattaaaatggggggggctgtga

SEQ ID NO: 716160 - DNA, 876 bp, Homo sapiens
  misc_feature (1)..(1): n is a, c, g, or t
  misc_feature (207)..(207): n is a, c, g, or t
ngttctgtatctcttatgttgtcggtgtttggttgctcgcctacgtttggtgtcgccgtgctatatgtgtggtggttgttttgcgcgtctctgcttgttttctgcggttggtgtgcgtggcctcccgcttagtttgtcttgttaattcctctccgctagacaggcgctggtgctgctgcgcaacgcgtctgtttgtccgccggtaancgccgtttgcggggaaagcccggttcgtcgcccctcccgcggtgttaaacccccgcccccggtagttttgtttatccctctcccatatttgggcccttgcttccccccacccgaggaccctgggtcccccgagttctcttgtcggtgggaatactcgcgccccccatatatttttgtgttgtgcgccacccctttttccggggttttcccttgtgcgcgggtcccgcgagaactatttcccccgggatgttctgcgcccctttcttccgcccgctggggcgcctgcttattgggccgtcgccaaaccccccctggtggtcctcttggatacgcccgatcacgcccctccttacgtgtaggttgtagccgcctcgtcgtggtgccctgggaatccttgtacccccccacccgttggtggtcagccgtcagccccctccgttcctctcgggtcgtcatttttcgctgttcttcccccccccgcccgcggtaaaagggcgcgggcagcatgcccccgcgccggttttgacagctgcttcttttctggattgtgccatttccattatgcatatctcctcctgccggggtcgtgtataaagggcctctacccccccttttttaatttcccccccaatgttccccccccccttttccccccccccccaaaaaaaa

SEQ ID NO: 716161 - DNA, 185 bp, Homo sapiens
cttgtcttccacaacctgagctatgtattgccatctctgccaggcttcgagctagtgcgcagttatagcgaaagtgctgaaaaccgtggctctagggaggtcaagacttgtgtcttagggttagggtgtcatgcattgtacttcttccattgacccaaagttcaggtgattcactgctcccacta

SEQ ID NO: 716162 - DNA, 552 bp, Homo sapiens
attgtatcagaatggtggacatcactgcatcgagctctcccctcccccacccgccagccaggcgccccagagaggaccagagcagccctgagcaacgcaaagcgcaggtgcacaccttccatctacagcctcgtgccggacgggacctgtaaggacacggccattgtgggcaacaaggacccaccttccatctgtgccaccgtcccagtgaaaaccttcctcaacatcacgccagctgaggttgctgtcctggtttgggcaaaagattggtcaagcttttgtcatgaattgtgctgacacttgggggccaaaaaatatacttgttggtccttgggactacacttgctgcaaggatgaacgaattgacccacggattcctttgtaatgaacgagcatcgggtggagccccccaaccatttaaacgtcaatttgtcacccatgactgccaaggacggctaggcgtgatgattgggcaaaagaagggtatccagtggcaatttcatcaagcaagtaaatgttattgaaatggcctcccccaccttcaggcgtacc

SEQ ID NO: 716163 - DNA, 169 bp, Homo sapiens
cccgagatcgtgccacttcactccagccggggcaaaagagcaaaaggccatctcaaaaaatatacatatataagggagataaagtttccgattttccaatacagtttcacattggaacagccctaatggatacaactttatggcagggttttagtgtgtgagtgggatc

SEQ ID NO: 716164 - DNA, 458 bp, Homo sapiens
  misc_feature (234)..(234): n is a, c, g, or t
  misc_feature (384)..(384): n is a, c, g, or t
agtgatcccctgcgtggctgggctgctcgggttagatcgtcaggaaaagcataaaaaaaaaaaaaaaaaaaaaaaaaaaaaattttgggccgcccgccccaaaaatttttaaacctttttggggggcggggccccaggtagggaaaggtagacctggggcaatacgcggcccctaaggaggaaaacccggcgccataactaaggggctgtgggtttcttcacaaaaaaaaaaangcgccgggggggaaaccgaggcttgttctaggaacaaacttcccaagaggggggctctggagggtccataacggggtctcctacacacaagggagtctccaagcgcgagagcgcctggatattaaaaattagcgccccggccgctggatncacacaccagccacaccaagaaacctccaccgacacacacggaacgccacacaacaagcaaccgcacaaacagt

SEQ ID NO: 716165 - DNA, 442 bp, Homo sapiens
atataactatttcaggtcatcagaaactcttgaaaacaccattttttagtggatccatggtattttattatatgaatttatgaaatctagttaaccaactccctattattagatatttataaaatctacttaaccaaatccctgttattaggtatttaagtcattctcaggttttcactagtctaatcaagttgctgaataggtacatgagattttgtctgagtttgtgatgatctttcaaagaaaatacagaaggcagtggcctggttaagagctcacatttgggagctaaggcacttggatctgggtcccgcttccagaactagtgacctatgtgatcttgggcaagtcccctctgagtctcacatgattctgctgtatgatgcaccatccttagtgatttcctattattggaaataaaaatatttttaaaaagttaaaa

SEQ ID NO: 716166 - DNA, 860 bp, Homo sapiens
  misc_feature (614)..(614): n is a, c, g, or t
  misc_feature (618)..(618): n is a, c, g, or t
  misc_feature (624)..(625): n is a, c, g, or t
  misc_feature (645)..(645): n is a, c, g, or t
  misc_feature (648)..(648): n is a, c, g, or t
  misc_feature (653)..(653): n is a, c, g, or t
  misc_feature (655)..(655): n is a, c, g, or t
  misc_feature (662)..(662): n is a, c, g, or t
  misc_feature (671)..(671): n is a, c, g, or t
  misc_feature (675)..(675): n is a, c, g, or t
  misc_feature (677)..(677): n is a, c, g, or t
  misc_feature (682)..(683): n is a, c, g, or t
aggatagtcagctgtaccaagccccttggcctctcccatgcacacaaacacctcctagcaagacctgttggttagctggcacatgcttcggcaatttttttatactaccaacgtgaccataaaggcatggcattcgttgtgactggcacccatatgtttgactttttttctttaagactatccacatttacaaattaacggtctggcgagtgttctgtttcccatttactttaatagctcacctcctcccagactttctacaccctgtttcgcacctcaggctgaggatgtcctggacctccccctcttggtccctactagagacctctcatacagatctgtggtgcccagtcattgggttgttgatcacgtgcttcacatgtgaactaagttttttacttccatcagactacaggccactaccttctgtgcctcctccacccctcaccaaaccccatcttttactatgctgtggggcatcagaactccggaatgaccagcatgatattttcagagtcttgtccccggggtattagcacctctttttgaacagggaattgattcaagattggacatggtctcctctgattatcaggtactggggctgagggcantaanaatagnnagcctccctcctcgtccccngcntcaananattgccnccatatttntcancntcttnntcctcccatcccttgagagcacgcagtacaatgagtcagaagccccgggtaggcaggtagccagcacctcataatgccatacatctgtgtagtgtacataggtgtaaaatgcgctctcatgtaaggcccactggtgtgtgtcacacgaagaggatcctctatagtcggccgcacgca

SEQ ID NO: 716167 - DNA, 210 bp, Homo sapiens
gagatggcactactgcactccatgcctgggcagcagagcgagactccacctaaaaaaaaaaaaaaaaaaaaatcagattttgtgaaacctcactcactatcacaaaattaccttagaggtacccacctccatgtttcaattacctcccaccaggtaccttcaatgacgtgaggatttgggggctcaccaatataggggatcctctaaagt

SEQ ID NO: 716168 - DNA, 766 bp, Homo sapiens
  misc_feature (614)..(614): n is a, c, g, or t
  misc_feature (618)..(618): n is a, c, g, or t
  misc_feature (624)..(625): n is a, c, g, or t
  misc_feature (645)..(645): n is a, c, g, or t
  misc_feature (648)..(648): n is a, c, g, or t
  misc_feature (653)..(653): n is a, c, g, or t
  misc_feature (655)..(655): n is a, c, g, or t
  misc_feature (662)..(662): n is a, c, g, or t
  misc_feature (671)..(671): n is a, c, g, or t
  misc_feature (675)..(675): n is a, c, g, or t
  misc_feature (677)..(677): n is a, c, g, or t
  misc_feature (682)..(683): n is a, c, g, or t
aggatagtcagctgtaccaagccccttggcctctcccatgcacacaaacacctcctagcaagacctgttggttagctggcacatgcttcggcaatttttttatactaccaacgtgaccataaaggcatggcattcgttgtgactggcacccatatgtttgactttttttctttaagactatccacatttacaaattaacggtctggcgagtgttctgtttcccatttactttaatagctcacctcctcccagactttctacaccctgtttcgcacctcaggctgaggatgtcctggacctccccctcttggtccctactagagacctctcatacagatctgtggtgcccagtcattgggttgttgatcacgtgcttcacatgtgaactaagttttttacttccatcagactacaggccactaccttctgtgcctcctccacccctcaccaaaccccatcttttactatgctgtggggcatcagaactccggaatgaccagcatgatattttcagagtcttgtccccggggtattagcacctctttttgaacagggaattgattcaagattggacatggtctcctctgattatcaggtactggggctgagggcantaanaatagnnagcctccctcctcgtccccngcntcaananattgccnccatatttntcancntcttnntcctccctttgggtgacagctctcagtgcaatgttccgatgccctcgtggtgtgtctcagagagagggtcttctatagtctcg

SEQ ID NO: 716169 - DNA, 141 bp, Homo sapiens
aaacaaagctagatatctttataataatagcgaataataccaaagaaaccgattgtatcacgtttcggtgttgtcgctacatcattttcataaactggtgattcttccaatttacgacgtaggtataatccaaataatcct

SEQ ID NO: 716170 - DNA, 454 bp, Homo sapiens
aagtacaattatttagttaccttaagttgcactgatactaccattatatcacagtgcacacaaaacaaatgagatatatgcttatactaatcagttttacacaaactccctagtcaaatttgtttcaggccaatttaaacattagcacttaacagttttatacctgtactttaagtaaggttttaagttgaaaggtcattatttctttatctgaaggattaaaggaaacaggaacccagtggctaggtggtttgggaagaacactcggtgatggcggctcactgaatttggctccagcatagttctgattggcttgtggcttaaaaagtaagctaggacttgacaagttcgcgttccagttttgattatttgggaagtttttgttcttccctccgttttgcatggcctgccatgtggctgctgacgagttgtaaccatgtcctctttctttttt

SEQ ID NO: 716171 - DNA, 282 bp, Homo sapiens
aaaaaagaaacccattttttaaaaaaaccgctttcaaggccccttttcccgtttttccggggggcaaaaaaaatttgggaaagggaaaaggttttgttttttacccccccccccccccccaaggtttaaaaaaaggtttcccccaaaatttggtttccaaaaaaattttgggggaaaaacctttttaaaagggtttttgaaaacaattaaaacgggttttttttttcccccaaggaccccccccactgggtttgggttcaaaaaatttttggaaaaacccca

SEQ ID NO: 716172 - DNA, 103 bp, Homo sapiens
ctagaggatccccgcgatatcttgcacgtactggtggcatgaactcctatcaatttctcagcgcgcagtgatggccctgagctacctgacggctcgatacttc

SEQ ID NO: 716173 - DNA, 1263 bp, Homo sapiens
ccctatataaatgctcgctttttgtcgttgtgtttgtatacgacttagatgagagaattttttgtgttccgacaacgaggggtagtggtttgctgaaatagcgttggtcagccaagtgttgatgtgcactcctacctcctgcgttgtagtgagagaagctcgttgtcctcctttctatacgggggatgtgttcttggtttcttccctcgacagatactcgtctggggggaaagataataatataatatttgggggagaaacaccaactacttgggtggtggttgttctttgttttcctcgtttataaatatattatatgatgcgtcactacaaaaggttgttgtaacacacatcgtggagaatggggaattgtgttgtgtgggggggtggtttgtaaagaggttgtttaatatatgtggtggagaacagttcgtggtttctgtctcctcgtgtggggggaatccttggttgtatatactccttgtagttgttttttgttggctcgcacgcagttttatccccctctcacaggggggaataactcctgggagtggggtgttgtgtttgtgaagagggtgtgttccacagaggcaacacacggtttatatgacccccacataggcctcctgttgtggggtaaaatactcccgccctctttctcacagtcggtaccacagggggaatgtttgggggtcacaagggagcacacacctcacactataagccacgagtggccctgtcgcgtgtgtgttagacacacatgtacacacgttgtgtattgccacgcgccttgtgtgtgttatatatgtgttacacacatgggcacacgcgtttttgtaatgtggagaaaatttgtcccacatgaaccacacacgggggtttctgtgaggttcttgcttttgtgtttgttctttctgttctttgtttcgcggcggaccctgtgggggacctctcctctccacacgagtcaccacgtgtttatgcacgtcgtttctgtcttccttatcctccacgtgtttgagaaaacaccaagttacacacggtgaaaatgttggttctcacggggttaacacgcggagaaaatttctggcgtaaccgggctccttccctgagatgagttttgtaaataacacctatctgaaacgaggcttctggctggtcctcttttatcctggatgtggtttttctgtgtaaccattccttgaagtcccggtttggaaaaatgtactcttttccaccagaaaaacctttaatccctcggcc

SEQ ID NO: 716174 - DNA, 334 bp, Homo sapiens
  misc_feature (25)..(25): n is a, c, g, or t
ttactagactatccctgggccttgntaggattctcctatccaattccatgcagtacagcatagggcaaactggacagaatagaaaggacctcaaggctctgggcctgtgttccctgtatatcccaagatctggagatttgacatgctaactaactcatctgcagctcagtggcagccaccttgtgcctctgaggtatagtagctacgctggggacttcctgttaaacacgtggaccccaagccagttctaacaccaaaggtgtttacaaagaaggacttggctggtcacatatccttaggccttgagtttaatgggtagaagtgccgccctctt

SEQ ID NO: 716175 - DNA, 200 bp, Homo sapiens
accacaacaggcccaccttgctcttattctgccaggtggtgagggcgtctaccagctgggtgagcataaaggggctctatgcctccagaaagctgatgccctggcgctcgaagatgcgaatgtccatctggaggcaagatgtggcgtgcctgggtcagccaggagcctgggctgggtctcacaggaggctcatggacaaa

SEQ ID NO: 716176 - DNA, 217 bp, Homo sapiens
  misc_feature (19)..(19): n is a, c, g, or t
  misc_feature (50)..(50): n is a, c, g, or t
  misc_feature (91)..(91): n is a, c, g, or t
  misc_feature (131)..(131): n is a, c, g, or t
  misc_feature (172)..(172): n is a, c, g, or t
ttggataataccttccttnaagtaacctgaaaggtgatttacccaccttnagtccccactgcctaaagtcttatgacttccaaattgctcnagtaaatgctgagtggatatttagtaagaaacctatgganactagggacaaatatgtgttcattaaatatgcatcatatantctgcaagcacctggcctggtctcttcaaaaaggcagtattggcc

SEQ ID NO: 716177 - DNA, 1312 bp, Homo sapiens
  misc_feature (363)..(363): n is a, c, g, or t
  misc_feature (808)..(808): n is a, c, g, or t
  misc_feature (822)..(822): n is a, c, g, or t
  misc_feature (858)..(858): n is a, c, g, or t
  misc_feature (860)..(860): n is a, c, g, or t
agctaggaactactattttgttttaattgcgtacattttgcttggaaatcacaggaagaaacacaacaaagcattgcccaaggtacagaaacaataataaacgtacttaaaactcatttaaattccagcatttttctccttattttagaagtttaacatttcagaagcagacactgcctcccttcctgcaacaactttctcctcttaagtctcatttttccccagtttcaagggcgaattctagaactccccggaaccgccaccagttaaccagaattccgtggctttggaaaataaaactgctgttatagctcttctgggtatttgagaaatgcacttgtgaagggttagagttgaatcttntgatgcgaaagtcgggttttcctgatactgggattccgggattccaggtgttggggtggcccaattcctgcgagaagcaatagcgggcggtaacatgaggagcacggtgcgtccagcgagtccttccgcctggggccctgccgaccccctgcctgcgcccccaggactctggcctcacccggccgtgccggggcctctgtgacgcggcgttccaggcactcggccccggccgagcccgtagctagagcggctcagagacaggaggcggcggcagcagcggcggcatgaaccactgccagctaccggtggtgatcgacaacggctcgggaatgatcaaggcgggcgtggctgggtgccgggagccccagtttatctacccgaacattatcggccgcgccaagggccagagcctgcgcggcccagggcgggctagaactctgcgtgngcgaccaagctcangactggaggagctcgctgttcatcagttacccagtngnagcgtggtctcattactctcactggcgaggacagtggagatcatgtgggaacgcatatctagtgactataagctaaagctgaagccgtgttatggcccagtcttgattactgagccagtgctgaaaccagtggccaaccggtaacagatcacggaaatgtcttcatgagcatctgggtgtccatgccttctatatgtccatccaagctgtgctggcctctctttgctgctggcattcaatactggccatagtgcatgaattcaggtgctggggttaccacagagtgtgcccatctttgaggggttactgtctgactcataggtgtgcaacaactggatctggcaggcttgactcacaaatagctcatgtgcctaataaaaacctggtataatgttgtcaatgttcggaaaaaaatggtgaaactcaagaaattcgtatgtggcgctacacaa

SEQ ID NO: 716178 - DNA, 1389 bp, Homo sapiens
  misc_feature (400)..(400): n is a, c, g, or t
  misc_feature (1223)..(1223): n is a, c, g, or t
tgacaagtttgccaccgggtgcaccaggtgcccgtgtgattgtgacagacacgtgggtgatgaattgttaccagctaccgaggtgctctggtggcccagcacgcagtgagcgtgcacctgtactgtgaacgggagtctcggtatgcatgtacgtctctcgaccatgatctacgaacttggcctgtcgcagtggtccgtcagaccactaccagatgatggccatgcagccaagaccactgcgttgattagcatagtggctattgagcagtctggagtaacgagttgttggtgcactgtgagggctagtaggagggtgcatcattggcgaggccaagagccagggcatctggtagccacggagtccgctgggacaggtgcataggagaggtgaggcgtgggnttgtagggagctcctagagcaaactctcctgggagacctttggttggtgaacaaccgatgggcataggggatggttcgcgaccatatgtaccacctcgaagttcgaacttgggagactcgcgtacacacggacgattaaggcgcgcatacgctcgttactgtgggctacacgcgctcctgccaagcttactctggaggaccgtacccacgctatctcaatactccctcgtggtgaaagggcccaacggcgtcagcgcgcccattggactttgccttttggggtcgcgaaggcaattcgttcaaaggagatcgaagggtgcgatgtcgcgcatcaacgaggcgtgggtaacaattggcgatagtcgccttgttggtcgtcccgttagggaggtccccgcccgcgcgagaattgctaccccacgcggcttttgggaggcatttgtttccattgggggggattggcttggggggggtccctcgggttgtgagccctttctgtggcgacacgtatgagggagagggcgctggtcccttcattccggtcggtgggttaggtggtaccctttggtgctttggccggtatctaccgttggttcgtcgcgccttggaatcagatctctccgcgttctgagggacgggattggcttaaggcggcttgccggattccaattgttcacctgtagttacccccctttttttaggttcaccagttgggccaagaaattagggggtgcaccccaggaggacaagggctttcctatgccgcatccctcttgtggggaaggcgcctttggagagcgggtacacgagccctttgaatgtnttatcctggggggggtacgagccttctttggcggcgtaaggcaaacacgcattaccactgtgcaggcgaacccgatagaatcttcgagcaggagtaccgggggagcagagagcgtcaacaatggtggttcggtggatcgaaattatcatccgcggagcgaaagtac

SEQ ID NO: 716179 - DNA, 307 bp, Homo sapiens
aaaaaaaagcacaggtagggcagtaactgctgatgtgtaagctacaggaagttatccagaagatctagtgaacaatattgtacggtagctacagtacagcaagcatatttacaaagtagacaggacagtcttctatgggaagaagatgccatctaggactttcatagctagaaaggaaaaaaacacctggcttcaaaggacaaggtgactccggttaggggctaatgcaggtggtgacattaagctaaagcaatgctcatttaccattctgaaaatcttagggcctttaagaatgatgctatggaaa

SEQ ID NO: 716180 - DNA, 2572 bp, Homo sapiens
  misc_feature (2398)..(2398): n is a, c, g, or t
  misc_feature (2488)..(2488): n is a, c, g, or t
  misc_feature (2530)..(2530): n is a, c, g, or t
  misc_feature (2552)..(2552): n is a, c, g, or t
  misc_feature (2561)..(2561): n is a, c, g, or t
atgggactgccccgaggaggacaagaagggcctgtgtccagcccccaaggaaaccggccggcccgggggccccgctcctggtggtcgggagctcccggaatctcctgtctcccctgtcagttatgtctgcctcccaggctctgcagaccgtggccctgtcggcagcccacggcagcagctcagagcccaacctggcactcaaggctttggccttcaacggctcccctttgcgctttgacaagtaccggaactcagattttgcccatctcattcccttgacaatgttataccccaagaaccacttggatctcacattccaccctccccgacctcagactgcgcctcccagcatcccctcacccaaacactccttcctggcctatctcggactgagagaaagagcagagactgtctgagggcagccatgttctgtaccaaaaacagagagacaaaagacaaaaaaaaaaaaaaaaccacaaaacttaaacacaaccccagcaggtgtatgttgctgcaaaacctacagaccccgatgggtctggaacatgtgtactgtatatctttagtaaggaatagaaaattggctctgtgtgtatacctattgcattgacctgaaagctgctttatccaatcttcagagaggtgacctactgcatacttctaccttcagaggcatgcctccccagccacccactcccactctcagcccttctccgtacttttctctgaaaggaatcttgtcttgttaaaccctaaagagagtgtccttaatagcaatcagcacttgtaagcttatatactggtgcatttggttttctgttgggtgaatgcggtgtgtgggcgtttgtggattctgaaagagaaagccgtgtgtcgtgtgccatgacatttctattgcacattctttgtactggcttctttaacagcgatgaacgttcttttccctcctgggttgttcatccacgacagtctctccctgtgctccttcatcacctttccctctctctttgatggctacagagtggtagggcctggtgcttagtcgatgaaggaatggtagccatctacagtgctgctggagatttccgccagagcgctggagaccttgcgctcagatcttctctggtgatgaagaggcgaggaatcaagtgactgatctggaagaaatatctcgcagcactgcagctaacatcacagaacttaagtgtgttttgtgtgtgtgcccacacgtagacaaatgtgtacggtgcacacacacagtgcatcattttttaagggcagattatatatatatatgagatgtattaattcagtggttaccatttgtttgcaggaaaaagaaatgtatgggtgaaaaaatttatggttgataaatccagccaaggagattaaaaggggtttggataaattctgggtataaatgctcagactaaaaaaaagaaatggcagttttgcacagtgctatggtcttgcactagtttttgtttctcatctgaaaaaaaaaaagtaaaataaaaggaagaaaatgtaccttttttatggaatgagtagactgtatgtttgaagatttagccacaacctctttgacatataatgacgcaacaaaaaggtgctgtttagtcctatggttcagtttatgcccctgacaagtttccattgtgttttgccgatcttctggctaatcgtggtatcctccatgttattagtaattctgtattccattttgttaacgcctggtagatgtaacctgctaggaggctaactttatacttatttaaaagctcttattttgtggtcattaaaatggcaatttatgtgcagcactttattgcagcaggaagcaggtgtgggttggttgtaaagctctttgctaatcttaaaaagtaatgggtgatttaaaaagaaaaaaggaaaaaaatctttggctgaatatgttcattgcttgtatttttaaaacaacagaatttccagtatgaaacaggctgaaagagcaggaagaaatgttctttgtataataatgggaagtttggaatataaaagtttatatattatttatctattggagaactggtgtacaggaggaacattttcttactgtgttgctgttttccatcatgtgttatcctaagagttggggttttttaaaatctgtttcaccaggggaaaataaaagcatccctaatgttcttcctctagtcagtttgctttgctgaaagctccctggaaattagtacagttctacaggaagccagaagactgtactgtctgtccacaccatggtctcctcagtcccctccacgccagcccctcttccccacacctagtaggtgtgcttacaccttccctttgccagtcatcccgccatgggatggggggagcctacttgggtgccctgggnaaaacctgtttacactaagggagatgcccacagggagcggggaagtccaaaaaacccttcagttcatttttccagcagagacctttgctnttgggcaagggttttaaacgatgtttcaaccttggccaagtnaatgtttttaagttaaagggcnttttgggtngtttttggggg

SEQ ID NO: 716181 - DNA, 2570 bp, Homo sapiens
  misc_feature (2396)..(2396): n is a, c, g, or t
  misc_feature (2486)..(2486): n is a, c, g, or t
  misc_feature (2528)..(2528): n is a, c, g, or t
  misc_feature (2550)..(2550): n is a, c, g, or t
  misc_feature (2559)..(2559): n is a, c, g, or t
ggagatatgttttacgagtacatagatatgtacacatgcacacactcacacagagagacacacacaggccttctcatcctaacaaacccttaataagcacgattctgacccctgtcagttatgtctgcctcccaggctctgcagaccgtggccctgtcggcagcccacggcagcagctcagagcccaacctggcactcaaggctttggccttcaacggctcccctttgcgctttgacaagtaccggaactcagattttgcccatctcattcccttgacaatgttataccccaagaaccacttggatctcacattccaccctccccgacctcagactgcgcctcccagcatcccctcacccaaacactccttcctggcctatctcggactgagagaaagagcagagactgtctgagggcagccatgttctgtaccaaaaacagagagacaaaagacaaaaaaaaaaaaaaaaccacaaaacttaaacacaaccccagcaggtgtatgttgctgcaaaacctacagaccccgatgggtctggaacatgtgtactgtatatctttagtaaggaatagaaaattggctctgtgtgtatacctattgcattgacctgaaagctgctttatccaatcttcagagaggtgacctactgcatacttctaccttcagaggcatgcctccccagccacccactcccactctcagcccttctccgtacttttctctgaaaggaatcttgtcttgttaaaccctaaagagagtgtccttaatagcaatcagcacttgtaagcttatatactggtgcatttggttttctgttgggtgaatgcggtgtgtgggcgtttgtggattctgaaagagaaagccgtgtgtcgtgtgccatgacatttctattgcacattctttgtactggcttctttaacagcgatgaacgttcttttccctcctgggttgttcatccacgacagtctctccctgtgctccttcatcacctttccctctctctttgatggctacagagtggtagggcctggtgcttagtcgatgaaggaatggtagccatctacagtgctgctggagatttccgccagagcgctggagaccttgcgctcagatcttctctggtgatgaagaggcgaggaatcaagtgactgatctggaagaaatatctcgcagcactgcagctaacatcacagaacttaagtgtgttttgtgtgtgtgcccacacgtagacaaatgtgtacggtgcacacacacagtgcatcattttttaagggcagattatatatatatatgagatgtattaattcagtggttaccatttgtttgcaggaaaaagaaatgtatgggtgaaaaaatttatggttgataaatccagccaaggagattaaaaggggtttggataaattctgggtataaatgctcagactaaaaaaaagaaatggcagttttgcacagtgctatggtcttgcactagtttttgtttctcatctgaaaaaaaaaaagtaaaataaaaggaagaaaatgtaccttttttatggaatgagtagactgtatgtttgaagatttagccacaacctctttgacatataatgacgcaacaaaaaggtgctgtttagtcctatggttcagtttatgcccctgacaagtttccattgtgttttgccgatcttctggctaatcgtggtatcctccatgttattagtaattctgtattccattttgttaacgcctggtagatgtaacctgctaggaggctaactttatacttatttaaaagctcttattttgtggtcattaaaatggcaatttatgtgcagcactttattgcagcaggaagcaggtgtgggttggttgtaaagctctttgctaatcttaaaaagtaatgggtgatttaaaaagaaaaaaggaaaaaaatctttggctgaatatgttcattgcttgtatttttaaaacaacagaatttccagtatgaaacaggctgaaagagcaggaagaaatgttctttgtataataatgggaagtttggaatataaaagtttatatattatttatctattggagaactggtgtacaggaggaacattttcttactgtgttgctgttttccatcatgtgttatcctaagagttggggttttttaaaatctgtttcaccaggggaaaataaaagcatccctaatgttcttcctctagtcagtttgctttgctgaaagctccctggaaattagtacagttctacaggaagccagaagactgtactgtctgtccacaccatggtctcctcagtcccctccacgccagcccctcttccccacacctagtaggtgtgcttacaccttccctttgccagtcatcccgccatgggatggggggagcctacttgggtgccctgggnaaaacctgtttacactaagggagatgcccacagggagcggggaagtccaaaaaacccttcagttcatttttccagcagagacctttgctnttgggcaagggttttaaacgatgtttcaaccttggccaagtnaatgtttttaagttaaagggcnttttgggtngtttttggggg

SEQ ID NO: 716182 - DNA, 342 bp, Homo sapiens
cgtgagacagactttcctttcccctatcaatctaagttttgtttaaatgcccatcactctttgcaggggggggattaaagtttaaattgggggggcaagataaacacatgattgaaggacaggtactacttcagaagaggtaaaggcaattaattaattaattaattaatgggtttttttggagccagagaatcactgtttcagccaggctgtagtgcagtgatgtgatcataattaattggcagcctagacttcctgcactcaagcgattctcctgccttagccttccaactagctgggactacaggcgcgcatcaccatgcccagctaatttttttattt

SEQ ID NO: 716183 - DNA, 370 bp, Homo sapiens
ctgaatgctctgggagctccagctgccactcctgcagttctgggagctccagcggactctcctgctagctctgagaagctccagctgcccctcctgctgctccgaggtgcttcagctgtccctcctgctagctactaggtgcttcaggtgcccctcctgctgctctgggagctccaacagttgctctttcttcattcccagttgctcatctctcttgactagctcttgatccagttgctggtctaagagcttcttctctcttaagacaggttacatctattctctgttcaggccaggtgcagtggctcatgcctgtaatcataatactttgggaagccaaggtgggaggatcccttgagcctaggagttc

SEQ ID NO: 716184 - DNA, 2344 bp, Homo sapiens
  misc_feature (2170)..(2170): n is a, c, g, or t
  misc_feature (2260)..(2260): n is a, c, g, or t
  misc_feature (2302)..(2302): n is a, c, g, or t
  misc_feature (2324)..(2324): n is a, c, g, or t
  misc_feature (2333)..(2333): n is a, c, g, or t
tttttttttttgtcttttgtctctcagattttgcccatctcattcccttgacaatgttataccccaagaaccacttggatctcacattccaccctccccgacctcagactgcgcctcccagcatcccctcacccaaacactccttcctggcctatctcggactgagagaaagagcagagactgtctgagggcagccatgttctgtaccaaaaacagagagacaaaagacaaaaaaaaaaaaaaaaccacaaaacttaaacacaaccccagcaggtgtatgttgctgcaaaacctacagaccccgatgggtctggaacatgtgtactgtatatctttagtaaggaatagaaaattggctctgtgtgtatacctattgcattgacctgaaagctgctttatccaatcttcagagaggtgacctactgcatacttctaccttcagaggcatgcctccccagccacccactcccactctcagcccttctccgtacttttctctgaaaggaatcttgtcttgttaaaccctaaagagagtgtccttaatagcaatcagcacttgtaagcttatatactggtgcatttggttttctgttgggtgaatgcggtgtgtgggcgtttgtggattctgaaagagaaagccgtgtgtcgtgtgccatgacatttctattgcacattctttgtactggcttctttaacagcgatgaacgttcttttccctcctgggttgttcatccacgacagtctctccctgtgctccttcatcacctttccctctctctttgatggctacagagtggtagggcctggtgcttagtcgatgaaggaatggtagccatctacagtgctgctggagatttccgccagagcgctggagaccttgcgctcagatcttctctggtgatgaagaggcgaggaatcaagtgactgatctggaagaaatatctcgcagcactgcagctaacatcacagaacttaagtgtgttttgtgtgtgtgcccacacgtagacaaatgtgtacggtgcacacacacagtgcatcattttttaagggcagattatatatatatatgagatgtattaattcagtggttaccatttgtttgcaggaaaaagaaatgtatgggtgaaaaaatttatggttgataaatccagccaaggagattaaaaggggtttggataaattctgggtataaatgctcagactaaaaaaaagaaatggcagttttgcacagtgctatggtcttgcactagtttttgtttctcatctgaaaaaaaaaaagtaaaataaaaggaagaaaatgtaccttttttatggaatgagtagactgtatgtttgaagatttagccacaacctctttgacatataatgacgcaacaaaaaggtgctgtttagtcctatggttcagtttatgcccctgacaagtttccattgtgttttgccgatcttctggctaatcgtggtatcctccatgttattagtaattctgtattccattttgttaacgcctggtagatgtaacctgctaggaggctaactttatacttatttaaaagctcttattttgtggtcattaaaatggcaatttatgtgcagcactttattgcagcaggaagcaggtgtgggttggttgtaaagctctttgctaatcttaaaaagtaatgggtgatttaaaaagaaaaaaggaaaaaaatctttggctgaatatgttcattgcttgtatttttaaaacaacagaatttccagtatgaaacaggctgaaagagcaggaagaaatgttctttgtataataatgggaagtttggaatataaaagtttatatattatttatctattggagaactggtgtacaggaggaacattttcttactgtgttgctgttttccatcatgtgttatcctaagagttggggttttttaaaatctgtttcaccaggggaaaataaaagcatccctaatgttcttcctctagtcagtttgctttgctgaaagctccctggaaattagtacagttctacaggaagccagaagactgtactgtctgtccacaccatggtctcctcagtcccctccacgccagcccctcttccccacacctagtaggtgtgcttacaccttccctttgccagtcatcccgccatgggatggggggagcctacttgggtgccctgggnaaaacctgtttacactaagggagatgcccacagggagcggggaagtccaaaaaacccttcagttcatttttccagcagagacctttgctnttgggcaagggttttaaacgatgtttcaaccttggccaagtnaatgtttttaagttaaagggcnttttgggtngtttttggggg

SEQ ID NO: 716185 - DNA, 2424 bp, Homo sapiens
  misc_feature (2250)..(2250): n is a, c, g, or t
  misc_feature (2340)..(2340): n is a, c, g, or t
  misc_feature (2382)..(2382): n is a, c, g, or t
  misc_feature (2404)..(2404): n is a, c, g, or t
  misc_feature (2413)..(2413): n is a, c, g, or t
gtgtcatcggagtgctaagatgcagggccgaaagggagaaagggtttgtgaaaggcaaaagctatataggcgccttacgctctagtcaatgtccagcatgagtttctactgcgaaatgctcttgtgaaccctcttgctaaaggaggcgttgcccgcgggtcggacattccaccctccccgacctcagactgcgcctcccagcatcccctcacccaaacactccttcctggcctatctcggactgagagaaagagcagagactgtctgagggcagccatgttctgtaccaaaaacagagagacaaaagacaaaaaaaaaaaaaaaaccacaaaacttaaacacaaccccagcaggtgtatgttgctgcaaaacctacagaccccgatgggtctggaacatgtgtactgtatatctttagtaaggaatagaaaattggctctgtgtgtatacctattgcattgacctgaaagctgctttatccaatcttcagagaggtgacctactgcatacttctaccttcagaggcatgcctccccagccacccactcccactctcagcccttctccgtacttttctctgaaaggaatcttgtcttgttaaaccctaaagagagtgtccttaatagcaatcagcacttgtaagcttatatactggtgcatttggttttctgttgggtgaatgcggtgtgtgggcgtttgtggattctgaaagagaaagccgtgtgtcgtgtgccatgacatttctattgcacattctttgtactggcttctttaacagcgatgaacgttcttttccctcctgggttgttcatccacgacagtctctccctgtgctccttcatcacctttccctctctctttgatggctacagagtggtagggcctggtgcttagtcgatgaaggaatggtagccatctacagtgctgctggagatttccgccagagcgctggagaccttgcgctcagatcttctctggtgatgaagaggcgaggaatcaagtgactgatctggaagaaatatctcgcagcactgcagctaacatcacagaacttaagtgtgttttgtgtgtgtgcccacacgtagacaaatgtgtacggtgcacacacacagtgcatcattttttaagggcagattatatatatatatgagatgtattaattcagtggttaccatttgtttgcaggaaaaagaaatgtatgggtgaaaaaatttatggttgataaatccagccaaggagattaaaaggggtttggataaattctgggtataaatgctcagactaaaaaaaagaaatggcagttttgcacagtgctatggtcttgcactagtttttgtttctcatctgaaaaaaaaaaagtaaaataaaaggaagaaaatgtaccttttttatggaatgagtagactgtatgtttgaagatttagccacaacctctttgacatataatgacgcaacaaaaaggtgctgtttagtcctatggttcagtttatgcccctgacaagtttccattgtgttttgccgatcttctggctaatcgtggtatcctccatgttattagtaattctgtattccattttgttaacgcctggtagatgtaacctgctaggaggctaactttatacttatttaaaagctcttattttgtggtcattaaaatggcaatttatgtgcagcactttattgcagcaggaagcaggtgtgggttggttgtaaagctctttgctaatcttaaaaagtaatgggtgatttaaaaagaaaaaaggaaaaaaatctttggctgaatatgttcattgcttgtatttttaaaacaacagaatttccagtatgaaacaggctgaaagagcaggaagaaatgttctttgtataataatgggaagtttggaatataaaagtttatatattatttatctattggagaactggtgtacaggaggaacattttcttactgtgttgctgttttccatcatgtgttatcctaagagttggggttttttaaaatctgtttcaccaggggaaaataaaagcatccctaatgttcttcctctagtcagtttgctttgctgaaagctccctggaaattagtacagttctacaggaagccagaagactgtactgtctgtccacaccatggtctcctcagtcccctccacgccagcccctcttccccacacctagtaggtgtgcttacaccttccctttgccagtcatcccgccatgggatggggggagcctacttgggtgccctgggnaaaacctgtttacactaagggagatgcccacagggagcggggaagtccaaaaaacccttcagttcatttttccagcagagacctttgctnttgggcaagggttttaaacgatgtttcaaccttggccaagtnaatgtttttaagttaaagggcnttttgggtngtttttggggg

SEQ ID NO: 716186 - DNA, 773 bp, Homo sapiens
tggaaaaagagtctcactgtgttgcccagggtggagtgcaaatgtggctttgactctgggtccactgtgcgaaccttctgtgccctcccaggttcaaggcaattctctgttgcctcaagcctctcccgagtagcgtgggcactaaaggcgttgtgccaccagtgcccagctaaatacgtggtattttatagctaaagacggagtttccctccagtgttgtgcgcccagaactgtggctctctcgaagacctcccgtgacaaccctcgagggtgtaactcgtgcacccgcctgtgtggcctctcccggaaaaagtgtgctgtgaagaaattacacgaggtgtgcggaagccccaactgtgagtgggctgggtggggcccaacacagaccttgtgagtcagactacaggaaaggacttttgaaagccgtgggtgtggttgcacgtgttgtcacaccgctctctttagtctccccgaggtacacatgcggggagagggcccctaagggacgagagagaggataatcaactctttgataagcgccccaatgagagtttataaaggggggcccaccggccctgtggggcggccaaccgatgttagcgaacaaagcgctctatatgttccccctatagagaatttttaaacaaaagaaaaaagacgagaacagaaacaaaaaacacaagtagcggtgagaagacacatcaaagataggagagagagatgtttagataagaattgtgtcgagtcgacatagacaacaactagagtagggg

SEQ ID NO: 716187 - DNA, 753 bp, Homo sapiens
tgaaccgggggcgggaccagcgcggagccaacgatgtgtctgcgcctcggaggcctgagtgtgggcgacttccggaacggtgctgatgaagacaggcctggtgctggtggtagctgggccatgtgagcttcatcacatgctgccctgttccatggcacagtgctgcactacgtgggcacccctcaagatgcggtggctctgccgagtactgccgtggtcaacatcctctctgtcatcttccgtgcatcgtggttcatctatcttcaggccatcgtcagccatcgtgttgtgcacgctagcctcgcctatcacccccctgcgctgggaccagtgtttagctcgagcgtgggctgtgctctcctttctctgacctgtgccctcggcctcttgggctccactcgtccatgacctttgccagccaggggctaggcactgcatggctgcctgcacttcttggggagctctgactctacctgggtccctcgccaccgtgactgtcccttcgtagccctatacgcagttatactaggctcccagccctgtgcctctgggggcatccgcctaggtgctctgcgtggcggcagcaccgtgttggctgtacgctgtgctcagctcgacccaccaggctgctgcgagtctgaggccctggtgggggagacgcagcccaccgcatgactgcggggagaccccagacctggtgcggggccgtgcctgctgagctgccccaggtctgagctctgaccctctgtgaga

SEQ ID NO: 716188 - DNA, 176 bp, Homo sapiens
tgccacaaccaagaggctactgataaatctttacaagcttgtaaaatctcagatatctgtttattctcgagctcaacaagcattgaagtaagttttccgggagctcacagcaaattcacatccaagcacaaagcaatcaatcagcagggattcatcttccacactgcaagtggctg

SEQ ID NO: 716189 - DNA, 275 bp, Homo sapiens
cctgagatacaagaatactcattagaacaattactaattctataatgggccgaagtgagaggatcacttgaggtcaggagttcaagaccagcctggccaacatggtgaaacgccatctccactaaaatacaaaaattagccgggcgtggtggtgggcgcctatagtcccagctactcaataggctgaggcgggagaatcactggaacccgggaggcagaggttggggtgagccgagatcacgccattgcactctagcctgggaaacatggcgaaa

SEQ ID NO: 716190 - DNA, 414 bp, Homo sapiens
cggcacgaggacagaatccaggtgtgtacacccgcatcaccaaatacaccaaatggatcaagaagcaaatgagcaatggagccttctcaggtccctgtgcctctgcctgcctcctgttcctgtgctggctgctgcagccccagatgggctcctgacctccctaccttttcctcctcctgccttgcctctgctgaatggggccagatggtttgaccaaggtcatgtgtccatcttcaaaaagagtcagggtggggaagagtaacccctgggagaatgggtctggctttggcatcccggtgaggagaagtgtggtggatgactaggccttgggtgagcaggagaagggaagtgtggcctagaaggattctggaatctgggaccaggagagcagggattaaacatgtgcaaacttga

SEQ ID NO: 716191 - DNA, 105 bp, Homo sapiens
agggagagggagaccgtggggagagagagagggatctctaatttttgtgacaatcctacaaggaaggcagccttcccttttttgctaaacctcagagagttaagt

SEQ ID NO: 716192 - DNA, 308 bp, Homo sapiens
tgaactctctcgtgaactctccgtgaaccatctcgtaggtcaggcgtggggacgtggggtgtgaccctggggttcagggcctgccctgtcccctgtacttcagatctgagttcaaagacaagtttttctgcttcatatttgcagtgtgatcttgagcaagtcttatcttcctgagcctcaatttccttatctgttcaaagggataacagtggcacctgtaacagtgtctctccccagcctcctggaattgttgggggatgaaaagagataaaacagatcaatcattgagcccagagcagtctcacgga

SEQ ID NO: 716193 - DNA, 402 bp, Homo sapiens
  misc_feature (110)..(110): n is a, c, g, or t
ggaaaatctggaatttttagtatttaattgttacagttctttatatattctagatattagatccctgtccaatgggtagctggcaaagactttcttcatactgcagagcngattgctttgctttgcagaattttttttttttttgacttgtaactgcatttgacaactctttggcttcctttctgtgctattggagatcttttcagaaagccctcacatgtagcagtgtcttgaagtttttagctatgtcattaaggcttttggtctattggaattatttttttgtgcagggtgacagatatatggacctaacttcatcctagctttaattctgtgcttaactcatttaactctgttctcctggcttgacttcatcttgcctacccacccactcctccttta

SEQ ID NO: 716194 - DNA, 205 bp, Homo sapiens
ttttttgggacagggtcttgcgtttttacccaggctggaacgcagtggcgtaatcttgtctcactgaggcctcaacctccctgggctcacgtgatcctcccaccagagcctcctgagtagctgggaccacaagggtgcaccatcacacctggctaatttgtttaatttttggtagagttggggtcttgctatcttacccaagcta

SEQ ID NO: 716195 - DNA, 577 bp, Homo sapiens
tgcagtcctgacccatggaattctactcgttcatcgcatctgcagcctcgggttcgcatactctctttacttttcctcgtttccctctttccctgggattgactctgagtggaataccttgtgcaaatccagtaggatctactgtctgcactgtatactttgcatgactttatacgcagtatgtatgttgaaaacaaacaaaaagaagaaaacactcaacaaaaccaatctacatgtcttggactaaaaaaaaaaatatgaggtcgtatactcagttgtccgactcggaaattattgtggcttgcctctcgtgtgctttttggccctctgttgtggcctgtgtatcagccatgcatgacgatacttgtcccgctcttggaggcataacagggggaggaagagccactgtccccggtggattggaggagtgctccggtaccctctgactctcctgtgggtgttggtcggagcagaactggtgaggatgtttgatccgagatttgctgagctctccccaatcacaagctgtctgctgggttctaacctcaaggtcctgctgccaaggcccaggtgagac

SEQ ID NO: 716196 - DNA, 141 bp, Homo sapiens
gtggaatcagcgtcacttacacaaagtggtgcatctaagtggtaaaaggtaaaactacacaacttgacttatttatttatttatttatttatttatttatttatttattatatttgcgacagggtctcattgtgtcaccca

SEQ ID NO: 716197 - DNA, 244 bp, Homo sapiens
agggggtaatggtcccagagcccatggagttagtgctgagaagatctgcaggtggtgacacattccccagtggtgcagagtagaagccctgggcctggaatccccgggctgctctgtgaagtgggctggtgcagatggggactcctcgtggaagcccctgggaagaaattaaccactgtgaagggcatagcctgcctgactgtcaacgctgggctcaccagctccttgctttgtatccccagtg

SEQ ID NO: 716198 - DNA, 237 bp, Homo sapiens
ctgggatgtacattcctggcatccatggaggactggtccaggacctctgccaataccaaactccacggatgcccaagtcgcttatataaaatagcacagtatttgtatataagctaagcacatcctcctgtatactttaagccatctctagattatgtatgataactaatatgatgtagctaatgctatgcaaagtagtaatacttcctcatttagagaataatgactttttgaaaa

SEQ ID NO: 716199 - DNA, 413 bp, Homo sapiens
gcatgattcggcacgaggagatttgagagacagtgtgagagagtgagagagagagagagagagagagagagacagagacacacacacagagtctctctctttcactccccctcttttctcctcttccccttcccctcctctctttcttcctttttccatcccttttcctccctgctcgtatccccctcttttttttctcccccttcttttcctttctacctcctttccccttttttcccctgctttccctctccctccccctctcttttcctccttctcacttccccttccccccccccttctctctttcctccccctttccccgctttccccccccctctcttctcctttcccccctccttttctttccctttccttccccccttttcttttcccccccccccccccccccc

SEQ ID NO: 716200 - DNA, 364 bp, Homo sapiens
ccactgagtctctgtctgttccgttggtgtatatctctgttttggtactgtaccatgctgttttggttactgtagacttgtatagtttgaagtcaggtagcatgaagcctccagctttgttctttttgcttaggattgtcttggcaatgcaggctcttttttggttccatatgaactttaaagtagtttttttccaattttgtgaagaaagtcattggtagcttgatggggatggcattgaatctataaattaccttgggcattatgaccattttcactatatttaagactacttgaactgattacaattcttttatgattgggcagtggatcagtggctgggtttttaaaaatcatatttaat

SEQ ID NO: 716201 - DNA, 311 bp, Homo sapiens
ttaagagacagggtctctgttgcccaggctagagtgcaggggcgcaatcatggctcactgcaacctcgacctcctgggctcaagtgatccttccacctcagcctcctgagtagctgggaccacaagccggtgatggcgcttgtgtgtagtcccagctacttcagaagctaaggtaggaggatcacttgagccccagagctcaaggctgcagtaagctgggactgcaccactgtatgccattaaggtcactgaagccgccgtttcctatgtacagtgataatctgccttagccttcctgagggccttggctt

SEQ ID NO: 716202 - DNA, 173 bp, Homo sapiens
acatacgaacgtgacgatttacactacacttgtatcaaggaatcgaaagtgtcacgggtaaaaactctccaaggttaatttctgtcaaatgcagtatattatgaaaggacaggttggtattatcaggaaatgttttcttaagcttttcctttctcttacccctgccctaccca

SEQ ID NO: 716203 - DNA, 216 bp, Homo sapiens
  misc_feature (195)..(195): n is a, c, g, or t
ataccacagtctgagcagttcacgggattgcagactcttgagtttttctccacaagtcgtaatggtcttgttttcacaaacatagtttactcatcataagaatgtgtaattcgccagtgtttttcatccatacttcatactagattatctctaatgatctatcttcagtttgctacttcttcttctctcagctcnacgctactattgaggccctct

SEQ ID NO: 716204 - DNA, 675 bp, Homo sapiens
aggaattttgtttgtttgtctatatgtgcggcttttcagaagaaatttaatcagtgtgacagaaaaaaaaatgttggatggtagcttttactttttatgaaaaaaaaattatttgccttttaaattcttttcccccatccccctccaaagtcttgatagcaagcgttatttgggggtagaaacggtgaaatctctagcctcttgtgtgtttatggtaagtgtcgtagtttgtaggttatatataatgcatgtattcactaaaataccaatttacaaaaactcctgtcttgctagaccaacggtctgctggttgtgcagtgtgcctgtcactactggtctgtactcctatggcattcgcatttctggtattatcggtacaaagtacaaaaataaaactggtctatcgagtagtaaaacaaacacacaacaaacaaaacaaaaaacaaagcacacacaaatgaacaaaaacaaaaaacgacacaagaaagaaaagacagcgagagaaggcacggcgacggcagcgcagagacgacaaagcagcaccagagaaagaaagaacaaacacatcggcagcgacgaggaggaccgacaacggagtgaagaagatcacaagagagcaaggccacagatagaggaacaacaagagaatcgagcggacataacgaataggagcga

SEQ ID NO: 716205 - DNA, 356 bp, Homo sapiens
tggtgagtgcgtgtatacaagcaccatgccaagcaatgtaaaagcataatgaaagagccaggatgaagtgcagccaccctaactaccccatgcaactcttaccctatggaacaaaaatccttccttagtctcaagttcatccatcctaaaaggaaaaaggaggatccaatgagcactcggaaccttcggtcactatttatccagattcttgttagaccacagggtatcccgaaggagtatgccatggcatgtcagcaaaatccaaataccactcttcagaaggtaatatacttaaaacagaaataaaacagtaaaattgcaccctatatattcacaaaatttacactggaaattat

SEQ ID NO: 716206 - DNA, 447 bp, Homo sapiens
acaactcagttacgttacatagtaataattgctcgcttgggtggaatagggacgcagaagtataggaccatgtggaactcagaaaagggagccctgaagaatgagatttattgttcttaccaggagagtccaggtgctagagttctctccttgtaagtgactaaccttctcccttttggtacacaatcctcagatgaacggagatgattcattaggccattctagcttaatggatgcatcactgtgcaaccacgcaaatgcctcatttctgattcactcatttaatatttattcgaggagtgctgggtactaggccattagaagaacaaacaacaacaacataggcctggaccttgcacttgcagagttcacaggctagagaggcacacaagttaaatatagagacagctgaaagagctgacgtctgggacagagggaggcccctgg

SEQ ID NO: 716207 - DNA, 1284 bp, Homo sapiens
gtgagggttgtctctcaagaaagtatcttggaggctactccctacatgaggtcccagcattggtttcgcagggcccagctgtgaacatcacttgcaacatctgagggccttatacaccaatacggcgcaaccgatcctagcttccccaatgtaggaataattttgtgcggcgaaatcggtcccgaggctataaagcttcccatagaaataagatcatggttgaatttcaacgcctaaagtacgcaaaaggggtgaatgtttgaatctaggggaaaccaatcggttggagggccaaggagaatttggttggggctccagcataaagttgggacattgtataaggacccaggtcgcccttggaagagtattaaacggtctaagaagcttaaattgtatggggataatagttatatgttgtggttactgataggtaaggggccctaggtatagagttagaagtgttaatgaaaggtctcccattagggtggggggtcacttgaaggtctgcgctgcgttatctgatatgtgaaggtttcgtcgtagtttagtagatggatcaagttaagtttggaaaagtggatattgaataattaagagacgaatggtgttaagagagatgtatagggataactagaaggcggaaatgaaacaccacgtttgtctagtagccaaacctattaaatcggtaactatcttatattgctagcgaaagtcctagcgtatatcatatgctcgtatagggtggtaaagtagatattctagcgtggtagttctataagtctaggctagctggatagcaaataggacggtcaagataggtgtcggctggctgtagtacgtggaactgcatagatatggtcttttacggagagttgaatgctttcagtgagtgtcttatctaatatgtctaacataacgtcaggagtaggagtatataggagggaagagagatacgaaagtgtccagctgttcaagtgtagacagaaaggaggcactgaaggttcacttgtcatgtttctagcagcccgcagcgtgaacccgtcaggccgtggttctagatagcgccagtgtagtgtaagtagttgcagagcgtgctgagcatgctcggacgatagaagtaaagagagaaatagggttcgtttagtcagaagagagctgagaatctattctgccatccagaagtgctgagaatcgcagaaggaaaagtgataatgattcaggcactggttccaactgctgatagctagcagtagttgacgttgaagttaattccaatctctagcg

SEQ ID NO: 716208 - DNA, 131 bp, Homo sapiens
taatcgctagtatatcattttggtcagaaaatatatttggtatgatttcagtcttcttaaatttctgaagactagaggggaaactatcacctaaaatcagtttggaaaacaagtacataaaaatgggaagg

SEQ ID NO: 716209 - DNA, 134 bp, Homo sapiens
cgctatggatttagttggacatgagtcatgtcacccacagcactgaaccactatttaagaacgtcagtccatgggaaacatctacttctagctattcttcctattttgtgctccggccgttggttcctatcttc

SEQ ID NO: 716210 - DNA, 1096 bp, Homo sapiens
gagccttccccgcgagcggacgcggaagcgcctctgtctcgctttttacttattttatcccccctttccccttacttttagaatattatcactatacatattagctcccacatccaaccaaaaaacgaatttcacctggagaggcggaaaaccggggaaggggacagagacgaggaacacacaacaagaaagagaagacaaaagcagaaacacagagagacgggaagaaacgaaaaaaggaacagaaaagagaaaaagaaaaaaaggaaaagaagagagaacgaagagagagagaaaggacaaaagagaagaagggaagaagaaagaggaagaggggggggagagagacgggggagagaggggaagagaagagcaagggaagagagagaggggagggggcgaggacaggagggcaggggagggggggaggcggaggagggcggggggaggggggaaaggagggggagggggaagagggggagaggagggagaagagagaggggggggagggggagggaagaagggagagggaggagaggggggggagagagaggggcggaggagggggggggggcgggaaagagcgagggggcgaggaggggggagggggagggggagaaggaggacggggagggggagagggggagagaggaggaagagagcgggggcagaagcgaaggggcagagaacggaacagagaaaagagaggccgaggaggaggagaggagaaggagagggaggagagacagaagaagggggggggaaggggacgaagaagagaggaaaagggcggacagagaagagaggagagaagggagggaggaagggggggggggagggcggaggagcgagagacgaggaaacgggaagaagagaaggaggggagagaggagaggcgacagagagaggggaaaaaagggagcgcacggaggagaagagaaagaagagaagggaaaagagagaagaaagagagaaggaaaaagagagagaagaagagaaaggaacaagaaagagaagagaaaaaagagaaaggaaaaaggaaaagaagagaagagagaaaagaacaaagagaagaaaggagaaaaaaaaaagaaaa

SEQ ID NO: 716211 - DNA, 194 bp, Homo sapiens
gtgacaagtgtggggtaagcttagtaaattctatccctcagtttaccccacacgtgacaagtgtaaagctgctgagggatagaatttactaagcttgttttttttaatagtgaagtctgtgtaatatgttgtactgaataaggctgtctagaatttataaatcgtgaatacacaggtaacattgtcaaaaaaaa

SEQ ID NO: 716212 - DNA, 186 bp, Homo sapiens
ctgattcgtcatgggtgtgcaccatgaggacgtatgacaacagcctcacgatcatcagccatgcctcctgcaacaccaactgcttaggaccctgggcaaggtcatcccatgacaactttggtatccgtggaagtgactcattgaccacagtacccatgcgcatacactgccacccacgaaggactg

SEQ ID NO: 716213 - DNA, 114 bp, Homo sapiens
gtgatgtagagtatccccaagtacagtgtctatccaagaagacaaaagcatctcttcttctaaggcttaggttctgcccagacttcctgatacatggaatagctgctgtagttg

SEQ ID NO: 716214 - DNA, 110 bp, Homo sapiens
actcggcccctctgccgccccagtgaaatagaagactgattaggtttctgagtagaatcaaggcaggatccttcctgtctttggtcctcaagtagacagaactccagacc

SEQ ID NO: 716215 - DNA, 472 bp, Homo sapiens
cagtatttagctcctacttttaagtgagaacatggcaatatttgtttttctgtttctgcattaatttgtttagaatactatgcagccataaaaaatgatgagttcatatcctttgtagggacatggatgaaattggaaatcatcattctcagtaaactatcgcaagaacaaaaaaccaaacaccgtatattctcactcataggtgggaattgaacagtgagatcacctggacacatgaaggggaataccacactctggggactgtggtggggtggggggaggggggaagggatagcattgggagatatacctaaggctagatgacgagttggtgcagcgcaccagcatggcacatgtatacatatgtaactaacctgcacaatgtgcacatgtaccctaaaacttaaagtataaaaaaaaaaaataatgtgtcagtcatgatacaagatgatttaaataaaagacctcttta

SEQ ID NO: 716216 - DNA, 736 bp, Homo sapiens
cctgagggtctggcccttaattctctgtgtctatatgagattctgaatccccagagaaagctgtctcttgcaagaagctttgatgaagccattgtgaacttgatacattaagtgaagagtcataaaagacagagctaataatgcaattactgagagacaacttgacattgtggacatcggatacccaaggagacgaagctgaagcaggagaaggaggggcaaattcaccggcttccaagcttttgtctgcctcattctaaaatttacacagtagaccattttgtcatccatgctgtcccacaaatagtatttagtatacgatttatgacaggtttcatgtccacttctattcgaatttctatatttcccatgtggtcccatgttactattacgggacgtcgagccagttcaccatctagggagtcaatctgtatcatcttgaggtggccaaatatgcgcacatgctgagaattttctatacacagttcatcacgtgtcgcccatagtacttctcgcgaacatcgtggcttccaacgcggccagtgtacaccacttgcttcccatgctctaagcccaagcaaacactgcactacatacctgtttctcctggcgcggccataaccgcgcaatcatgcgctctcagccacaggtgtagtcctctgcggtactctccacgttggcagccttcacaggctgtgctgaatcatcccatggtccaatttcaccattatctcga

SEQ ID NO: 716217 - DNA, 934 bp, Homo sapiens
agcggataaaatgatttgacgtttgctcaagatcatactatgataaatgccacagccaagctttgaaatcagtttggcctgacttactgttatgtactaaacactctggggtgtttaacaaaaaaaaaaaaaaaaaaagactctccatcttatcccagaaagtttgctgtaagttaacttggctcctactcaggttggaggaagatacctgaggttaagaataagcagtcactgaaaagattgaaaatttaccacatagttatttaaacacacacacctaacttgggaaattctttacaaccttggctggcaaattaaccctatttttagagaatttaccaaagacgctttctggttttcttctgggtggctggtggttacccctttattttttttctttggcttggcaacctgggagcctactcagaaatggagggtcctttaagaagttatccttagttaaatggaaggattgtccatttcacttaagaaaaaccttttttacgggaagaactcagtacacggttcctggacttagttaaccagaacctgaccaaagaccacaatcaatacctgaaatctagttctctggccccaaaacaattaggtcccatgggggctccacggccctttaactgaacataattgctagaaccttaatattgacagattctcttttaaaactcctggaccatgacttatggggggcacattcttaaaaagaaattccaagagtggaacttcccatttgcaagggtctaagggtgtgggaattattgcagtttgcaccctttcttacaccgacttacactgggccaagtggaaaactacccggaccttttttcaacaaatctcccgagcttataaagaaacagggacatcctttccaaaaacccaacgaaacccaaaaaagcacactttgacacgcagttct

SEQ ID NO: 716218 - DNA, 686 bp, Homo sapiens
tttgaaactttgatatagcacctttctaattcccgtcttgttgttcctgcttttaatgtgatattcgcaaaacctgcccaaacccatgtatctaggcttctccccatattttcttctaagtgttccagagttataagtctctttaattttaagtttttatagtttagtgtgtgtataagtattttgtttcgcacttgagaggaagacaagggttccacaggtctccgcttaatcctcttccactcttaagaccgcttgagtttttctcacccccactctggttgtgggagtctgaaccccctttcttcacctgctttggtcactggtaaccctagtaaaagattatatgataatacttgcacccggtttatttctgggttctttgttctgtcactgtatttttttttcacctttatgcccttacccccttggttttatttttgtagctcttggactcttttgacactcactcgagtgtatgggtacctcttgttctttttctaaagctgttggctattcactggtacccttgagattacaccatgaattttagaattatataaaatatctctgcccaataagtaaccttggaattttaataaggatgcaccttgaatttgtcaccatactccagaaatattgcccgtttaaccagtattaccatctcctggctgagaaaccatgta

SEQ ID NO: 716219 - DNA, 123 bp, Homo sapiens
tcacacagcactagggaaaacatggcttatactgtggaatgcctgcggggtgatgttgatattctaatggagttcctgctcacgtgtcaccacagcaccggagtttcgtcgttgggaagtagc

SEQ ID NO: 716220 - DNA, 315 bp, Homo sapiens
ctgttaccaactctgcctatccaagttcaggatcacaggtggctgcagctacttgcagcagtttcagggtacaaggcaggaaccaaccatggacaggatgccattccatcataggctttgctcatacacacacacactcactcagattgggacaatttagacacatcaattaacctaacgcacacatctttgggatgttggaggaaattggagtacatggagaaaacccatgcagacacggggaaaactaacaaactccatatagagtggccttcggtgggaatcgattttttttctcatcaatgttataccaaa

SEQ ID NO: 716221 - DNA, 331 bp, Homo sapiens
tagtcatgggatggctgatataactaaaagaaggacctagcttgtattggcgcatttttcttacagtgcctagggagtaggtatctaataaagaaaggtgtatcctttaatattaatgcccttaagaaaaatgcctttctctataaaattaactctgcgcctcgagccttcggcgaccgtgggcctaggccataggggttcccgtctttgctcgggtttttggctggttgcgccccacagccagcgccgacccccaacatcaccaagccacccccgcttcccacccgacccctcgctcctaccactccaccccccatacctccggcacaca

SEQ ID NO: 716222 - DNA, 113 bp, Homo sapiens
gtcatcgcgtccgcttctgcttctgccgcttcctgcttcctgcttctgccgttcctgcttctgccaaccccttgcttcctgcttctgccctcgtattccaggtcttggtgagg

SEQ ID NO: 716223 - DNA, 248 bp, Homo sapiens
  misc_feature (178)..(178): n is a, c, g, or t
ctcatatgtggaagggacttgccttgcctcagatgagattttggacttggacttttgagtaaagactggaatgaattaggactttggggacttgtcaggaaggctggattggttttgaaatgtgttgtctccagatttttctgaaaatattaatgaagccagctgggaggaggagcantttggatgagactgggataagaagtggttaataaaatctgggtatctattctgaaaaaaataaagcatga

SEQ ID NO: 716224 - DNA, 482 bp, Homo sapiens
tacaaaaatatctatggaatttgccagtttaagtcccaaagtatcagcacactaagatctgaaacaacgtcaaaaaaatgtaaaaacaaagataaatatttttcattttcagtgttacaagtttgaagtgtctttatctgtgtgttaggaggtaggcagtctttaggcagaaggtacttttttttccatataaatttaggaggtacccgtgcagttttgatacatggatatgttgcatagtggtgaagtctgggctttgggtgtagccatcatctgaatagtgtacattatacccattaagttatttctctttccttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgc

SEQ ID NO: 716225 - DNA, 671 bp, Homo sapiens
  misc_feature (1)..(1): n is a, c, g, or t
  misc_feature (564)..(564): n is a, c, g, or t
ngttaaaaagcttacttattttaaaaagacccgacaaagcattcagctcagtcctgcccagctgtccagccccagtggcccttctctaaggctgtggcgagagtcagtgcaaacccggccactgtttcctgggggtgtgttcttgcgggttacacggcctcttggaattcaactcccgccacccccctgcaaacctaaagcatccgtggcaccaccttggcacctgggccagaaactcagatgtctttcttgactcctccccgtctcaccacacccaagtccccatgccctggctaagaaaatactcctccttttttctacaatgcctgtgccgtggaatgtccatctgtccaatttataaataaaaccgggggcttcttctaggccaggcctgaggatgctgtggtcatgctggcagacgaggtcctggctgcctgggccttgcagcctcgggtgtgaatgggtgtgcgggtgggagttgggaggcacagtgataaacaagtaacaataaacaagaacgcagggctgccgtttaattggggctcctgcaggctcagctattcnctcccttcttcttctgctcctgtttccacaaagggaagcgcaccaggaaatgctggtgaatggaattgggtgaaaagtgaagaaatggctcctgcaacttgaaaaga

SEQ ID NO: 716226 - DNA, 219 bp, Homo sapiens
  misc_feature (39)..(39): n is a, c, g, or t
  misc_feature (48)..(48): n is a, c, g, or t
  misc_feature (52)..(52): n is a, c, g, or t
  misc_feature (66)..(66): n is a, c, g, or t
  misc_feature (69)..(69): n is a, c, g, or t
  misc_feature (88)..(88): n is a, c, g, or t
  misc_feature (90)..(90): n is a, c, g, or t
  misc_feature (94)..(94): n is a, c, g, or t
  misc_feature (97)..(97): n is a, c, g, or t
  misc_feature (100)..(100): n is a, c, g, or t
  misc_feature (103)..(104): n is a, c, g, or t
  misc_feature (123)..(124): n is a, c, g, or t
  misc_feature (155)..(155): n is a, c, g, or t
  misc_feature (166)..(166): n is a, c, g, or t
  misc_feature (178)..(179): n is a, c, g, or t
  misc_feature (190)..(190): n is a, c, g, or t
  misc_feature (202)..(202): n is a, c, g, or t
ggcgaaggggctcatggcaagtggcagccattggaacangggttgagncccnggcctgggaaagcncancagggtatgggggaaaccntntatngcncgnttnntggtgcagtgcacaccatnntctcataccctgtcagccctcactgggtcangggccttgggnagatgtcaaagnncccagcagcancggggtggccanctggggagggcatcctt

SEQ ID NO: 716227 - DNA, 280 bp, Homo sapiens
tacagcgccagatctagaggataccctgccaaagtcgtagtacaagtagttgtagattacagtgcacgcgccacacacccagctacatttattccatattttacgtagagacaaggtttcaccacgtatggccaggctggtcttgaacttactggcctcaagtgatctagccctgcctacggcctcccaagagtagctgggacttagcaggtgtgaggccacctgcgccccagccaaggatctacatatctattaattataggctagacagagtaatcca

SEQ ID NO: 716228 - DNA, 909 bp, Homo sapiens
tctctctcgcgtgctccctctcgccgctgtggggaagtcggggccgccgagcggccgtcgccaccgcctcgccccgacctccttcccggtcccctcccggccagtccctcccgcccgcgcacccgagtagtgagtggccccggcagggtctggagagtacgcggggcgccgggtggatggttaaaccatgtacaccggaggattttacagaggactcctgggagagttggctctcacggttctgatttacgattcatcagcaactcctataaacacacgcggacgtcactcaatgaaagctcttcagcagggtttcatatgtccccactgtctgaaatctcttggactctgctcgatgaacttccaaacatccactcccacacgccgtcatgatgctggctaatgactcaggtcacggaggagagccctaatctcgcctcgaagccccgatgcatgtacacactgctcagacaagaggtcccaggacctacaggctcacttaaggcagaccaaggctacacgcgaaccaaccaccgacagcactaacccatcatcaacggcgcaccagcgaagacgccccccctgcagccggcccaccgacccccccgctcacccccgcccagacacaccaaccacaaccagccccagaccacaacacctcccctcacgctcagaacgctccttgcacccaagcagcccaccccgccgcaccgcactccgcctgcagcgacacgccccaccaaccgccccaccgcgcgccccccgccaccgcacgcacctccacacaaccccaaccccccgcccacccccacacaaagcacgccgcgcccccacccccacccccacccaccccacccccacccccaccccccacccccccccccaaccacccaaccccccccaccccac

SEQ ID NO: 716229 - DNA, 353 bp, Homo sapiens
atatacaccacatatcccatggccaataaagcgcattcaatgtgtttataagccacacagtcacttgtgtttaagcaaccacaagtccaaagtaaaatagacccacaaaataatgacgtgcatgttcatacacatccaaaattcgcggcatactcagtaggtacctacacacattccgagagttcagattttgttttagattgtgttttcttacattctggagacccgaagctacagctcagctctcttccatattgcgctcacaaagcctcccacatatcctcactctgtgccccccttaaggctagaggtgagcatgtccctcacaagtgcacatgtcgagccatcagcaa

SEQ ID NO: 716230 - DNA, 772 bp, Homo sapiens
agcggggggcacggcgcgtggcgtgagacggggcggggcgcgcgtatcggcgccgcggcgcgtgacgcgttttcaaatcttcaaccgccgcagcccactcgtttgtgctttgcgccttcctcctccgcgccttggagcccggatccggccccggaaacccgacctgcagacgcggtacctctactgcgtagaggccgtagctggcggaaggagagaggcgtgcgtcctgtcaacaggccgggggaagccgtgcttacgcgtgtgccctggtgcgacacgtttctccggacccagcatgtaggtgccgggcgactggccatgaactccggagccaatgaggatccgacaagtaaaggacatttccagggtgggaatccaagtcagaaaagtgaaaaaaacagaccatactctgaaaatctctgagaaactggataacaggccagaaaaaattccaaatgtaagccacttgtggggcaaacacggtatttaccttgacttaaccttctgtcaccatatctgaaaaaattcaaaaggacattaaggatctgggaagggcgagttgaagaatttctcagcaaagatatcagtgatcttatttcaaataagaaggaagctaaatttgcacaagagcttggggtcgaaatttctccctgttaccaagtccaagaatctgcatataacttggaggaaacccactttcacctcattcccaggcatgatggcagttcactttacagtcaccagacacagtgtggttaacgcagaggaacac

SEQ ID NO: 716231 - DNA, 374 bp, Homo sapiens
  misc_feature (4)..(4): n is a, c, g, or t
  misc_feature (12)..(12): n is a, c, g, or t
  misc_feature (19)..(19): n is a, c, g, or t
  misc_feature (29)..(29): n is a, c, g, or t
  misc_feature (56)..(56): n is a, c, g, or t
gacnatttttcnttctggngcgttatcgntctggtcgaatgcagcgacagcaccancgtaggttttagccagtacggtagtgattgcagcggtcagcgttgttttaccatggtcaacgtggccgatagtaccgacgttaacgtgcggttttgtacgttcaaacttttctttagacatcgattgtccctctaagacacggataaatcggtgatatcaccacatcaaccaggcaacatgcccgacttgttgaatgcaataaacagaaggaaaaaacagggaggagaaaagaagtggtgctgataggcagattcgaactgccgacctcacccttaccaagggtgcgctctaccaacttgagcttattatccagcaca

SEQ ID NO: 716232 - DNA, 595 bp, Homo sapiens
cacatgcccggctaattttgtattttaggtggacacggggtttcatcatgtggccagactggtgtcaaactcctgaccccgggtgatctggctggctgggcctcccaaggtgctgggattataggcgtgagccaccacgacccaaccttagaaggaatatggggagtctgggcatggtggctcatgcctgtaatcccggcactttgagaggcccaggtgggcggatcacctgcaggttaggagttcaagggccagcctggctaacgtggtgaaatcccgtctctaccaaaatagaaaaattatgccgggtgtggtggcagatgctgtgtagtaccagctactagggaggttgaggcggaagaatcgcctgaacccgggaggtgacaaggtttgaggtgaacctagatggtgccacgtgcattccagcctgggcacagagtgagatcctcagaaacaaggttattgggaaaagtggactgtgaggggggccatgttgggaagttgacctgacacaagctcgcacctggacacgctgctgggagcggaggacctgagcctgccgagctgtggacgaggagacgtgctgcggagtgca

SEQ ID NO: 716233 - DNA, 180 bp, Homo sapiens
  misc_feature (174)..(174): n is a, c, g, or t
atctttgaatgttttaatctccagatttatgaactttttttcttcagcaattggtaaagtatacttttgtaaacaaaaattgaaatatttgcttttgctgtctatctgaatgccccagaattgtgaaactattcatgagtattcacaggtttatggtaataaagttatttgcanctgttc

SEQ ID NO: 716234 - DNA, 304 bp, Homo sapiens
ccgtgcagtgtgtgatgttatggtattttcttatatttttgacgatttgccaaaacgcagtgtggcggattcccgccggagaaaaacccaagatatgagttgggtatattagagagtggcctaatacggcccagtgacttgtggatacagtgtacaggaggattggtgtcctgacactgtgattatgtccatatcatgataccgtatgcggtatcgatacccagttttcatattttattcgggagattacacagacttgtagcttatatcctggtattatatctgttcataacaccacacaatt

SEQ ID NO: 716235 - DNA, 474 bp, Homo sapiens
cacgaagtggagtactgatacgagcgctgtcttgacaggagaggcatggtgaaaattgtattagcggtgaagatagctggttacctacagtaggacggaaagacccaatggagctttactgtagcttggtattgggttttggcattgcatgtataggatagttgggagactatgatggtatggcgctagctgtatcggagtcatcggtggaataccaaccattcaatgctgaaattctaatctgtggtttgaagccacggagacagtgctaggtgggcagtttgactggggcggtcgcctccgaaagagtaacggaggcgttcaaaggttctctcaggttggatggcaatcaaccatagagtgcaaatggcataagagagcttgactgcaagactgacgggtcgagcagatgcgaaagcaggacatagtgatccggctgatccgaatggaagggtcgtcgctcaacggattaaa

SEQ ID NO: 716236 - DNA, 221 bp, Homo sapiens
caggctcagtttattttaaatgccatattgaaaacatcattcttaagatccagtacgtaggacatttattggattaaactgcagcatttatctatgtctttagctgtcattgttccctctctgaattagctgtacctatcagccttcctttggttttaagtactgatttttttttaaaaaaacgagggactgtctaccattctccccactgtgctgttata

SEQ ID NO: 716237 - DNA, 1463 bp, Homo sapiens
gttcaagtagtgagaaacggccttgtcacagttcctacgcgatccctttacttggcactcataggaggtggctatacgctgtcgcagacacgcactgcacgggtcaccaatctgatactgtgtcggctctaacgatcgtccgacgaatgactgagccattggtgcattagggtggacattgggttggtaattcagagtctgcctgtgtactcgcagtctcaaacacacagttgtatgacatttgaccccactcgccattgttccgagtaggagagagaagagattcatcgtaattgtggaagcgagctaagatgttccagagggatgagtaccgaaatggctgctgcgattgaataaagcctttggcccatggatatgaactatgagctaatgattgctagtggtgaatgcttctgaatgaaatgaatgaagcccccattgtgccttaggctctctgtgtgtggatctagctgggagcgagtgattttgcgcgtgagatcgtgccactggagaggtgtgcgacagggcctatatgccatgcaaaaccagaaacctgcaaggagccgagtatggactggcaacgcgctgttgctcaagatccgtgaagcatcaaacgtccgggctcggtgcgtttccgacattcgctcccgtttggggcgtggtagtttcgggcccgttggggtggcaccccgtgtatctgcgtccggtgcgttggccactagcagcgtgaatcctgtagtccattgagagctggggcgttgacgagacggtggattccgttaaaggtcacgatgatctcaataccatcgcgagatagtggctagcgatcgagaaaacgattttgtcgccagagcctctagcgtagataggcatcggggtgggcccctgtcgagttgcggaaacgagaacgtgcacgtgcaatcgtttggagccaccttgagcgcggtctagggtccgctcaacggttttctggcacagtgtcccatgcttaggttggtaacaactgggccctccccccatcggttgcgagggaagtaggtgccttttcgcaatgcaccagttgtttggcttaggattatacggggacagaatttccggtctcagggcggctagggtaaggattgggggcggcgtgggtgttcttctctgggcgttccccgttatacggtccaatggttgtttaacgatattttggtatctgtagagccacgtttttcgacggcctttgggggcaatttggggtcgttgccacccccatttaacagaggttgtttcccgttgttggctcacttcgtcccttatggacgagaggcaaggggggagaagtcctctaccgtggcgcgggcggagaccctcccggttccgttaaggagggctccgcgaaaccatcgtggcttccttggagcgtcaagttctttacactttttcgttgctccccggagcctttttttgacacttacacc

SEQ ID NO: 716238 - DNA, 482 bp, Homo sapiens
  misc_feature (185)..(185): n is a, c, g, or t
cctgggtgtgtgggtgcttgaggatccctgaatcgacggtttttgctgactgcagaccaggttcggcctctcggacgtctgctcagtccctatgacgggcacacgtgggcaggtgctggaggtggtgcgctcgccgtcgccgcgctgcgctgagctgcagcaattccaccaggtcgctgttgtcntccgcttggcaccagagcttccagtttgacgaggacgacggtgacggggaggatgaggaagacgtggatgatgaggaagacgtggatgaagatgcccatgattcagaggccaaagtggcgagcctgagaggaatggagttacaggggtgcgccagcactcgggttgaatcagaaaataaccaagaagaacagaaacaggtgcgcttaacagaaaggcggctgacaccatgggaggtgtgggttattgggcaaagaaaaagaagaacgtgaccgggttgcaatgaaagctctagaggg

SEQ ID NO: 716239 - DNA, 233 bp, Homo sapiens
cccaatttttttgggcccccggtttttaacccggtgtgggccccttggggggccccctttttccccttaaaaaaaaaaattttccgggggggggggggccccccctggggtttcccccccccgggggggttgggggggggggttttttttccccgggggttttggggtccggtggggggggtttccccccccccccccccccgggggggggggggccgcccctttttttccca

SEQ ID NO: 716240 - DNA, 139 bp, Homo sapiens
gcctgaggagttggatgactctgactatgagaaagaagattgatgtcagaagcaggacgagcgtcagacagaagacgatcagctgatagctggccagagtgccgggcgatcatggctcagcttccccagggaccgagag

SEQ ID NO: 716241 - DNA, 418 bp, Homo sapiens
  misc_feature (40)..(40): n is a, c, g, or t
  misc_feature (71)..(71): n is a, c, g, or t
  misc_feature (76)..(76): n is a, c, g, or t
  misc_feature (85)..(85): n is a, c, g, or t
  misc_feature (110)..(110): n is a, c, g, or t
  misc_feature (186)..(186): n is a, c, g, or t
  misc_feature (202)..(202): n is a, c, g, or t
  misc_feature (208)..(208): n is a, c, g, or t
  misc_feature (232)..(232): n is a, c, g, or t
tgcaggaataaggggaaaggtgcttaccgtatcgagtatngcacctacggtttcaccgaaatcgtaacgtncctgnctcccgggntaccgttgttcgaaagggatgttgnagtagcgctactaccgggctgctggcctcacgcggcagacacttaatcatccgctctgccatcacccttagtcccnactgcaggcgaaccgncacggnacacaccggatgcacgggctggantagctcatgcagcaggcagattttgcggctgatattttgtttctgctctgtggaaaggatatttccaccgctggtggttcagctttgtctgactggctgataacaaacagcatcttatgccggtatgcttcgccaatcacctgacggtaaaagtgctcatcagtcgccagtgcccgatcatcagcc

SEQ ID NO: 716242 - DNA, 246 bp, Homo sapiens
aaattcgcggccgcgtcgacagcttttttgcaaaaatcaaaaatggcaaaaatcagacattttctgtccaaaaatgatgcataaaaatgtatccatgcttttgtcacttctaggttagactactgcaattctctactttccggctacccagataaagcactaaataaacttcagttagtgctaaatgcggcaatcctgactagaaccaaaaaatgtgatcatattactccagtgctattctcccta

SEQ ID NO: 716243 - DNA, 208 bp, Homo sapiens
gaattcggcacgaggagagactgaggggaaagagaggagagaaagaaaaagagagttggaacagtaaagagaaaggaagacaacctccagagaaagcccccgagacgtctctctacagagagggcgacgcaccccggctaacctgcaacggctggggagcgagtgcccctaaatagccgtttcccttgcttttatgcctcggagtact

SEQ ID NO: 716244 - DNA, 293 bp, Homo sapiens
  misc_feature (52)..(55): n is a, c, g, or t
  misc_feature (117)..(119): n is a, c, g, or t
cacgacgggtacggtatgaacaggggataaaggtactgaactctcatacagnnnnaccttctcactcagagacttcttcctcctactacccttgacaccctttgcctccttgggaannntagtgaggctagtaggcaatggactcttggcactcggccgtctagacttcttgcccattggggtgcgcttcaggctgaggaaagatctgttgggcccacagatgacaggtgagagagcagaagtcaacacggtgcctagagggcttggggtcacattgtattcatccagaaggc

SEQ ID NO: 716245 - DNA, 968 bp, Homo sapiens
tcgaagatgggtgtgtaccttggttatgtatgaactcctcagtatgtgtcgtgaagctatgaaatggacgggtaaccaatgtctcgttaacacatgaatcactggcttcttacttacctgcgctgaaccgaaattctggctgatgaaggatcatgatcctataccccagcttgaagtacgtggatgtatacagaatgctgggattcggggctctagcaaactgtgttattgtagtaaaatatgttggtcattatcgtataaggattgattttcataaactagggaggctttctaagaggatgtgtgtaggacggtgtttatggtgtctgtgttcgtcaagatcttagggattggaataggtatttgaagatagatctaggttggaaacaagagatgcatacatgtgtcctagtttgttctgccttataaatgaggaggagagtaggggaagggaaagagggtcattgtgatcaccatgagattctcacattgttatgaacgtgcaggtgttcttatatataatgagtgatgaatgatgtgtggacttgctaacctgtagtactttcaggaataaatgaagttaaatgattctggggtgagtatagtaagtgaggatataagatgtgaacttaatgatgctggtaggtagaaaagaaatattttgtctatttgtgaacttgtacttggtggggatgaatgatggggtttgacagtgtgttcttagggtatttgtgagtatgggtaagccaatctttaggttgactaaagaatagatgtgaaataaacatcgtcgggttaaagataatgtatctgggggacttgagttggaaagaggggggaagggtcgagaaattgacctgggaagagggaaaaaccttgtttcgaagaggcttttgcaaaggggggccgtaggagagctggtacaggaaggggggcttttttaactgttggggaaaattgtgggggcc

SEQ ID NO: 716246 - DNA, 195 bp, Homo sapiens
  misc_feature (5)..(5): n is a, c, g, or t
gtcgnggtctttcactggactatactctaaacagaatttggtttcctgaagggcatgccctgcttcaaatgggcccttatcctactgactacagaatactgtgtttgagtcgtatacgattacaccagacaagactgtgaacacatgtgagctactcaaagatcctattctgcttccttataaagataaagggct

SEQ ID NO: 716247 - DNA, 417 bp, Homo sapiens
  misc_feature (127)..(128): n is a, c, g, or t
  misc_feature (224)..(224): n is a, c, g, or t
  misc_feature (248)..(248): n is a, c, g, or t
  misc_feature (271)..(271): n is a, c, g, or t
  misc_feature (280)..(280): n is a, c, g, or t
gtctggatcagacaaatgtgtctgctgctgcccggaggagaaaaatgtgcctgtttgcaggcttccagcgaaaagctgttgtagttgggccaaaagatgaagactataagcaaagaacacagaaganngcagaagtagaggggaaagacctaccagaacatgcggtcctcaaaatgaaaggaaactttaccctcccagaggtagctgagtgctttgatgaatancctatgttgacttcagaaggagangcccaaaactcttgagcatatanggagaagcnaaaggctctccccagaaagaacagacactgctcaagaaagcataaaatagagtgcagccccgtttccaagtgtgcctgaggcgtgagttcattcgtgtgatttcaggagcccctgactgtgcgattatgggccaacc

SEQ ID NO: 716248 - DNA, 317 bp, Homo sapiens
tgctttggaccggcggcacggacggctgccttcatgggggattcggaggccccctgctgtgtacaactgtggcccacggcatcgtctcctatggaaagtcgtcaggcgtttcttctataactcttctcctaggttctcccgtttttgccctggataaggacaacaatgagaagcttcaaactgctggatcagattgagacccccctgtgactgactcttcttctcggggacacaggccagctccacagtgttgccagagccttaataaacgtccacagagtataaataaccaattcctcatttgttcattaaacgtc

SEQ ID NO: 716249 - DNA, 402 bp, Homo sapiens
  misc_feature (127)..(128): n is a, c, g, or t
  misc_feature (224)..(224): n is a, c, g, or t
  misc_feature (248)..(248): n is a, c, g, or t
  misc_feature (271)..(271): n is a, c, g, or t
  misc_feature (280)..(280): n is a, c, g, or t
gtctggatcagacaaatgtgtctgctgctgcccggaggagaaaaatgtgcctgtttgcaggcttccagcgaaaagctgttgtagttgggccaaaagatgaagactataagcaaagaacacagaaganngcagaagtagaggggaaagacctaccagaacatgcggtcctcaaaatgaaaggaaactttaccctcccagaggtagctgagtgctttgatgaatancctatgttgacttcagaaggagangcccaaaactcttgagcatatanggagaagcnaaaggctctccccagaaagaacagaccattggttacacagaaaggcattaaaattaaggagtaggcaggacccagtttaacacaggtggtggccatagggcacgtggaggattcaatatgcc

SEQ ID NO: 716250 - DNA, 298 bp, Homo sapiens
  misc_feature (7)..(7): n is a, c, g, or t
  misc_feature (14)..(14): n is a, c, g, or t
  misc_feature (16)..(16): n is a, c, g, or t
  misc_feature (58)..(58): n is a, c, g, or t
  misc_feature (62)..(62): n is a, c, g, or t
  misc_feature (272)..(272): n is a, c, g, or t
agccggntagtgangnggcaaaggcacgaaagcatttaagcaacctgcaaagcggaantggnaccgcagaagatgtaattggcagcaggagacagccaagagcacctaaggaaaaggcccaacccctgggaagatctggccagcttccaagagctctctcaaacaccaggccacacttgagggaactgggcaaatgggtgctgcttgattagctttttacaagcgctcccaaagcaaacaccttgacagtggggaaaacctttttaaaattnttcccaggaggatttttttcggggcc

SEQ ID NO: 716251 - DNA, 813 bp, Homo sapiens
gcagacctgaaccaggtggacgaagaacgcagatgtgtcagaacaagtctccaagtggccccgtggaatcggtcacctctggagaacagcccgttggtgtggaaggaggggcggctagcttcgtccgactagtaccgtggaagaggtgggctacgagcagacatccatcctcgaatcatgcggtccaagcagcggtccgttccctgcatgggcgcgctctgcgtgtgcagcatcgagactgtgggcatgtggagccagagatgaaggggcccccagggcgtcctacctaggcccttgcagggctcagttggtggggagtctgctgctggtgaaacagatcgaggagcagatacaggaggaacgcggtagtgcaaagatggcgaaatgatgcgctttgggcggctcactgctgggtgcatgatccgcacgttcctgcatgaactgcgaggacgaagacagaggacgaggaacgatgaatgctggtacagaggatgctagaacaagaagcagcgttgtgaatgcgtctcactatccagagggctctggtgcccgaacagtggtaatgagaggatgacgtgaagatgagtctgaggatgggtatcaagtgagttacgattacttgggctatggtagaagatggtatgcccgttgctccatgcccatcgcgtggggtgctgcgacctggcgcgggacccgggcaccctgaagctggacataacctcatcgacgtactcctcaccagaagcgtgcttacaggattctgcagccatgtggcgataagggaacctcgtgcggtgacatgtgcacggacaa

SEQ ID NO: 716252 - DNA, 346 bp, Homo sapiens
catttaggcaatataaagttgaactaagattctatattggacaatcagctatcaccaggctcggtaggtttagtcgcctctacctataaatcttcccacgtatttatagctacatagaccggtagtgctcttatagagctagtatctataggtacgctcgtataggtttcagggaggtcatagctatatagagctctcctatgcaaaggttatatatctagttaaattacatataatagccagcaagtaataagggagtaaagtccttgactaatatatatagcttaagttaataaatttttacatactattaccctatgacggtaactaataatactaataagca

SEQ ID NO: 716253 - DNA, 259 bp, Homo sapiens
ccgaatgcctggtggcagggacccgcaccaggtatctccaacgatgctctgacatttgtttctttcttttctttctttcttcttcttcttcctcttcttcttcttcttcttcttctcctcctcctccttcttctttttcttcttttctttttttttttctcctatctccctttcctggtcaccactgacattttggacgggataatacttcgctgtggggcctttcctgtgtgtagtgggctgtacagcaacgggtccc

SEQ ID NO: 716254 - DNA, 445 bp, Homo sapiens
  misc_feature (43)..(43): n is a, c, g, or t
  misc_feature (49)..(49): n is a, c, g, or t
  misc_feature (71)..(71): n is a, c, g, or t
  misc_feature (105)..(105): n is a, c, g, or t
ataaaaacattcgatccagcaatcccactactgggtatctacncaaagnagagtaaatcattatactaaanagacacctgatcacagcacaattcagaattgcanagatatggaaccaacctacatgcccatcaactgatgagtggataaagaaaggtgagtacagaaatatagactaagacaactaaaatactttaaaagtaccttataacgttggatttggcaaggatttcttggatatgacaccaaaagcacagaccacaaaagtaaaacaagataaattagactatttcaaaactaaaaatttctatacatcaaagaacacaatcacaaaagtgaaaaagtaaccttatggaataagagaagatatttgcaattcataattctgataggggattaatatccggaatatagaaagaacttctacaagtccacaaacctcgtg

SEQ ID NO: 716255 - DNA, 851 bp, Homo sapiens
gtgatgacccatggccggtccctacgcccattttgggggtgatctcgtttttgtggaccttctctaaatgcgtggaccctattggacgttggctgttttacccagcccatggctgatggcccccaccccaaggggcccacccgggtctttggggtctttatgatggaggcattggtggtgagaaggaccctcccgcctagcaaggtggcggtggccgctgaggaatttttggcgcacattttttctcaggggcgcaccccgtagggggtggtaccataggaatgggtctcccacccaggagttttccacgtggcgtggtccaagaatctactccctcgtcccaattatgcgccgccgatgttggcgtaattggattataaggaaaactaccctggagttttaatgggaaggggtggacaccacgtgttcctcctccctggcacgcccatttataagggtgtcttctaaagctgcttttaattttaggagagggccccatttgttttttgtcacttggcgggccacacccgtgtggtggtgtgtgtgtgtgtggtcgtgtaaaggtgtctttataatcttttacactatttctttaccattgccagatgactgggcgtttactatttgagaaactggtgtgtgtgtatcaatgatccatatgatccatcttaacgccacgtttgggaggcataacattttgccatagaaattaaaaaaatactgatttggggccatgagggatatttgaccattaagagtaattttcacgctttttgccaactttgatttttatttcatttggacttgtttccaagatttatatttaatatttggcataccagagatatgta

SEQ ID NO: 716256 - DNA, 289 bp, Homo sapiens
catcctggacctgggcaacaacatccaccagtggtgtggttccaacagcaatcgatatgaaagactgaaggccaccacatgtgtccaaaggcatccgggacaacgagcggagtggccgcgcccgagtgcacgtgtctgacgagggcacttgagcctgaagcgatgctccaggcgctgggccccaatccggatctgcctgtaggtactgaggacaccgccaaggaggatgcggccaactgcatgctggacaagctctacaaggtctaccaaatggtgcaaagaccatatc

SEQ ID NO: 716257 - DNA, 366 bp, Homo sapiens
acgactgtgttcggcaagacagtttgtggaggagcacctatgggagcactcaggaggaggcctggagggctcagggaatgctcccaaagagagcttgggttgaattttgaagaccaagtaggagtaggacatgggaaaaattgggaaagggaatccccagtagtttggtgggagcagaaggtgcgtttgggaacatgaaaggagatgaggagggaatgacaagaggggaaagaagggccttgtgtgccaggcagagaagcctggctgcattccaggggtgacagagcgccttggagggttgtcagcacaggagtggtgtggttgggctgtgttttagagacgctctgtgtggggagtgtggggttt

SEQ ID NO: 716258 - DNA, 874 bp, Homo sapiens
  misc_feature (571)..(571): n is a, c, g, or t
gcatgttataatttatgattttgcaggtactcatgaattagtatagtattcaaagcaattatatatatatgatagttaaggaacatttgtaatattcatatgacacttaaatctatgtatatgtaggtctagttctaacatgtagcataataccaatataattttgtgcaataacaatttaatttctcttatgctactttgttactaaacttgaacatatatgcagacactttggtatactttctaatcttaagtattatttttatagatttcagttgctgtccccaactgaaacttcagcctagtgaagtttctccaaatttagattaataaaaaactttaaaaactacatgactcaagaaaagttgtctaattggcattaataataatggaacaaaaattatgtaaaaaccttaattataacaacataatgaagcaataaaaatattttattgattagaaatacaatatttaggagtctatgtatctttattctattattcaaatactacaaactcttcagcaggacacctagtcatgtgtaataataattatattcaatctttagtanttttgctacttccaattatatagtgtaatttcccagtttttaaaaaattgtcattatgaagatcatctgtccagagggagaagagctattagagttgctagctgatttatacttagatattatcgtggatgtagttaatggattctgccgggcgaatgtcgaagcttaattggaagggttcgaatatcgatgattggaaaagaataaatagtttaggaaaggacagtgtttagggaagaaaaatggttggatatacaagacaatgttaaaaagggggagaggaattattctatgaggaataat

SEQ ID NO: 716259 - DNA, 927 bp, Homo sapiens
gggtcggggtgtgagaggtattgctcggtctagggagattcttcatgccaaatcactatgtcaacagacatcaggtgtgaccctatcctctcaggtatgaggatagatcagggatcagcagacgtctatctcgcaatacagctacacaggaggcaacctattcagtcacccagtatggaattagcggggttgtaggcatgcaatcgttggctcttatggattatgataaaactgcaatggagcagggtgacacatgaccataataattggccgatatcatcctgatcccacaatgcgtgtggccagcgccaaggcttagattgtcatgagctaatgattgtatggtatggggcttatgtccatgtaatcgagagaattcatgggcaataaatcgtgaagcgcttagaagagagagatgctgtctagaggtctggttaggaggagctttgactttagcttcacgatggtcttgaattattgaaagttacctatttattgtgggaaatagactacttagtatgggtggagatggtaaggatgtgcataattgtatatcggattcgtttcttgtaggcttgagtcgcttggtgaccgaattgctagtgactagtttactaactaggtactatgcaggggaagtcaagtaaagtgttgaatgtcacctgaatgcgttgagggtgtggaaatgtgcaccttgcttaaattgttaagatgagcttagttctaccgcagataacgggcattcttgaaggtactgccggtacgctgcgatgtcgcgatattacgggtgtgctaggagtcctattggcccagatatcaacgcggctgcggtagggctgtgggcgtacacctggcaggggcggcataacgggaagtccgaggcagttgcgcgtgtacgacccgcaagtacaaacggtacacccacag

SEQ ID NO: 716260 - DNA, 217 bp, Homo sapiens
tgggatagaaaaaaaaaatttcaattttcttttaatgtgtggtctctttcaaagagggtcacatacatcaacacacacactttatacaccacccgcacctactccagtggagggagctcgggaagtgatccacctcgtgaagaggaaagaggggagaaaaagaagagaatcacgtgcctcgtgataagaaactttgggcacactttcaaatctgcgg

SEQ ID NO: 716261 - DNA, 302 bp, Homo sapiens
  misc_feature (59)..(59): n is a, c, g, or t
ttgatagtagaactaaattattaggctatttcaagaaattaatatattactggtagaanaactgaagctacaaaatggcctggtttctcacttcagttaaattttgtgctttctgagtgctttgtattttagggtgaacccacactgaaagggtatttgggggccaaaccctgattcctttattaaaattggttggcccagaaaagtggttaaaaattctggttccaaggaaggtctgtggtgacgaggtatgaaaaagaagcctgttctctgcccttctttttccaataaaatgttccaac

SEQ ID NO: 716262 - DNA, 844 bp, Homo sapiens
tctggaagtggctttatattaatggaattttaaaaaatctgggtttcatctccagcggtgtcatttttcccattgcggttcttatagaatttaggagaaaacccagcgggagggcgcggggctctccacaggcgcggtctctaagtgaagggaaggcggtgcctcgaagttcagtccgcgggtggcgcccccatccttccccgcgggggccccgttaccacaagaaccgcggtgcggaattctaccaagagggcgggaaaatagggcgggtggcggcgtggaagaccgcggcgcgtgatgacagtcgatagagaacacgcggagatgcggcggctgtgccggcggtgcggggtggcgcaagcggcgcgcaagctctgggggagaagagacaggtgggtgcgacgaaatagacgcgcccacaattggcgccccggggccccggtaccacttcccaccgcggcgggagaagaaataacggcaaagacggggccacgaggataaccaggggggggggcgtccaaaaggggggcaccaccggatcccaagggcgtgccaaagggccaccgcaccgaatgagaggggggcaacactacaacgcggaggagacacattttagagggagatacagagagagaagggcaaaaggatccccgggagaggacaacggcatccccagaggggggcccatacgagaggataaacacacagtaagggggtttgtcccacaaacacaaattagggacacccgggtagagagacaggagcatagtccacaacaggaaagcgccccgggagctcatcccaaagccatccacgagaggggagacaccaccatcggaaaaga

SEQ ID NO: 716263 - DNA, 200 bp, Homo sapiens
gaccggcatcgtctcggctcctgtgcccaagaagctgctgatgatggcgggaatcgatgactgctacacctctgctcgcggctgcacggccacactcggcaacttcgccaaagccacctttgatgccatctcaaagacctacagttacctgacccctgacctctggaaggagactgtgttcaccaagtctccataccagg

SEQ ID NO: 716264 - DNA, 295 bp, Homo sapiens
cgcgtccggcactctggtgacagagcgcagtgccgttcccttcctgcctgttaacccggaatactcagccacgcggaatcaggggcgacaaaagctgccccgattgaatgcccgagagtttgccaccttgatcatcgaggcattctcagtgaggccaagcgggagacggcagggcaaggagcctgagcgagccccacagacaaacgcttcgagctgtctctgctggagccagagtgacctctgaggagcaaaaagagtacgacagcgtgggcctctgaggaggacacagaccagg

SEQ ID NO: 716265 - DNA, 335 bp, Homo sapiens
  misc_feature (159)..(159): n is a, c, g, or t
  misc_feature (176)..(176): n is a, c, g, or t
  misc_feature (214)..(214): n is a, c, g, or t
  misc_feature (216)..(216): n is a, c, g, or t
  misc_feature (276)..(276): n is a, c, g, or t
  misc_feature (292)..(292): n is a, c, g, or t
ttgaacccaggaggcggaggtcgcagtgagcccgagatcatgccagtgcactccagcctgggtaacaagagtgaaactccgtgtcaaaaaaaaaaaaaaaaatgttactcatcctctctcaaagcaaaaaaagaaaccctaacagctctgaactctggntttatttttcttgctgnatttgggtgaacattgtccattaggtataatttgcctntnttagagaccggggaggcagagtctctagaggaagtgaagtctgatggaatcatgcctgcnaatgagggcttgaacnggatgcccaataaagagttattatattttatcttttgtgggtt

SEQ ID NO: 716266 - DNA, 255 bp, Homo sapiens
atttgaggcaggacactgcaggcgtaagtagacgggcagacgtgactgcagctgaaacgcacgttctgtgtgcgccccacctgtccccggatgccctacaacgtgacagacggcacactgactgcccacccagctgtgcgggaggtgcagagcagagggctttagggagcagtgactgcggtcaccccctttagttctctgggtgtagaccacaagcaacttcccacttggcacgccccaacacagtttctggcc

SEQ ID NO: 716267 - DNA, 448 bp, Homo sapiens
cctgattccgtctcaggtcgccgtgaaggagccgccgcatgtctggcatctgcaatgatggtcgtgcggactgctccagttcctggatcagaggaatacagacctacagatgagcccaataactgaggcccgcagaattcacttcacgctacaaacggagctgattacacccgcagagacctgtagggcagtgcgagcccggccagccaggagcggacaagagagtgtcagatggtcggtcaatatacagcaggaagatccacgagccaggcggaaaggcattgcacaacctccactaatgttgcggggacccacacatacaaacaaagaattgactcgcgcccaccgcatcaagagcaatcagaacacattgaatccgcaaagaaccaagtaaccggccccgaccgtgcgcattggaagccaatccgcagggccaagcgccatcctg

SEQ ID NO: 716268 - DNA, 153 bp, Homo sapiens
tgaaccaccacagatacctttgccgtcggttggcgattccaagctcatagtcttgcggtgaatcagtccgtggtaccgtcagaaattgcaggtctcccatgttattggggatcatctgatatatcgtctggtatagtccttctgatcaggaca

SEQ ID NO: 716269 - DNA, 340 bp, Homo sapiens
gctcgactcactatgttgcccagtctggtcttgaactcctggcctcaagtgatcctcctgccttggctttctaaagtgctgggattacaggtatgaactatcatgcccagcccaaaaactttaaaaatcattataattttccatttttattttagattcagggagtacacgtgcagttttgttacaagggtatattgcgtggtgctgaggtttgggcttctcttgatcccatcacccagacagtgagcacagtatccaacaggaagtgtttcagctcttgttcccctctctccctccctccttttggagtcctcagtgtctactcttcccatcgtcgacg

SEQ ID NO: 716270 - DNA, 490 bp, Homo sapiens
tgagaaatgtgcaggatcatggtcagttgatgttttttctccttgctaaaaagataattagaaattaaatatctttccaaaatttgaagatatgtctcccccagtcagattataagcttctcaaaactggcttgcccccagaattttactgcttacccagcagacatgtattgaccatcacatggcaaatgatatcagcaaatcaaaagatgggcgtaggggtccagccgagacagaaattttttgtttcaattcctggggcattaaaatgttgcttttctcgtgctctttcccccccccccccaatgaaaacaatacatgtatatgttagttttttctagcaaacaaaatataaatattaagcgagggggatcatactgtcaagaccatcaaacaaaacaaagaagcttaagtgaactaagcacagggaaaaggtgttttttcactcgttcattttgtcatctgcttctagatgctgcaatcaagaagt

SEQ ID NO: 716271 - DNA, 900 bp, Homo sapiens
  misc_feature (897)..(897): n is a, c, g, or t
  misc_feature (900)..(900): n is a, c, g, or t
gactcgcggcatggagtcaagatggaggagtacgcgcgagagctttgccatgggaattgtggatgactgtggtggggccctttacgatgggtaccattgctggtggtatctttcaagcaatcaaaggtttcgcaattctccagtgggagtaaaccacagactacgagggagttgtgacagttattaaaaccaggctcacagttaggaggtagcttgtgcagttgggggagggctgtttccatgatggatgtagtatggtctcaagtcagaggaaaggaaagatccctgaactccatcacaagtggtgccttaaggggagccatatgcaagcaagaattgaccagtgccatggtgtggttcagccgcaatgggtggcatctcctagcttaaatggaagggagctggtatctgtgtggacaagattgggcctctgaaacaagtttccccaatgtcctcagttgggcagaagaccccttcccagtgtgccttcaacttcagtaaccttcctcacctttgggagactatcgacaattatcagtaggacttctttcctaggatttctttaacaagaacgagtgggggtcgagacaggttccagaagatccagtacagtctgttttaaaaccatacgtggacagctatggcaataggtataagagacattagccattttctattaaggaacagcgggacggtgctaaagctatacgttattatccctgatgcttgtgtcacatatgtattcgtagaaaaccgatgtgaaatgaggcccagcaaaagaatattcaatctggggcgcggggtgtgtacacacaagcggggcctaagagggcgcacaagtagtaccaacggtgaacatcggttgttgtgtcattttatcttctttctttctttggntgn

SEQ ID NO: 716272 - DNA, 191 bp, Homo sapiens
ctgatcctccctgtggtgtttatctgatgcaccctgtggtgtttatctgatgccaccctgtggtgtttatctgatgccaccctgctggtgtttatctgatgccaccagccaacctgtggacatagtggtggatcctcctatgagtctgaccctgcatgtgcatgcaatgcttgtgcacttggcctgtctgt

SEQ ID NO: 716273 - DNA, 392 bp, Homo sapiens
ggtactgctgtaaactgtgaattgtttccgtatgttactactaatagtagcaacaaaaaacactgcccaaggagtttgagggagggaatgaaagtctctttcttgggtggagtctggagaaacacagcttagttttctttgatatgaaatggttcaacggtgagagggtaagtttgctctggagttttgggaaaatcaaagggctccaattatccccttaagaaaggaaaattgattgaagttttggtggatccctgcctataccttctcaataggattcctgcagagttctgccatggggcaaagtctcacgagactagagggtctccatctcatgatccggcagattactttcgttgggctcttgaatgcccgtgtacttcatgggaggt

SEQ ID NO: 716274 - DNA, 238 bp, Homo sapiens
  misc_feature (207)..(207): n is a, c, g, or t
gaagaggggccttggtgatcagcacccctgcttgtctgcaaaaggggtctgagagtaggaccttattcacatggcatgggcaaagtggttttgcacactttctgtccacggtgtgtgcctgtggtcacttacaactgtgtcaccttgtttgtccaaatcgttgcgtcttatggagcagggtcactccctgaccggcaagggcaacanggaagattggagggtggacgatgtggcagtg

SEQ ID NO: 716275 - DNA, 1206 bp, Homo sapiens
  misc_feature (930)..(930): n is a, c, g, or t
  misc_feature (957)..(957): n is a, c, g, or t
ctcaggaacctccaatcatggcagaaggcaaagggggagtgagctgtctcacatggccagagcaggaggtagagaggggaaggtgccacacacttacaaacaaccagatctcaggacaactcactcagtatcaggagaacagcaccacaaaattgtggttaatcattcatgagaagcctcccacgacccaatcacctcccaccaggccttacctccaacatctgggattacaattcaacatgagatttggtgggaacacagatccaaaccatatcacgcacaaattgcaattacttcacactcacgataacccattaatctgtgaaggattaatctgttcatgaaggcagggccctcatgatggaatcacatcttaaagcccctacgtctgagtactgttacattggggatttagttttaatatgattttcagagcagaaaaacattcaaaccatagcaatatgtattgaatatctagatcatttccaaataagatattaatatgatactgaaacatttattgctgaacataaatttagaacttactttgcctacctattacagaagaacaaaagatatttgggcctattaaacctttcctctgccatttcctgtcctgtgtcataggactaggaatcgtgtttctagaaagtatgaaatcgtgtgcttgcaaacttggaagaaaacagttcatgactgcataccttctagttctctagtgttcactggaaattaaagacactaaaagttaacaattcttattaattaatcatattaatgtaattggaatttctagaaatattaggggaagcaactttatacgcaaagcataacagaaaaataaggtgtattttttctttgaaacctatgaaatatactggccaggcacggtggctcatgcttgtaatcccagcactttgggaagctgangcggtggatcacctgagctcaggagtncgagaccagctggccacatgttgaaccatgtctctactaaaatacaaaattagcagtcatgtgcggtgctgtaccccagtactcggagctggggggaatcgtgaccgggtgggtgctgaccaaacctggcccagcgggaaagagactttaaaacaatggaccaaactgcacaagctctgccacacttgtcgaacccgtggacgcacaagaaaagggcatctggacctggaataacgaaacgacacatct

SEQ ID NO: 716276 - DNA, 557 bp, Homo sapiens
  misc_feature (53)..(53): n is a, c, g, or t
  misc_feature (295)..(295): n is a, c, g, or t
  misc_feature (409)..(409): n is a, c, g, or t
  misc_feature (411)..(411): n is a, c, g, or t
  misc_feature (502)..(502): n is a, c, g, or t
  misc_feature (522)..(522): n is a, c, g, or t
atgtgtgtgcttcttgagcctgcacacttttcagacactgcaaacagattgantgttgctgtcctcatttcctgttccacatggattttagcatagttgctttttatcacaggaaccactgaaaacccagctttgcaaagatgtgatgtcatagagatgaatgtggtgtgatgtaatgttgaaaccgtaaactgatttgtgtttgcggttcactaagtgatcaacaaatgtcatgtgttctatttctcttaaaaagttaagatatcccacagtacttctgtgacttctttatggngtcttggggtgccttgatacacaatttgggacatatagcccttagtactcttttcttgctaccttgacaccacatttctggtgtacatcaagtgtttggaagatggtaggtttngntggtttctattgccttaggcaaatgtctgattcatggaagttgggacaaagaacatatatacaatctgctgtctgaaataagacattttanagtgtaatactttgtttagntatgcttgcccatgcttattgctttctcttgaatg

SEQ ID NO: 716277 - DNA, 1101 bp, Homo sapiens
gaaacaatctagcctcttcctcctcagaggacaggtgacactgatgaaagctcctctaggttccgtcatcgctcagtccctccgtccacaacctcttcctcctcctctgattcatgacttcagacttccagtcgtcattccagtagcagatagcaccagtcacagagtagcatgcttctgactgattgaaccactcaaatgaagaatgaaaaaggaaattagagtggcgtccgattcacttattggacgtgagtggactgtaataacattcgtagtgtgattgctatgaagaggggaagttctcagaatattgttaaggtccaaagtagagttaactggatgacacgaattgtcgtaggagaattcagagaaggtttactaaaaatagtatctaacatatgttagagatggcagtaagtagtacatagttcaactagactgtgcttgactcagacgaggagtacctttatagttattgacaggggtgcaaatcttttgttatctgtgtggtactactttcacaagatagtatctacttagaaaacttgataaggctggtaaactcttgcagaatactgttgagtagtggatggaacactgatcgttgtgtacttctctggatgaaataaagtggccaatacttgagtgtcactatatggttaagtgggatatgtagtcatgagcatattttcaaggatggtgcagttcaggatattctggcaagtggatgtcataatgctttagggctgtatgtgatgtaacgatttactatgttagtactgtaagcttaggagtgagcctactattagtaaatgtgctctatttggacatgtatgttcagaaagttatctgacttatgtcctaagtggtatgttcaggagcctataatatatgactagtaggaatgctgaagttccagctggctgggtacggctaatgcagttgcctccggggtccataagcttttgcaggctatcccattcctgaggaaaagtatctctgaaggaccctaagaggggacaaaaattgaacccttacaggactaacctggagccggcgttacaccagggacacaaaacacggccttaagggaacatacaa

SEQ ID NO: 716278 - DNA, 144 bp, Homo sapiens
taacaaaaaaaaacacccccctctttaaaggggggggccccccggggggggggggaaaaaaaaaagaggggggcagccccaaaaaacaaccccccgggggcccaccgacgtaacaccgccccccccctgcttgtgagagaagag

SEQ ID NO: 716279 - DNA, 195 bp, Homo sapiens
tgggaggattgctagaggcaggaggttgaggctgcaatgtgccatgatcacgccactgcactcaagcctaggtaacagagcgagaccctgtctaaagagagagaaaaaaaaaagccaagttttattttggtttacgaaatggataattttattaataactaatagtaacttatgtggtatcagtaaggcactcaa

SEQ ID NO: 716280 - DNA, 329 bp, Homo sapiens
tctctctctctttctctctcttttctctctcattggaagagagagagagagagagagaaagagagagagagagagagtgtgtgtgtgtgtgtgtgtgtgtgtgtgtgttttactacctgtagtagtgtgaatggtgacctggtgaccctacaaaaaggtatgtcgtgtatctgtgaacaccgtgtgtactatgcaccttattgtggaaaatagtgtctttgtgcagactgtaattcagagcatctataagaccaagcatcatctatagtattatccgagggtggattctcaacttccaaggctctcgtgtcctttatcaagacacaaaa

SEQ ID NO: 716281 - DNA, 190 bp, Homo sapiens
aatggtcagaagctggctagaagttgatgcgttattggcctcagagtctctgatcaagcagatttcacgaatcctcggcccagagtttacataagagcaggaaagtccccttccctgcatcacacacaacagaaaacatgtgtggccaaacgtaggatgagtgtgacagtccactattctccgacaggga

SEQ ID NO: 716282 - DNA, 167 bp, Homo sapiens
  misc_feature (4)..(4): n is a, c, g, or t
  misc_feature (14)..(14): n is a, c, g, or t
  misc_feature (17)..(17): n is a, c, g, or t
  misc_feature (19)..(19): n is a, c, g, or t
  misc_feature (24)..(24): n is a, c, g, or t
  misc_feature (48)..(48): n is a, c, g, or t
  misc_feature (53)..(53): n is a, c, g, or t
  misc_feature (60)..(60): n is a, c, g, or t
  misc_feature (113)..(113): n is a, c, g, or t
  misc_feature (135)..(136): n is a, c, g, or t
  misc_feature (167)..(167): n is a, c, g, or t
gcantgtgacacanggncnggccntagtatagtgtgttcactcgtgantggtntcctttnatgcttctgccctgtcaaaggtccctatttgaaatgtgttataatacaaacanggaagcacattgtgtacaaaanncttatgtatttatgaatccatgaccaaattn

SEQ ID NO: 716283 - DNA, 153 bp, Homo sapiens
ctagaggatgccacgtagtatgtaacagctgacaacgtgaagatactggtacttgatagcctcttaaggaacattgcttccaaattttaagctggaaaggtcactggacataactttaaaaaaaaattacactacatggctttttagaatttc

SEQ ID NO: 716284 - DNA, 594 bp, Homo sapiens
ttttaactgccagtactaagaagtcagagttgaaagacagaggcaccccggccagagacgtgaagcactgattaaatggatcagaatgactgaaaaggccccagagccacatgtggaggaggatgacgatgatgagctggacagcaggctaaattataagcttccaccacagaagtccttgaaggagttgcaggaaatggccaaggatgatgagagtctaattaagtccaggaaaacgctgttggaagatggtcctgtggtgacagatccgaaggcccccaatgtcgttgtaacccggttaaccttggtttgtgagagtgccccgggaccaatcaccatggaccttactggagatttggaagccctcaaaagggaaaccattgtgttaaaggaaggttctgaatatagggtcttcacttcaaagtgaacagggatattgtgtcaggcctgaaatacgttaaggacaactacaggactggggtgaaggtggttgcaccatttatggttgggaggtttgggccttggccttggggagttaagttccttactccagttgtggaggtttccaagggcatgttgttcccggggcgttcc

SEQ ID NO: 716285 - DNA, 107 bp, Homo sapiens
cctggacagcaggtgagactggaggcaggagagggcaggcatctgaggagaggctctgcagccagagagggcctgaggactgtgtgaccgagagctagcagacgcac

SEQ ID NO: 716286 - DNA, 184 bp, Homo sapiens
gctgactgtgggagcggatgtttgacggcctcgatgagtgaggcgtaggtgccaggtatggcgacacacttctggaccagcgtctccaggcgcaggtagtcctcagtcactgcccttgactcatgtaccccctgcagcagacgtgggccagggggtaggcgggtccatgcacccggagcttggg

SEQ ID NO: 716287 - DNA, 216 bp, Homo sapiens
ctaattgcttcttcgatgacgtaattattgatagatacatatttattgccattttaaaacttgatttccagttgatcctaagtttcttttttcttctttttcgggttggatagtttccatttattctatgcttgagtacttttctttgtagtttttgtgaatgtaatgttcagttttgttttgtggatgccctgtcgtcatcgaagaaccaattag

SEQ ID NO: 716288 - DNA, 752 bp, Homo sapiens
agcgggtctcgaggatgtccggctggcgtgcaggttccgggtgcgaggcgtcgggacagagccgtgatccagggttcggcggccggtggaagcgtactgcgatcgagctctgcgcacttcggggaggcggctaaggaaaggtgcctacaggcgagtagacgcgaacggagaggcccatagaacgctttctcaaagcaagaatggagagaaaccatgaagcttgctgacgatggaagacacagaggagtactgcctgttcctgataccagatgagtcaggggactcagataacacatcaaggagattctgtgcagaagtacgatgtgagagaataatcactcggtttgcactctatgcgtggtccccgtacagtcgtaggcgagaatcgagccttgtcgaatcttcaatagtataaacgtgggaaaggaggtgttcctgctcagtagtgtttggcgtgacagaaggttgggggataacgattgaggatgaatggtttattgtgtatgtaatagagctagatctacaggggaatttccaggagttagtagcaaggattgaagagaatgatggtgaattcttgtcagtagaagctgctgactttctcctctaaatggctggatcctgacaagtagcaccaatagggtatttgactgccatggggaattgtgtattatcgcctggcagcacagaaaatgctggagcagaagtcttggttagcgacgcaacccccaacaataccgggaagcatggca

SEQ ID NO: 716289 - DNA, 208 bp, Homo sapiens
  misc_feature (8)..(8): n is a, c, g, or t
  misc_feature (62)..(62): n is a, c, g, or t
  misc_feature (90)..(90): n is a, c, g, or t
  misc_feature (158)..(158): n is a, c, g, or t
acaagatnctgcttgacataaagacacggctggagcaggagatcgctacttaccgcagcctnctcgagggccaggatgccaagatggctngcattggcatcagggaagcctcttcaggaggtggtggtagcagcagcaatttccacatcaatgtagangagtcagtggatggacaggttgtttcttcccacaagagagaaatctaagt

SEQ ID NO: 716290 - DNA, 983 bp, Homo sapiens
  misc_feature (268)..(268): n is a, c, g, or t
tggattaaaatttcgctactgtctaaccctctttgggtccacactgtgctattaactgagctagttgtacaatcaccgctatcaggtgtgtagcttcagcatccatgaacccagtgagcccttacgagcccacaatggaaggaatgaacaagctccagatgcaccgcctataaggagctgctacacactcatgtgtggaagtgtctgctagttgtgcaacatgcgtgagacctagcgagacctagttaacccactcagtatatggaangaaactctcgtaacacattccgcatacactgagaaggatgcatatgtccagatggacgccacctaaagtagcgtggtaacatcttcatcctgccatgggatgcacgggacttcgttgcttgaagtcatgtgtagtaccctaagaatgccatgcaatttgcgggagcagcagtagccaattaatcaaccacggaattttactagcaaactttccttggatgcgactggtggttccaatactcaataacctttttcttctctcagttgcgcttatgcgctgcaccactggttatcctactacatgcatgtaactggtgcgaaaaagcgagtgctgacttactcattggaattatgggatgctggttggaaaagaccctgggtaggtaagctgttgatgtagaaggaactctaagaacttaccaaaagcatgaataaaagatcgtgcacaattttcatgattgggataacctcagcttgatgtaaaaaggacgtacaatgatgcatgctgccccaatggtactccaggggaaaccatggcttatgttactaaaaactacaatgctagtgtaaaggttgattctgcccaggtacgaaccctcagaaaatccctgggagtattcctctctcaagtgttaatggcggcacgcactgatgtccccacctttttgctttggacccaatttttgttgtttcgtaagggggatcaattttttcga

SEQ ID NO: 716291 - DNA, 944 bp, Homo sapiens
caagtgtgcgtgctcaaggacacggtgtggtagtatcttttcatttaatgtgaacatgactaaaaaaaagcagtcctgccttttaaatcttgtggcagctcagacagggaggtgcttaagaaccttaactactatgtcagataacaaaatattttttttcgcattgtgggagatttggttactgctcaggacatgatgtattagggctaaatatatgctgtgtataccttgcaccgtgtgtacttcccctctctccctccctttcccttcccctgtggggcaataagatggcgcattttgcaagtagacgacaatgataatgaaggcctacggataataaaaaggtaggcgcgggccgacccggagacctgtggaagccatgtgcttaaaggacccaatcttgtgaggtggagggcgttagcgccccgagaacgagatcccacacatgggcctagggcgtgctcgataaagggaacgccggcggcagtgaaagagagtgtggggacacgccgaagtagaaaaaaacgcacggggtgaacacacaaggctttggagaaaatatccgaagaaggggctacgagagtccaaaaggtgggctattcacagggggggtcacgggaaggatgataatcatttgccggcaacggtgaacttatcaaatttctaatcaagagatatctaaagcgggcctttactctactaagacaaagataagactttcattgggtattaagaatccagacaagaattctgatggggaataagtacacacacgacttgctacagaaaactagggggggtaagttcaattagaagtgtctgcaagctgcttacgcgcaaaagtaagataacaagagtgggagtggaagaacaccaagttgtcagagaaggacaaagtatagaataagaaaaggggaacagacataaggagtgcaggtggttca

SEQ ID NO: 716292 - DNA, 143 bp, Homo sapiens
ggtggtgcatcctttggggcttcctctaggtcagtgtgtgagatgaatgcaggagagaagatcagtgggcatgttgggagcagtggaggaaggaaggaaggagaggagaggaaaaggaagaaattaataacgccttcttccta

SEQ ID NO: 716293 - DNA, 256 bp, Homo sapiens
agcggagggacctggtgggaggtgattggatcatggggagggatttcccccttgctgttctgttgatagtgaacgagttctcacgaaatctgatggtttaaaagtgcagcacttctccctttgctctctctctcctgctgtgccatggtaagacgtgccttgcttcccctgtcgttccgccatgattgtacctttcctgaggcctctccagccatgtggaactgtgagccaattaaacttcttttctttagaaatt

SEQ ID NO: 716294 - DNA, 488 bp, Homo sapiens
aacgatggtcctcagctgcttggaggctgaggcgggagaatcgcttaaacccaggaggcgtaggtttcagtgagccgagattgtgccactgcatttcagcctgggcgacagagtacaactctgtctcaaaaaaaaaaaaaagaaaaagaaaaagaggaagggggtaggagtaatttttttttcctaaatggatcatttaactttttggaaggtcattggaaatgtgacatttatatcagggacaattatattaagcctccgggagtagaatttatgcaacggctaaaatctagaaatatccgcggggcaggggggctcgcgcttgtaatctcagcacttggggaggccgagggggtggaatcactggaggtcgggaatccgagaccagccgggccaacaggtggaaaccccatctggtactaaaaatagaaaacataagcggggcgggggggggggcactgggggtcccagcggctcagtaagctgag

SEQ ID NO: 716295 - DNA, 142 bp, Homo sapiens
aatgatgcctagaagtaaaaatagtggtgctaccatgcccaagctcccctgcttgtaattgggaacaacagtcattatctcagaaacctcactgacaacgtgcctgggtacctgatgctctgaattctgtagatcatggtca

SEQ ID NO: 716296 - DNA, 1165 bp, Homo sapiens
ggctgctgctgagatcaggcatctacgcgctggaacccatgcagcctccctggggctgggctggctctggatggagccaggacatcggcaagggctcatcggcgagctgctagcactgtcagactccatgccttcaagccctgagtgtgaagtcatccgctgcaggaccggggagtggggactctgaccgtgtgggcctggtctcaggccctacgttgcatcgatgactgcctcatctggtggaagccaggcattataagctcgtagccctgttgagagcatatccgtgttgcctcatgcagggaagtgaagtcagagataatagccactatctgacttactctaatatacacatagaagacacaaaatagaatagagaaaaaacaaacaaaagacagatacatacataatagggtgcgggtgcgcatgaacatgaactttcctctggagggcgcgcgacggttcttataaagagacccgtcagcgcttctcattcgagaagcaagcgtgagtggagctcgcgcgagatcagtcgagcgtggagcctatagagatgacacgtgaacagcctaggtcgtgtaaccgaagcggaatggacagtcagttgcggtcaagggcgtgtgggataaaaggagccggagtgcaaagcgtggagtgtcccctgtgtgaggggacagagagagccattttcacatgtctgtgaggggagagtggagacacattaagagagttgttgacgacctaacattcgcaattcagtggaatgtgtctaccaatgatgcttcggagagtggccacaccttctaagagattttattgtaagagcgcgagatgttcaaagaccatggggcgcttacaatataaggcggggagtataccccggtgtgcccagttgtagttcagatagcccaccgagttgggggatccccggagaatgatttccttccaaatctttcgcgtggaaatcttgtcaggccggcgcgtgcagtcatccatgtgggaaatagaacacaaactggccttgcacgccaactttgcgaatccctggcggacaaggcacattcttaaagcatgcacagcgccacccctccaggttctaacccttaccgcgatggggctctgcccaattggcggacaggttcacccaccacgctcgactccaacc

SEQ ID NO: 716297 - DNA, 3130 bp, Homo sapiens
agcgggattaggtctggctctctcgttctttctcccttctctgcctctctctcctccacgctgctttgatttcgctcttgcctctcttcttgcgctgctcagctgggaacatcgtctcaccagggcagcagcgacgcgctgcacagccagacaggagctggctgcggggcatggaagcagcctccttggcagccgggagaggagcaagcgcacgccactgcccgtgacccaggcgtccggctgctgtcccctgccggggagctcatccacgcagaggtctctccctgtcctccctgcgagcttttcctctgcagagcccagtggagccagccatgtaccgcggcaacgcttgctgaccccagtgaggagagaggcctgaatccgagggccctggcacctgtgagctcttggctgtcacctgccccaagcctcgcacctccgctccacagcagtccccacaggagacaaccctgacgggagcatggagctgctgtccacgccccacagcattgagatcaacaacatcacctgcgactccttccgcatctcctgggccatggaggacagtgacctggagagggtcacccattacttcattgaccttaacaagaaggagaataagaattccaacaagttcaagcaccgggacgtccccaccaagctcgtggccaaggcagtgccgctgcccatgacggtgagaggccactggttcctgagcccccgcacggagtacagtgtggccgtgcagacggcagtgaagcagagcgatggggagtacctggtgtccggctggagcgagacggtggagttctgcactggggattatgccaaggagcacctggctcagcttcaggagaaagctgagcagatcgcaggccgcatgctccgcttctccgtcttctaccgcaaccatcacaaggagtacttccagcatgccaggacccactgcgggaacatgctgcagccttacctgaaggacaacagcggcagccacggctcccccaccagcggtatgctccacggggtcttcttcagctgcaacacggagttcaacacgggccagcccccgcaggactccccctacggccgctggcgcttccagatcccagctcagcgcctcttcaatcccagcaccaacctctactttgcggacttctactgcatgtacacggcctaccactacgccatcctggtgctggcgcccaaaggctccctgggggaccgcttctgccgcgaccgcctgcccctcctggacattgcttgcaacaagttcctgacctgcagcgtggaggatggggagctggtcttccgccacgcccaggacctcatcctggagatcatctacactgagcccgtcgacctgtccctgggcaccctgggggagatcagtgggcaccagctcatgagtctgtctactgccgatgccaagaaggaccccagctgcaagacctgcaacatcagcgtgggccgctagggactcctggggagctggggggcgagggagagatgagcggaaggtggaggtgggtagcccaggttcagggagctggctttctctctcctgcccccctgctccctccactctgcccagctgccctcccctcgccccttggcattggaggcaacagacggtggtcctcttggtaagtgtggcccacacccagcctggtggacatggaaaggcttctcagcctctgtagttggcagctgggctggacttctggagaacttcccctttcctctggtttccttgtcctactgttctttgcctcgtccaggtctctatctcccaaagacctgcccacctcctgggctctcccagggaagcccctctgggccaaagcccatgggtagcttggctgcctccagaagagatgcagagagctgtggggcgatctttcttagtcccactcaccccactcagggccaaccacagaatgccccctccctgctgagctgggtctctggggcttcccactccaggcctggatcccttccttctataaatagtctcctgcaccaccgtgactccctggctgctccttgccccaaagaaccctcttcctgcatgggagagctgtccctccttctccacctgcccaccgggacactccccctgctctctagaaaggaactctctttcttctcttggcactgggggcgtcaggctgtcggatgttccttccttccataccccagcataccttctccttgcttagagtgcaggggtctgagacagcagccactggggttgaggagggggaggagacccctgagacccagaggtgccccttcctcagctgggagtgggccgcctcatgctctgctggggcctggcatggaacgtgagacctgtaagctgtcccgcgggccccggcaccccgcccagctgtgcactttgctcactcgctctgccatggtgccatgactgtactgtgcccatgcgtgacctggactgtggaccctctgctgctccgcctctcccctccccactggctctgtctgctctcctgccaccctgctggccgggagcccctccccggggagttcttggtgaagtccttcccgggcctccttgtgtttttgcctcattcctactgtcacacaggtcacgagggtggactccctacaatcaacaaagcaaacagagagcctgtgggaggggctgacagcagcagccggctgtttgggggatgatggaggtgacatcaggcagaggagagtgcagcctcacagtgactttctcagaggtgacagagatgatggatgagcagctggattttcgtgatgaaggacggaagcagcagcgggccggcaaggccatacctcggtgagggacaggtggacaacggtcacctatctgtagccaggggcagttgtgtggccagctgtctctctgggatgagtcaggaggcctggaggcttggggagaggtgtggagaaggagagaacatggcccaggccctttccttccccctgtgctgacagcattgctgtgggggtggcccactgccctcccctggccctcatgtccccccggggctggggtccgcctgcctgtgctgtgcttgcgacgtgcatcaataaaccaccatggcctgagggccctgctcgtctcaaaaaaaaaaaa

SEQ ID NO: 716298 - DNA, 241 bp, Homo sapiens
ccccttggccccccccccctcccctttttcctgccgccccccctttggctgggtttttttccctggcccaaacctctctcctctctcttttttggggcaggttctctccctctcctcccccctctatcccttccttccgccccagccccctccctggggtttttttttctccccttcagccccccggctgatgccctttctggttttgggccattttccaatatttccgtggggagagaga

SEQ ID NO: 716299 - DNA, 124 bp, Homo sapiens
ggacctgcatacatacatattatgacattttagtgttgaattaaaaaattcatgatttttaattcaaaactaaaatgtcattaatatgtatgtatgcaaatgttttatcttattttctgaaatg

SEQ ID NO: 716300 - DNA, 2256 bp, Homo sapiens
ggcctcagcccggctcaccagccacatcttctcttccctttggtgtgtctccctggggtgggcaggacccactgcgggaacatgctgcagccttacctgaaggacaacagcggcagccacggctcccccaccagcggtatgctccacggggtcttcttcagctgcaacacggagttcaacacgggccagcccccgcaggactccccctacggccgctggcgcttccagatcccagctcagcgcctcttcaatcccagcaccaacctctactttgcggacttctactgcatgtacacggcctaccactacgccatcctggtgctggcgcccaaaggctccctgggggaccgcttctgccgcgaccgcctgcccctcctggacattgcttgcaacaagttcctgacctgcagcgtggaggatggggagctggtcttccgccacgcccaggacctcatcctggagatcatctacactgagcccgtcgacctgtccctgggcaccctgggggagatcagtgggcaccagctcatgagtctgtctactgccgatgccaagaaggaccccagctgcaagacctgcaacatcagcgtgggccgctagggactcctggggagctggggggcgagggagagatgagcggaaggtggaggtgggtagcccaggttcagggagctggctttctctctcctgcccccctgctccctccactctgcccagctgccctcccctcgccccttggcattggaggcaacagacggtggtcctcttggtaagtgtggcccacacccagcctggtggacatggaaaggcttctcagcctctgtagttggcagctgggctggacttctggagaacttcccctttcctctggtttccttgtcctactgttctttgcctcgtccaggtctctatctcccaaagacctgcccacctcctgggctctcccagggaagcccctctgggccaaagcccatgggtagcttggctgcctccagaagagatgcagagagctgtggggcgatctttcttagtcccactcaccccactcagggccaaccacagaatgccccctccctgctgagctgggtctctggggcttcccactccaggcctggatcccttccttctataaatagtctcctgcaccaccgtgactccctggctgctccttgccccaaagaaccctcttcctgcatgggagagctgtccctccttctccacctgcccaccgggacactccccctgctctctagaaaggaactctctttcttctcttggcactgggggcgtcaggctgtcggatgttccttccttccataccccagcataccttctccttgcttagagtgcaggggtctgagacagcagccactggggttgaggagggggaggagacccctgagacccagaggtgccccttcctcagctgggagtgggccgcctcatgctctgctggggcctggcatggaacgtgagacctgtaagctgtcccgcgggccccggcaccccgcccagctgtgcactttgctcactcgctctgccatggtgccatgactgtactgtgcccatgcgtgacctggactgtggaccctctgctgctccgcctctcccctccccactggctctgtctgctctcctgccaccctgctggccgggagcccctccccggggagttcttggtgaagtccttcccgggcctccttgtgtttttgcctcattcctactgtcacacaggtcacgagggtggactccctacaatcaacaaagcaaacagagagcctgtgggaggggctgacagcagcagccggctgtttgggggatgatggaggtgacatcaggcagaggagagtgcagcctcacagtgactttctcagaggtgacagagatgatggatgagcagctggattttcgtgatgaaggacggaagcagcagcgggccggcaaggccatacctcggtgagggacaggtggacaacggtcacctatctgtagccaggggcagttgtgtggccagctgtctctctgggatgagtcaggaggcctggaggcttggggagaggtgtggagaaggagagaacatggcccaggccctttccttccccctgtgctgacagcattgctgtgggggtggcccactgccctcccctggccctcatgtccccccggggctggggtccgcctgcctgtgctgtgcttgcgacgtgcatcaataaaccaccatggcctgagggccctgctcgtctcaaaaaaaaaaaa

SEQ ID NO: 716301 - DNA, 298 bp, Homo sapiens
ccccccccccccccccctttaaaaaattttgccctttggcaggcaagcaattgcacccaaattggtgggcaggggggtggaaggcccccgcccccaggagaacccccaaattcccccctcaaccctttaaccatggggggggcccccaaaggccccccccccccccctttgggtaatgttcccgggggggggggggggggtcccccccccttccagggggcttcccctggggccccccaaagggcaaacctaaaaaaaggggaaaaagggccaaaaaaaccccgttttttcccgggga

SEQ ID NO: 716302 - DNA, 3008 bp, Homo sapiens
agcgggattaggtctggctctctcgttctttctcccttctctgcctctctctcctccacgctgctttgatttcgctcttgcctctcttcttgcgctgctcagctgggaacatcgtctcaccagggcagcagcgacgcgctgcacagccagacaggagctggctgcggggcatggaagcagcctccttggcagccgggagaggagcaagcgcacgccactgcccgtgacccaggcgtccggctgctgtcccctgccggggagctcatccacgcagaggtctctccctgtcctccctgcgagcttttcctctgcagagcccagtggagccagtccccacaggagacaaccctgacgggagcatggagctgctgtccacgccccacagcattgagatcaacaacatcacctgcgactccttccgcatctcctgggccatggaggacagtgacctggagagggtcacccattacttcattgaccttaacaagaaggagaataagaattccaacaagttcaagcaccgggacgtccccaccaagctcgtggccaaggcagtgccgctgcccatgacggtgagaggccactggttcctgagcccccgcacggagtacagtgtggccgtgcagacggcagtgaagcagagcgatggggagtacctggtgtccggctggagcgagacggtggagttctgcactggggattatgccaaggagcacctggctcagcttcaggagaaagctgagcagatcgcaggccgcatgctccgcttctccgtcttctaccgcaaccatcacaaggagtacttccagcatgccaggacccactgcgggaacatgctgcagccttacctgaaggacaacagcggcagccacggctcccccaccagcggtatgctccacggggtcttcttcagctgcaacacggagttcaacacgggccagcccccgcaggactccccctacggccgctggcgcttccagatcccagctcagcgcctcttcaatcccagcaccaacctctactttgcggacttctactgcatgtacacggcctaccactacgccatcctggtgctggcgcccaaaggctccctgggggaccgcttctgccgcgaccgcctgcccctcctggacattgcttgcaacaagttcctgacctgcagcgtggaggatggggagctggtcttccgccacgcccaggacctcatcctggagatcatctacactgagcccgtcgacctgtccctgggcaccctgggggagatcagtgggcaccagctcatgagtctgtctactgccgatgccaagaaggaccccagctgcaagacctgcaacatcagcgtgggccgctagggactcctggggagctggggggcgagggagagatgagcggaaggtggaggtgggtagcccaggttcagggagctggctttctctctcctgcccccctgctccctccactctgcccagctgccctcccctcgccccttggcattggaggcaacagacggtggtcctcttggtaagtgtggcccacacccagcctggtggacatggaaaggcttctcagcctctgtagttggcagctgggctggacttctggagaacttcccctttcctctggtttccttgtcctactgttctttgcctcgtccaggtctctatctcccaaagacctgcccacctcctgggctctcccagggaagcccctctgggccaaagcccatgggtagcttggctgcctccagaagagatgcagagagctgtggggcgatctttcttagtcccactcaccccactcagggccaaccacagaatgccccctccctgctgagctgggtctctggggcttcccactccaggcctggatcccttccttctataaatagtctcctgcaccaccgtgactccctggctgctccttgccccaaagaaccctcttcctgcatgggagagctgtccctccttctccacctgcccaccgggacactccccctgctctctagaaaggaactctctttcttctcttggcactgggggcgtcaggctgtcggatgttccttccttccataccccagcataccttctccttgcttagagtgcaggggtctgagacagcagccactggggttgaggagggggaggagacccctgagacccagaggtgccccttcctcagctgggagtgggccgcctcatgctctgctggggcctggcatggaacgtgagacctgtaagctgtcccgcgggccccggcaccccgcccagctgtgcactttgctcactcgctctgccatggtgccatgactgtactgtgcccatgcgtgacctggactgtggaccctctgctgctccgcctctcccctccccactggctctgtctgctctcctgccaccctgctggccgggagcccctccccggggagttcttggtgaagtccttcccgggcctccttgtgtttttgcctcattcctactgtcacacaggtcacgagggtggactccctacaatcaacaaagcaaacagagagcctgtgggaggggctgacagcagcagccggctgtttgggggatgatggaggtgacatcaggcagaggagagtgcagcctcacagtgactttctcagaggtgacagagatgatggatgagcagctggattttcgtgatgaaggacggaagcagcagcgggccggcaaggccatacctcggtgagggacaggtggacaacggtcacctatctgtagccaggggcagttgtgtggccagctgtctctctgggatgagtcaggaggcctggaggcttggggagaggtgtggagaaggagagaacatggcccaggccctttccttccccctgtgctgacagcattgctgtgggggtggcccactgccctcccctggccctcatgtccccccggggctggggtccgcctgcctgtgctgtgcttgcgacgtgcatcaataaaccaccatggcctgagggccctgctcgtctcaaaaaaaaaaaa

SEQ ID NO: 716303 - DNA, 852 bp, Homo sapiens
  misc_feature (621)..(621): n is a, c, g, or t
attacaacatttcctaaactctaaatctttgataatacttacttaaccattgtaaaatggacttttaaaaacaacccttaaaattgaatttatttttaaaaattaatattctagatgcttgaggattcttacatcctctttgtttaaagttttatgtttaatgtttttgtatcatgttttgtactttttgagaatccgtttttgcgactactcctttagttttgtatatcttagcactcacctttatatttactaatgtaggggagaaaagattgttatctctaacaaaagacagattaacaagagaaaagcataaattttacatgacacaagagtcttcagaagtgaaaattttaaaaaggcagggaaactgtatttttatgcttaggtttgatgaagagtggacagtcatgtagaaataagattggacaaagagaagtacgatctaatggcaacagactgggaagaacttaaggcctatttgttcatattcttcttggtgtctctgtgtcttcatcttttcctctgggtgttagaaggacccctctggaatgaggatcttataacctacttacaggaaggtcagagaattattttatgacctgcctcaggggagaacanacagataatttggcatgaccctgatacaaatttagaatcttgtctaaatgtgtaattaaggtcacatcttattactcagttataaatagtaactatatatcaagattatcctgatcctaagtctttgtatccttaagcaaaacaaatcggagaattgtttttcagtgattttgaaaaattacttccctccaccccagaaaacccccctaaaatatagaggaaagggaggaa

SEQ ID NO: 716304 - DNA, 670 bp, Homo sapiens
tcgatcctcagctgctctcaccgtgacctgtcacggtccaggtccatctcagcagcgtgagggtgcactccaagggttttttagagcgtcctcgtgtgtgctagacgcacccctactcgttcctataggaccccgaggacatagggaacccctgaaacaccacctgggattctctggtcacccgttttgggtttaggctaatctgctttgggcacggtggagcaccccccgaggaagcctgccagtcccagggcacacggctgccttttggaagggaagggctggcccactaaggtgctgctggctccccgccaccacagctgggcctcagccctcacggcaattcctgctgaagcacccctggggcaccccgggaacaggggcgtcagggatcctgctgccggcacaccctgtgccgctggcatagagggccgtgtcccccctgtgaaggatgaagagccaggccctcaggacccgtgtcctcagagcaccacaccctgagcaccccgagacagcgggcctggcaacgggccgggccaagcagggagcgcctccctatgttgcctgccccttctgggcaccggccagcacccttctggtgagaagaggtcccccctttttatgtgcactacccccccatctgtgattataattaatttattattcctga

SEQ ID NO: 716305 - DNA, 370 bp, Homo sapiens
gagctgccgcctactactactaaatccgcggccgctcgacggaaggtcagagaattattttatgacctgcctcaggggagagcaaacagaaaagatgagagagacttcccagtttctgctggtttctcagatgccaagatgccataatttggcatgaccctgatacaaatttagaatcttgtctaaatgtgtaattaaggtcacatcttattactcagttataaatagtaactatatatcaagattatcctgatcctaagtctttgtatccttaagcaaaacaaatcggagaattgtttttcagtgattttgaaaaattacttccctccaccccagaaaacccccctaaaatatagaggaaagggaggaa

SEQ ID NO: 716306 - DNA, 283 bp, Homo sapiens
  misc_feature (158)..(158): n is a, c, g, or t
  misc_feature (164)..(164): n is a, c, g, or t
  misc_feature (247)..(247): n is a, c, g, or t
  misc_feature (279)..(279): n is a, c, g, or t
aagctgaagttaagatctctcctaagtcctcttctgttaagatattttgtcacctttacagtatttcacagggtcccctggcccgggggtcatggccagaacgcagagactttatgatgaggacggtcccacgatgatccgactagcccagcaccagnccaggnacagagcacagtctccgttgtctcaggcatctggattgctcttggcctcccagtcttgaggagcggctggccaagccccagtntccacccatgcagtcatagaatgtcctcatcntagg

SEQ ID NO: 716307 - DNA, 263 bp, Homo sapiens
  misc_feature (104)..(104): n is a, c, g, or t
  misc_feature (154)..(154): n is a, c, g, or t
  misc_feature (157)..(157): n is a, c, g, or t
tccttctcgttcttggagcagctcagttcgtgctccaggccgcagctgccccccttgacctcaggccccgggggcggctcagggggcagtgccagggctgctcnttggcttcaggccgttgggcagtggtggccctgaccgattttgttccggnggnggctgaggctcagaggaccctgtgtcccgggtgtcactggccccggctggtggtagggaaggtgaggcggatggggaggtttgttttctttgttttctttctcgcg

SEQ ID NO: 716308 - DNA, 196 bp, Homo sapiens
agttcgacgctgcactgtctgtataagtatggtctatagctaatgaaaatatatagtacactcttcattgggtagtagctaccatgccaggccagcaatcactgaatgccaatgtgctaacgtatgtgcagggcgagatggctgtgtgtgttggtacacaagttctgcagaatcagtggaagccccatggcgcaca

SEQ ID NO: 716309 - DNA, 964 bp, Homo sapiens
ccgtgggtggtggtggcgtgtgtagtggcaggtgttgtctgcgcggctctaccagggaccgtgcgctgccgttaccgcccctatttttaagacccctatgggcgtctgttctggcaagttggcgcctgatctttggggaccggctcgcaaacttggttgcaagaaccttttcgacgtgttcacttgctgccggatccggtgacatattgccgcgggtgtgtgtgtccctttccgcgccgcggggtaatagggtgttccacacccgcgcacgcaccgccgctgggttcaatgcgccacccgcacggttttcaaacgtgttctgccctccgggcggggtcactcattcatatccagcgcccccctcgttgggcaggcaactagcagggtggcatggcctctttcgccagagctgagcgcccggaggatccttgttgttcgccgcaccgcacacgggctgtgttactcccgcgtctgtggggcactgcctcatagcctggccccgggcacctagcactttctttccacaaggaggcccctccacccagtcgtagaccgcgcgtgaaagtagttttcccccccattgtggaaaacgtgtgtgccaccacggcacgcgcagtttaaccagttactcaagtttcaaggggcgtttgatgttctctcactttaaaaagagaagctgtgctccctaacgtcacatggttacaccatgcgccccgtcgccaacatgtccgtaaaacccctcttgtttttgccgaaaaaaatgacacttaatagacacaccgtgctatttggcgcagacgcccactatgctgccgccctccaacttatgaggaggcggccaaaccttgtggaagtgctctgcccatgacccccggcgggagtcgggcccctcacattgtcatgccccgggctcacccccccactcccgttgggggccaacaaaaacctcttcttccaaataaca

SEQ ID NO: 716310 - DNA, 154 bp, Homo sapiens
ggtattgaaagcaaattaaaaattttaaattagggccaggcacagtgctcatgcctgtaatcccaagtgctttgggaggcagaggtgggaggattgcttgaggccaggagtttgagaccagcctgagcaatatagtgagactcctccatctaca

SEQ ID NO: 716311 - DNA, 595 bp, Homo sapiens
ggagctttctagccacaaggggatttaaagagacagtacctattttttttcttatattcctcctttgtggcaaagccagatatttaaggaaatcttaggtcactggttaaccacagagatatcacaacagaaacttcatgacccatactgcaaagaatacaccacttcacaaaaatagtgggacaaacgtcacaaatagttggctccagccctcaataagcaaaaatcaggcaatctctgaggcatgactcgaattagattcctcagttaccacaagtgtaatacctcataatgtcccagttctccaacaaaaaatatttaccaaacacttaaaacacgaacatagaaaacccatggctcccatttcaacagcgaaaaaacaaattcgacaggcaccatccttgaggaagtcccagactattcggaatttattacccaaagaacattaaatcaagtatcttaagtatgttcagcgaagctaaaggaacaacttggcaccaagaattaacagcgaaaatcaggaaaaccatgcttgacacaaaatgaggaattatcagtcaaccagacgacatcagcaacattctacacaggaacc

SEQ ID NO: 716312 - DNA, 175 bp, Homo sapiens
tgcattagctcctggctcggtgatgcctcctgatctatccatatgcctggaagatcagcactgggatgacctgatgagcacgaatggtcatgagtgatgcccacgaatcagtggcccagactgttcatgtgcactatggacgtgtggacgtgcatacgtgccctgtgtgcccctg

SEQ ID NO: 716313 - DNA, 1359 bp, Homo sapiens
  misc_feature (300)..(300): n is a, c, g, or t
taagtcacagaaaaaacaaaaatttttttataagtgcttgggaacgaaaaagtgcgtggagtggaatgtttaaacaaccagggagggagccacgtggtagaggtgttccctcacctctctgtgggaagtgggcacctaaggggtgcactatagctctatagagaggcaacttagaaaagagggcatttatagtctcatatatataatatatagagtgcgtcgctcgagcgcgaattttctcacactctcctcgagcgcaaagatatgttgtctttagagtggagggcgcccgcgggaganacacccgatatatatatgttattcttataacaagatgtggcggctctcgcgaggggttcgcgtggcgcgcggggtctcgacgggcgagtgtgtgtatacaaccgcagtgtgtctcccgcgcggggtagaggggtgtggggcgccgtgtgaagaagagtctctcccgcgggggtcccacacccctctctcgctgtggcgccacaacgcggtgggccttcaaccactctcctcgcaatctattttctgcgagaggggagtgtcacactctctgtggttctcccgagtgtcccccgtggtggaaacaccccagagaatttctctttccgagagagaaatcggtgggccccctttacccactatacataaaaaaagtggggcaatttgggggggagaccccccccgcgaaaggggagagtcaattatacaggcccaggggaagcgtgggaaaaacggtgagtgtacaaaaaaaaacgcatacgagtatagtgaagacgccctttgggggggggtgtgggaccactcaccaaaaaaaacacgacgggagaccgcgacaccagaataacgacacacggggagacccccaataaaagaaagaaaaattggaattgagagaaacaggagaagaccccaaaaagaaggggccaagtagggtgacgagacgcagaaaaaggggtggaccaacagaaaaaaactaaaagaggacaaaggggggacgaaacacccaagagggcgaagtgtgaagaaaataccggaataaacgcgagagacggaccaatatgtgggacacagagaacccgagggaaacgtgtgaaacggaaacaaaaggaaagtacgaaaaataagaacagaggaagatcccgagaaagagcagagatgcagcggttccgagagaaggttagaaaaaaactataggagaaaaacatagaaagaaccgagggatccgggcaggagagactaggaggacacgggcagagacacggggaacaaagtgaaaaaagattagaaacagcaaaacagtagacaaaaaatggggaaaaaaagaggaactagaaagaataa

SEQ ID NO: 716314 - DNA, 227 bp, Homo sapiens
tttgcgatgatggcagctgtatccagcactttggaggcagtggaggatcattgaggcagagtcatgacagctagcgaacatggaaacttgtctctctaagaaaaaataattagctggtgtggtggccacacctgtaatcctagctacttgggaggctgaagcacaagaaacacttgaacccaggagacagaggttatagtgagccactatcagccattgcactccgg

SEQ ID NO: 716315 - DNA, 385 bp, Homo sapiens
tcgtatgtgccagccacgacacaaacgcacagacacacacgcacacacatgcacacacagcacacaaacgcacggcacacacacgcacacacatgcacacacagatacacacacactcatacccccaccacacccacacacacactacagactcacacacacaccacatacacacaccccacacacaggctcatatacccaccacacctacacacacacccccatcacacctacacacacacctacacacatacacagacacatacaccccacaccacactacacctacacacacaccaaatacagacacacataccccaccacacctgcacacattacacaccacacacagacacacctcaacacacctatacacacaccacac

SEQ ID NO: 716316 - DNA, 477 bp, Homo sapiens
  misc_feature (109)..(109): n is a, c, g, or t
  misc_feature (140)..(140): n is a, c, g, or t
  misc_feature (181)..(182): n is a, c, g, or t
  misc_feature (184)..(184): n is a, c, g, or t
  misc_feature (195)..(195): n is a, c, g, or t
  misc_feature (228)..(229): n is a, c, g, or t
  misc_feature (235)..(235): n is a, c, g, or t
  misc_feature (248)..(249): n is a, c, g, or t
  misc_feature (307)..(307): n is a, c, g, or t
  misc_feature (357)..(357): n is a, c, g, or t
  misc_feature (376)..(378): n is a, c, g, or t
  misc_feature (382)..(382): n is a, c, g, or t
  misc_feature (386)..(386): n is a, c, g, or t
  misc_feature (477)..(477): n is a, c, g, or t
atttattagaaaagattaatactaaaacttttcaatgacagagacaatcaactttgtaacagaaagtcagagatactttatttttacttctaaatccaaaggctaagtngggcggggttgtaaaaatgaaatcccacttngtctggttcgcacggatactaacgtttaatcctgttttcanngnccaggattggnaacttgcgattgaacactgggcgggccacatgnntaggtnatatttcttaaanngtcttagggggaaaagtttgtttctggtcctttgttttcggtggcttttttacttttnacacttgttctgttttctggttggtctcttctgtcctgttttttcttttntttttatttttaataaacnnnctanctgngctttatactttttctttgcctcttttgctttctttctcctcttttttttattgtcgttcttctctttttgccgttctcggttttcttccn

SEQ ID NO: 716317 - DNA, 158 bp, Homo sapiens
atctgaggatacttacagtctaccacagcatgccaacagctcatgcccagcagtcgcagccggctacactgcctactggaagccagccgcagtcccagcatgcggccccagtcctgtccagcatcaggcggggcaggccccacacttgggcagtggac

SEQ ID NO: 716318 - DNA, 561 bp, Homo sapiens
taataaacgctgctgaaacaactggacatactcatgaaagagaataaatcgaattcagaccgtataccctccacgaacataaattcaaaatgaatcacaggcctggcacggtgtctcacgcctgtaatcccagctttcaaggaggcagaggcaggaggattgcttgagcccaggagctcgagacctgcctgggcaatatagtgagaccccgttctccacaaaaagtgggggaaaaaaaaagacaaaatgaacaaagagcagaccatgtacgatggtaatatcttctcaaccaaaacatagtgggaaaaaactttgaagacacacaggcttgggttagactcctgcatctaccttgcattaggataggctccccagaggcagggctagcagtgaggattcgtgggaaagatcaattaggaggctctgaacctcttcaagaagcatctggaacatcagatggctgcgccaccatctcggcgatcctgttcctaaagaagcaagatctgctcgctgagaaagtcctcgctgggaaatcgaagatggaggactactttccagaaa

SEQ ID NO: 716319 - DNA, 218 bp, Homo sapiens
tgtgtacttttcagtgaacatttgtctggtcatgagcttgttcttttctgtagataggtcatttgtgcatattttagatccacatgttagtgatagcatatggcatttatctttctgacttacttcacctagtgtgagaatctctagttccaaccatgttactgcaaatgaaattattttgttccttttcatggctgagtagtattccactgtgtatg

SEQ ID NO: 716320 - DNA, 214 bp, Homo sapiens
caggccgaggcaggggcatcgcttgaacccgggggcagagcctgttgttagctgagatcacgccactgtactccagcctggtgacagagacagactacatctcaaaaaaaaaaggaaaaggaaaaaggaattggctcagcccagggcctgggactcttctgttgagtatatctgggaagaaagtgagacaactagaaagtaattttttagtatg

SEQ ID NO: 716321 - DNA, 125 bp, Homo sapiens
agacgtcgggctccaaggttgggcatggcccttgaatccgggcatgctgtatgacaccttcgcagcctcgggggtctcctggggcctccaggtgccagtttggtaggcacttccggtaactacag

SEQ ID NO: 716322 - DNA, 295 bp, Homo sapiens
tgtgtctataatcccagctacttgggagcttgggaggctgaggcatgagaattgcttgaacccgggaggcagaggttgcagtgagctgagattacaccactgcactccagcctgggcgacagagcaaatgtcccaaaaaaaaaaaaaaaaaaccgggaaaaatttttcctttttttttgtttcaaaaaaaataggaaaaaaagggtttggggggagggccctgaaaccccagttatttagggggttggggcgggggaattttttgaccccaggagttgggccccagccggggggg

SEQ ID NO: 716323 - DNA, 379 bp, Homo sapiens
gacctctgcctttgggttcaagcaattctcctgcctcagcctcctgagtagctgtggttacaggcatatgcaccacacccagctaattttgtatctttagtagagatgaggtttcaccttgttggccaggctggtctcgaactcctgacctcaagggatccacccacctgggccacccaaaatgttaggattacagtcgtgggccactgtgccagccttctttttttttttgttttgtttattaatatgttttaataaatagagacagggtctcactatgttgcccaggttggtcttgaactcctgagctccagtgatactcgcaccttggcctcccaaagtgctgggattatagctatgagcccctgcacctggctgc

SEQ ID NO: 716324 - DNA, 310 bp, Homo sapiens
gggccacctgaaaatcccttgttaaaaaccagatcacaaattctggggctcttggtcccattggagaaggagggagagcctcaaaataagtgtgcacccatgcacatattcaggaccagcttgtttagtctttacactttgccttaaagttgcttttcctcgtccctttgtgtgcctggggggcctcggccctgttcgttggcaacgaggatcaaatgtgcctgcaggttttgcagaaacccaacctagaccacaaaacgtggaaaacagttaatttttttttccctaatgtttctcacgggccgtgggc

SEQ ID NO: 716325 - DNA, 317 bp, Homo sapiens
gtgctgaaaattgaaattatgtccagacatatccgtaatcttttcggtttctaaactatacagtgtagccagaatctcctaggttccgtggtgtcgaactggtccaaagggtgacactatcaaacctgtagcgctgatcttctgcacaaaacatcgtttgatacaacacaatcaacacatgcaggtccacccgaagaacatttcctactggccattgagcttaacgaggtttcttcttttttcacactactactgctataagatgcgctatactcgattgaaaaagtcacgccttgcttgaggcatgcagtcgacgc

SEQ ID NO: 716326 - DNA, 290 bp, Homo sapiens
tgcttaatctcatatctttcatttgcaaatccagttagtcagtcccagccaggcgcaggcactcatgcctgtaatctcggcatatagggaggacaaagcgggtggatcacctctgggcctttgcactgccactttactctgcctgtggacgcacttccccctatcttttgcacagctgactcccgcttgtcggccagattttggctcaaaaatatcactttctagagggagctaccccgactctcagctaaagaggtaccctccagtggctgtaccattttctccaacat

SEQ ID NO: 716327 - DNA, 106 bp, Homo sapiens
ggaaagactctgaaagaacagtccaaatgctactctaattctctagacgagatgtattaaggacccaaattagggctggccgcattgggcaggtccttcagcctca

SEQ ID NO: 716328 - DNA, 828 bp, Homo sapiens
cctacaaatctccttaattataacattcacagccacagaactaagtcatattttatatcttcttcgaaagcacacttatccccacctggtgcatatcatcaccctgatgaggctaagccaagtcagaaggccgtgaacgccaaggcgacaatagccttcctgattctacacccatagtaggctcccttcccctgactcatcggactatatttacactcacaacaccgctaggctcacggtaaacattcttgacatactgcactcatcagctggccctaagaactatcgaaactccgtgagtccaacaacgtattaatatggagctagtcttacacaatagacttgtatagtgaaagatacctgctgttgacggactgccactttatgagctccgctagagcccgatgtcgaagccccggcatcgctgggtcaatagtacttgccgcagtactcttaaaactaggcggctatggcataatacgcctcacactcatgctcaagcccctgacaaaacacatagccgaccccttgcttgtactatccctatgaggcataattatgaacaagctccatcggccgtacgagaagagagacctaaaaatcgctcatggcataactcgtccaatcagccacattaggcctggttagttaacaggccattctcgttccaaaacccccctgaaagccttcaccgggggcaagtcattctcataattcggcagggcttgcagtctcattatattctgctaggagattcaaatatcagcatcaaaagtcgctcaaaaacctttctcaggattcaatctatccaaaataggtttggagatc

SEQ ID NO: 716329 - DNA, 438 bp, Homo sapiens
aattcggcacaccggggggacttgaggagtgcacaggaggcctgtggcacctgggagtgagtgagtggcgagcaaacgctccttctcggaaaggcagatgcctgcaggtgcggaagtagctgcttggtccccagtgtgtcagcttggggggcacagaaaatgagagggtgacaggaagcttccggccaggcttggagagagggctgtgctttcttccttctgtagtttctttctctctctctctctctctctctttctttctccctctctatctctctctttctttttgagatggagtctcactctgttgcccaggctggagtgcagtggtgcaatctcagctcatggcaacctctgccttttgggttcaaacgattctccttcctcagcctgccgagtagctgggattacagggccacaccaccacacccagataat

SEQ ID NO: 716330 - DNA, 314 bp, Homo sapiens
ggctcggtacctcaatgaaaatcaggctgggcaagtgcggtagctcatactgtaatcccagcactttgggaggtggaggcaggcagatctcttgagcccaggagtttgagaccagcttgggcaacatggtgacaccccatctctacaaaaaatacagaaattagccaagcatattgccacacacccgtagtcccagctactcaggaggctgaggtgggaggatggcttgagcctggaaggcagaggttatagtgaaccgaggttgctccactgtactccagcctgggtgatagagccacacccagaccttgtct

SEQ ID NO: 716331 - DNA, 886 bp, Homo sapiens
gggttgtggaatggcctgggacccattgacagcacgatgtgtgactgtgagcaggagtgtggatgccatcggtgcagacgctggtggaccccaatgcatgccctctgcatgtgccctgcattcctggtgctgcttgttcactgtctgctgctggtgctctgtgctgtgcccatgtgctgccacttgcatggatcatgccatgtgccttctgatgactgattcctgcccttgctcacatgcactgatgcttgtgcctaacttgcctgtgtgccatcgatgctagtgaatgcctctgctgcacaatacccccaatagcttggctagtgaactgatagcattgcaagacacccgtcaggagcccataggtgcgccatagaggcaggggaggccctggtgggccatctggggacccggaagttctggagatcctgaagcatgtattcctctggacccctgtcatcgatggtggcctgagacctgccatgctggcctgtgcgcatggctggatgtggctgcagcagcacggcggggagccggcggctgtggaccctacctctccgtggaccctgcccctgccggctgaggagcgtgactgtgggtgctgcctgctgggaggcgctgctggatgagtcccggccgctcttcgagcgataccgcgccatgttctgccctgtgcaacggcgggagtgcgaggaggccgccctgtgtgctggccgagggtctgcactgtgggagcgccctcttcctgcacgaggtcggttacgtcctgggacagctgctcacgaggcggtggtgccccagctgctggctgcctgtgccgattcaccgagaaccccatggtgcggcccgattgcgcggagggcctgggcgccattgccggctgctg

SEQ ID NO: 716332 - DNA, 190 bp, Homo sapiens
acacactcagttagactttggctgcattctcacttggctgtatgcgtcacactagtaagaatagacagcgtcaccagagaggactgctctcacctcgggattttactgacacgacattagacttaggtcattggccagagagacttattctttaccgataccaccccaaccatggtcgagcggacgcgta

SEQ ID NO: 716333 - DNA, 618 bp, Homo sapiens
gatcgaggaagcccccttcctacgaagaggaacaggacgtcctccttggacacatcctgtctaggcgagcgagtgcagtgcgccggacctggtatggaacagcaaaatcctgttgaaccgatagttcgctcggtggaaggcgcctctaagtggtgacccatgctcgactctgtactgatagtctaccaccgtttgtagttgaggatctcgagccaagctgagagcctctggggaatgtgggggctagcagaggtaagaaatctacatacgagagacactccgacacaactctgttttaacggtagttgacatgccttgatccgccgccagggcaattaaagtcagctgttcatgggccgtaagatcccatgtccagtcgacaagtgtcggcgagcaaaccagtggtgcgccctgaagaatgaggcacatagccgtgccttcaatactgaacgggagagaaccactccggggagaaacccgttgtcgggcccaagatggaagtggagtttacctggcatgcggtaatgcgcccttgagcacgttcttgcaaagggccctacgcaagagtatatctctggagaaatcgtccccttttcggcgtcaccttaagccgccctt

SEQ ID NO: 716334 - DNA, 115 bp, Homo sapiens
tctagagcttacggttcagcaggaatctcgcgggggcagcagtgaatagcagcaggaattctcgcgggcagcaggaattctcagcagcaggaattctcgcgggggcagcaggaat

SEQ ID NO: 716335 - DNA, 1015 bp, Homo sapiens
  misc_feature (1015)..(1015): n is a, c, g, or t
gagtgctgacagtataaggtctcggagatccgggcactcagacatcggtgagtcggtccgttgcaagcaccccggaattataattatctacctacttcttattagcatcatatgttgattgtcgtctgcttgcaacaattgtgtagcaatagtgttgctaccagagacgactgctgcatcttacgatgagagataccggtcagtaattgtccaaactaaccatgtgggtcgaattcgcagaatgtatccatgtcttgagcatgtagtcacaaaacctatacacgtgagatcgacaggggtattctagcagctggcttatggaccagacaatcgttaaccaatcaaggtttgaaaatcacaaaacactcgggaagtcgataatcaggcctgatcataaggcaaatcgctagagcgtccaactataattgagatgcgttaggatagtaaatctagtacaaagacaaccaaagatatatggattaggacggctgggcatgactttatggtaattgtccgtaggtacacatatgcgttcaagaatgaaaattgatgtgaaggatttatggagaagcaatcgggattatgttaaaagtagaatagaagtcaaaacgtaatatcggatgattttcgcaatgcgatagtatagtaacttcgacagactacatccatataaggatgtgttcaagcgcatatgatacagaatgacacgggtatgacccgctaggccttgaaagggacgatcaatggtgcgccatgggaaaccaatttgcccacatgaccactggttgcaataattctcgactagatattctacatggaggaaagagggaattggtccaaaagtaccaattagcccaaatacatgggaagctgaatagcagcaatcgggacttcaacttgtacttaagggcctctggaaaagacgtaaacctagcaaattcgttaaggcgtacgtgtgaagatcggattggggtccggaaaattggattggacgtgtgtttaagaaggagaactn

SEQ ID NO: 716336 - DNA, 530 bp, Homo sapiens
ctggaccggcgagtattaactggacaagcaaggggcacgaggtacgcttgcgtcagaggcgcttcgtacaaacggaagcacctcccaccaacgtgtgcattcatcatgaggtgacgcccaccttcgggggcacttggtaactccgcacagtcgcagagtgagcggcaagatgggatggcaccatagcaacctcggacacaacctagggactggagttgcgcgtttctacgtacagagccggagcatgccgctcaagtccctgtggtggtggaactcccacatcgtggcagagtaagaggcccctgggaaccccgtgggaaaccccggtgagagggcggacaccccttgctgtagaaagctgctctgcccgaagcctggacccagctgctacatttagccgaataacaggggcacctgataagctgactagcgggaacctgaacccccaacaggactcagaccttttcagcaatcgtgctcgataccctgtgtccaatctggttccatattcagatatcatcgccgggtca

SEQ ID NO: 716337 - DNA, 119 bp, Homo sapiens
aggagtcatatcaacaagtagggtttacgaactctgatgttggatcaggacatcccgatggtggagccgctattaaaggttcgtttgttgaaaaatccatggtgctacgtgtccggcca

SEQ ID NO: 716338 - DNA, 105 bp, Homo sapiens
ctcgcaccaactggcaaagaagctgtgattcacatgtatgagcaccagtgataaccattctcagcttaaacacagttcacagggagttcctccaggaatacaaca

SEQ ID NO: 716339 - DNA, 1049 bp, Homo sapiens
  misc_feature (261)..(261): n is a, c, g, or t
  misc_feature (398)..(398): n is a, c, g, or t
  misc_feature (601)..(601): n is a, c, g, or t
  misc_feature (703)..(703): n is a, c, g, or t
  misc_feature (705)..(705): n is a, c, g, or t
cccccgtttagtgggttagtcgaaaaacgcagcacaattacccgaatttttaaagggtggacccaccccttattttatggggcacctcctggagaaggggaatccccccaccacaaaaggtgtgttggtgaacacacgaagaagacgcccaggcgccccttggttataatacccgcgccgggccccacggtatgaacctatattacacccgggtcctctttaaaaggggtttaatcggaaagggccctctcgtgggttgtngacgagaaaatttgtcgggcgcccccgaagagggttgtaaacagagatatagagggtgtcgcccccactctcacctggtgagcgcagccccccccggcgattatactatttggcccgcccacacttatagagagaangggtgttcacatggagcccccaccacgccgcagatctatttctctttcacgagagggagaaacacccacaagtgggtcacttgagattgtccctcgtcacccccccgcggaaaaaggcgcgaccacggtgtgcctatagacccacgcagaattttttcgcgggagaaaaatctatgctccccacaatatgggacccacagggncccacccccccgcgagtgggtcaatcctcttggtatatttggagattcacgagaactcacatttttggctggttgcgcacaagacccacacactgtggcttntntgggcactgagatttatatgagatttccctcgtgagattatatgcacacaagagaaaatatgagaccccccgacaccactatgagacttgcccacagacacctggccctgtattgagaaagagaaaagaccctccaaaaacagccaccgaaaaggaaccgccagaaccacgaatgtaagaaaagtccagggggactcgccaaggcccaatgttggtgctgcgccaaaaagtgaagctggagagattggatcccccccgcaaggagtataaggtgctgccatgatgttagctgtggcccctgtggatttttccccagaaccctttattaacttaaaaccttccca

SEQ ID NO: 716340 - DNA, 121 bp, Homo sapiens
cagtattagagtcagggacgttactagtaaataattgattgtatatttcaaaatagccagaagagaagatttatgttcccaacataaaagataaatgcttggagtaatgggtagtcacaga

SEQ ID NO: 716341 - DNA, 785 bp, Homo sapiens
ccacacacaccaccccaccacagcacctgccatcggctacgtccacggcgcgtgttaatacggacgaggaacatatctgtaggagatagatcaacagatcaattgtaggtactagcattccaaggatatataccttccaaatgatgatggcgaattttatacacgttctgctatacgttacccataagggtgaaattcgtggagcaagtacacctttccagtattcgagcttcttctccagttgaagcagctgcttactatggaagatgaaggacaattctagacatgtaagtggtgaccacaaaagcaggcctatctatgagttgcaaaattgacgacacaacccatgaacagaacaaacgaagacactgttcccgttaattgccgttctggcaacaagaccacagcacaacttcgagaacaagttgggagcaatggaaagagacacttaaccatgagaaagaaagcatgtgaccaactgcacaccagaacaaaagggtcttactgaagtaacacaaagcttaaaacatggacacaatgacagagtttaacgacagaggttcagtgatgctacatccaaagtcccatcagcttgaggaagatattgtgtcagtaacacactaacagcacatctgcacaacgaaaccgaatatagacagttcacaaggacaaactcaagaaggcaccacatgacacgagaacacttgattgtcagtcgaagaccgagacggtgacaggagcctatcaggtactttgacgataccgcaatagaaataccagctttg

SEQ ID NO: 716342 - DNA, 535 bp, Homo sapiens
ctcgaggccaagaattctccaaagtttgtatagtgtaggatttgttggtattcgtgataaaaacacctcatcctattcattttgccatgacgggcgaactccagataaaggttttgaaagtaatgagaaattattaattcatccatgttactggcttggtttgaatctaaatcgtaatgcacttgctccagaggaagcagaggagataaatgacgaatatgatattaatattatttcagataattcagccattagaaataaaacaataggtcaaataactactcatctagatcagataccgataggaaatgaaggtgccactgaatttgaacaatggtgtttagacgcactaagaatagtatttgcatcccacctaacagacatcaagtcccatccaaatggtaacgcagttcagagacgagatattataggcaccaatggtggcaaatctgatttttggaaacgagtattggaggactataaaacaagacaagttgtttttgatggcaaaaattttgaagaattaggtccatct

SEQ ID NO: 716343 - DNA, 477 bp, Homo sapiens
ccactaaatgtactgtgctagaagggggaaaaaataagtaggaagaatctctgtaacccataaaatggtatacaaatttcttactagtattattgtacaaagatgacaaacaaggaacttaaaatctacaagtgtactcaaataaatattatacaaagcaaaatatgatgggttccacaaagctttacaaataaaatactatggggaagcaagagagaagttgtgtcaggtggggcagagaatgaagaagggcattttagagaaggtgacattagagatgagtatataaaaataagcttctaagaggtgtaaaggagagagaaaggcattctatgtggagaagatggcatggacagaagcacaggaaatagtgaggaaatcgtattcttgaaggccaagaatgtgcatagccttggcttctctttgtattattattataaatatttttttgccacctatcacaccccaaaaaaaaaa

SEQ ID NO: 716344 - DNA, 645 bp, Homo sapiens
  misc_feature (39)..(39): n is a, c, g, or t
  misc_feature (64)..(64): n is a, c, g, or t
  misc_feature (174)..(174): n is a, c, g, or t
  misc_feature (192)..(192): n is a, c, g, or t
  misc_feature (197)..(197): n is a, c, g, or t
  misc_feature (205)..(205): n is a, c, g, or t
  misc_feature (207)..(207): n is a, c, g, or t
  misc_feature (212)..(213): n is a, c, g, or t
  misc_feature (226)..(226): n is a, c, g, or t
  misc_feature (236)..(236): n is a, c, g, or t
  misc_feature (239)..(239): n is a, c, g, or t
  misc_feature (244)..(244): n is a, c, g, or t
  misc_feature (252)..(252): n is a, c, g, or t
  misc_feature (256)..(256): n is a, c, g, or t
  misc_feature (264)..(264): n is a, c, g, or t
  misc_feature (335)..(335): n is a, c, g, or t
  misc_feature (337)..(337): n is a, c, g, or t
  misc_feature (374)..(375): n is a, c, g, or t
  misc_feature (384)..(384): n is a, c, g, or t
  misc_feature (407)..(407): n is a, c, g, or t
  misc_feature (432)..(432): n is a, c, g, or t
  misc_feature (435)..(435): n is a, c, g, or t
  misc_feature (461)..(461): n is a, c, g, or t
  misc_feature (463)..(463): n is a, c, g, or t
  misc_feature (525)..(525): n is a, c, g, or t
  misc_feature (571)..(571): n is a, c, g, or t
  misc_feature (597)..(597): n is a, c, g, or t
cgggaaaaagcaacatatttcatgctttgaatattttcncttgagaatagttttaaagttattnccttttgtaacattcaaaagtaaaacacacatataaaattccatcaaggattccctgtatgattaacattctgtacaagtcaaacatgaccacatctatattggaaaganagcactgagaagcaacancaggngaatgcancncctgnncctgtctcaggangaacagtttngtnaagtncagcagangaangtaacaangaccacttgtttccaaatacccagaggtttcttacgggccccccactaatcaataacacaagggctaagtncnaagtatttaaaaaaacaaaagactgcaggggaccccnncccccgggnccctttaccaaagccccaaaccncttaggacattaattacaatattcngcnccccaaaaaaataggcaaacacaggntngccaaattttagttacccagggaacctaccaaattttaaaggagaaaaaagacttacatccncaggacacaaactttagttttcacattcaccaaaacattttaaaancacccaaacaggagaatggaaaaggngggggcttatgtgggggggggtattacggcatttttttccccagtaaa

SEQ ID NO: 716345 - DNA, 153 bp, Homo sapiens
acgcaactccgggatcttatgttgtcttccacttggcactcatggtagtatagcattgaggaggacaaggctgggtatctggagggcagactgtctagcagccggtgatcttgttgtttggtgttcttgtgccacccaggtgtttgatgagct

SEQ ID NO: 716346 - DNA, 468 bp, Homo sapiens
gatcgctaatatgctgtctcaaaaaaaaaaagaaaagaaaagaaaagtgttactatagtatcctggcatttggctagcttgtaagtatctaagttaagttaggtaatttgatgattcaaagtttgactgtgaaaagcttgccgtaacatgcagatgggctgtaattgagtaaagtatgaaaatatgttttcggggttgccatttttctttctgaatttgattgcctggataatctgtggtcttctaaattattcttgaccttgggtttcccagtaattttatggctaataagtaaggctaaaaagtgactgggtgaaccattttagggtcccccaggttttagatcccataggatggcccatttaatcttatgtcagtatatacctaaggtcccattctcagaaactgctgtttccctagagcccagaaggccacagtcacctgccttcattaagaacactgtggcaa

SEQ ID NO: 716347 - DNA, 649 bp, Homo sapiens
  misc_feature (620)..(620): n is a, c, g, or t
  misc_feature (623)..(623): n is a, c, g, or t
cgcggtggctcacgcctgtaatcccagcactttgggaggctgaggtgggtggatcatgaggtcaggagatcgagaccaccctggctaacatggtgaaaccccgtctctactaaaaatacaaaaaattagccgggcgtagtagcaggtgcctgtagtcccagctacttgggaggctgaggcaggagaatggcgtgaacccggaaggcggagcttgcagtgagccgagatcgcgccactgcactccagcctgggtgacagagcaagactctgtctcaaaaaataaaaaataaataaataaataaataaataaataaataaataaatatcattatatagccaggtgtggagctcaggccagtaattcctgtactttggggagccgaaggggacggatcacttgagctcaggagtttgagaccagtctgggcaacatggtaaaaccccgtctctactaaaaaaatagaaaaaattagccaggtgtggtggactgcacctgtagtcccaactacttgtgaggctgaggtgggagaatcgcctgaacccaggaggtggttgcagtgagctaagatcacaccactgcactccagcctggatgacagagtgagacccttgctcaaaanatnaagttaatgtaatacatgtcgggcgg

SEQ ID NO: 716348 - DNA, 152 bp, Homo sapiens
tttgtatgggcaaaaaagtcgaggattgtatgggtgattatctggtataacaggtaatttaagtttctgtgctgtggaaagtgtaaagcatcccaagaaagggttttaatgtagattttttttttggccccccatgctgtggatggctaaag

SEQ ID NO: 716349 - DNA, 182 bp, Homo sapiens
  misc_feature (177)..(177): n is a, c, g, or t
ctgctcattgtaacctcggggttcaagcaattcttctgcctcagccttccaagtagctgggattacaagtgcccaccaccatgcccagctaattttaatatttttatgtagagacagtgtttcaccattgttgaccagtgctgatcttaaatctcttgactctcaaagtgatccacnccacc

SEQ ID NO: 716350 - DNA, 117 bp, Homo sapiens
tggggcagagctggcggctgttgttgtggtatggcggtggtgcgtgtcaggctctgcaggaagattcggtcagtgatggtgccagcagagctgcaggcctcgtccagcacggccagg

SEQ ID NO: 716351 - DNA, 188 bp, Homo sapiens
  misc_feature (9)..(9): n is a, c, g, or t
  misc_feature (15)..(15): n is a, c, g, or t
  misc_feature (101)..(101): n is a, c, g, or t
ctgaaacanactttnagaacagctggtcattatgccaaccaggagatggacagtaaggaggaggaggaggtgcctcagcccatgccaagcatcccggaggntctagagagccagaaggccatggtggcatttttaaactcagctgtagctagtgccgaggaggagcaggcacggctatttgggcagct

SEQ ID NO: 716352 - DNA, 295 bp, Homo sapiens
  misc_feature (24)..(24): n is a, c, g, or t
  misc_feature (60)..(60): n is a, c, g, or t
  misc_feature (127)..(127): n is a, c, g, or t
  misc_feature (148)..(148): n is a, c, g, or t
  misc_feature (150)..(150): n is a, c, g, or t
  misc_feature (160)..(160): n is a, c, g, or t
  misc_feature (237)..(237): n is a, c, g, or t
  misc_feature (247)..(247): n is a, c, g, or t
gaattctggatcctcggggggggnaccacgaggaccacgcttaaccacgcgctctgtgcnacctcttatgtgatgacgcacatcacagcttccacaagcattatctcacctcactggtgggtgaacncaggcctagggaccatccgcncnagtctgctanccctgccgtgccagtgggtctgcacagcctctacatgggagaaatgagcgagagagtgtggatgtgagtgtaaagcnctgtgtgtcnagagagggtgtggatctacgcttcgaatggtatttctatctggatatg

SEQ ID NO: 716353 - DNA, 304 bp, Homo sapiens
gtccacaatcaagttccaaatgcagaaggtgttgggcgataccatcacgtgatgttatcgcccatcacccttctgagccccagaccactctagacccaagcagccttatcaatttaccctgaagcatcatgaactatgttgggaagcaatttctacattcccaacctattacacttgattcccattcctctcaacacaaactggaagcataactagaagtcatctggccacgttgcctttatagtacaagaagtcacttctacccatatgtataacgtggtagcggtggtgtcggggataacta

SEQ ID NO: 716354 - DNA, 116 bp, Homo sapiens
acccgcggcgagttcatgcactcatgggcccggctgctcggcaggctaaggcgggaggattgcttgagtctgggaggtcgaggctgcagtgagccactgcactccagcgagtgatg

SEQ ID NO: 716355 - DNA, 131 bp, Homo sapiens
tccacacagcactaggggaaaaaaagcagtagacaaggaacagcaaagtaatttatcttgcatgccactttcagtcaacaggatgtggctctctagaatgctgtgtggagcctagttgcctgtgctggatg

SEQ ID NO: 716356 - DNA, 1235 bp, Homo sapiens
catagtggctcacacctgtaatcccagtactttgggaggccaaggcaggtggacggcttcagcccaagagtttaagaccagcctgggcaacaaagtgaaaccccatctttacaaaaaaaacaagtcaaaaattagctgggtgtgggggtacatgcctgtaatcccagctactcgggaggctgaggtgagagcgatggttggagcccaggcaagcagaggttacagtgagccgagatcattgcacattgaactctagctggggctacagagccagaccctctctcaagaaaaacaaaagcgaaaacaaggaaaaaaacaaactcgggtcacctgggatatacaggtcaaacacggtatcctcttgcaaaacacgtaagtccgtggccccagcacttgggaggctcagcgccttataacacccagcatcttcgggagagcgccaaaagtggggtgcgcaatcactttcgagcacccagggcagtttggcaagattttagcccgctgtgaccacatcaccgggaaaaaccgcaatagtctctatcacagaccaatactatccgcagacaacaccactcagcctcggaccacactgtcggggcagttgcacccccggtgtaggtcaccaaggcatagcctcagggaagggtttgacgcgcacgcaggcatcgacttgtgagccccaaaagggggatacgcagggcccaccgagcagtgaagggccaatgcgtctgcgaaccccaacgggagcaacccaccaagccccgtgaagacaacagggggaccggccgtaaacaccccccgatgatcgcccaccaaaatgaaccatcacaccaaccgacactcgaccaccacaaaccagacagcgcaccagcgttgcgtgcgacgaccaccactctgacccaccatgacagaaacacaaagcccttcctaccaccaaacacgccacaccgtcgacgtataggtggcgacccacgcgaggaccgcccccacacatcggaaagacacagacccgacgacacccacgcgcggaccgaccaagcagcgtgcttcagacccaaagggaggagcgaccgaccagggggcgacaacagacaaaaacaaggcgagcgcgtggacgactcaacacaagcaaccgacgtaaaaaaaatccgccccccgcggggcgaagccacgcaacacaggggccgaactcagcacaacacaccccccacacacatcgagcgacgaccatacac

SEQ ID NO: 716357 - DNA, 130 bp, Homo sapiens
  misc_feature (105)..(106): n is a, c, g, or t
tttttgatggaaattgtgaaaaacagtgttaaggattgttatcctgctgtccagaaaacgattttggtcatcatggaacgactgctttgcctcttgagatggagnnacatatgcagagctcatccgtttg

SEQ ID NO: 716358 - DNA, 845 bp, Homo sapiens
ggagggaagggatcctatatgtcctgtaggctctgtagcaaagggtcagcatttctaaatcttagacttgaacaaatcaaaacacccaacaaaaaagaacaaagagaatgatttagcaagttgggaatcatgacttgacataacagagcttcggttccaccatgtactttatcactagccctctgttctggaacagtcaccttgtaaatttctatttctggaaaattattttcccacgtctgaccttcacttctgactgtaccctgtacctagcttggtttgctgccattctgtctatagtaagtggcgtacacttgccctcgtgaattggattgaagagaaactatttacatcttttcttccataaaataagaaagtaatcaagctgactgtgatccttaaatttgagaccagagcagaataacagtctcactttgacatgttggtacttctgtccctgtgatttaatctctctaaacttgctttaggtcaccattgcggagcgcgggcatgggaggaaaatagtgttcaatatatccattaaatgttcattattctttttgaagatttgtgtgttggaattggtgtctctacacctaaataatacggggataatggctgaaatgtcctttgagaggacggtaaagcgcccgaagacatttaatggaccctttttgtgtgggagcggcgccaatattttatccctggaatatcgttcctaatgatcactacaaaactcccgggacaacaaagggggggggggtccccaataggaagcgcggggcaagggttgtctacacaccaagggttgggactggggtttaagggcaggtcgtacccgcgga

SEQ ID NO: 716359 - DNA, 117 bp, Homo sapiens
ttcagaggcacaaggaggctgctgcggatattggtaggcccgggcgagatttacaccctctccgcagcaggcctccttggtgctctggctccttggtgcctctggcttccttggtgc

SEQ ID NO: 716360 - DNA, 198 bp, Homo sapiens
cagcagagaagtcattcattctggcagctatagtcttcaagaaatcatattttttcaaatacatacagacttgcaccgttacacttactccttgcctcatgggctgaagcatggatgttgtgttagcaggcatggaaacaatcttttcttttcttttcttttcttttcttttctcttctcttctctgctggatacctt

SEQ ID NO: 716361 - DNA, 318 bp, Homo sapiens
  misc_feature (255)..(255): n is a, c, g, or t
tacaggatctcaagacagacactcggggcggggccagggggtggggctgggctgatctcaggcagagctgggcgcttagcatcagtgaggaagtggtaaaaaaacgcgacttcctttttcacttcctcaattttctctgcatgcttgttgaagatatgttggcgcacaaactcaggacccttgaattcctggccactgagaggacacagccactttatcctggcccaggttccggcggtgtgggaggatgacganacttctccagcttccgggctcgtggggtcttggcggccccagtcttcgtgggccctcttcctc

SEQ ID NO: 716362 - DNA, 193 bp, Homo sapiens
agaaaggtggatcgtctacccaggagtttgagaccagcctgggcacactgtgagaccccatctctacaaaacatgcaaaagttggccggccatggtggcatgaacctgtggtcccagctactccggagtctgaggcaggactgctcgagcctggggaggcaaaggctgcagtaagccaagatcacgccactcc

SEQ ID NO: 716363 - DNA, 916 bp, Homo sapiens
ggtgcctgtgtggatgtgcctgctggcgctggtcacgtgctgagcctgatgcctgatgcctgctgcctgatgcctgcgcctgatctgccatcctggcctcgtgcagctcgctgctgctgagtccctgtgcctgtgctggtgctgctggccctggctgtgtgccatgtgctggctgccacagcccatgtgatgctcgagaacatctgtagctgaacacggtgtgctactcaatggccctgggaagtgtggctggtgtgaaatctgcaaagtgctaataagcaatgaaatggcgtgcagatgctccagttcccgtcacatcatgccagtgctggaaagagcttgcggctcagcctcgagctgtgactatcacagcctgttgctgatgctggcagcccattgggcgcctgcttgttcccgagagttcttgtgccacgatggcctggagcttgaggccgctgctgtcgccttccttggatgggggtggccgagtatgaagtgaccccggatgacaatgcggaaggcatgtgggcgtgcagctaacgcagaattttctgagccacactgggtcctgacctcatccctgaggtcccccggccagctggtgacgaactgcaacccagctggctggagcagggtccctgcaaagaccttttccaggaactcacccggtttgagccacgagtacctgatgcgtggcccttttgccgactacctcgacagcatctacttcaaccgtttacttgcagtggaagtggcttggaaaggcagccagtgaccaaaaacaccttcaggcaataccgagttcctgggcaaaggtggctttggggaggtgtgcgccttgccaggtgcgggcacaggtaagatgtatgcctgcaagaagctagaagacaaagcggatcaagaagcggaaaagggg

SEQ ID NO: 716364 - DNA, 427 bp, Homo sapiens
  misc_feature (7)..(7): n is a, c, g, or t
tgggagnttaggaagaaggtttcccccctcctttcccccttggttgagaggggggggtccccccccccaggggtgggggtttcccctccccccccctttttgggtgtttaagggaaggggggccctttggccccccttttttttacccttaaaccttttcccctggggccctggggccccgggtttaaaaagttagggaaagttaaagttaggtttgggggggggcggccctttattggggcttggcgggaaagggattcttggggttttttaaatttggatggggccccaggcccgggggccgttcgggggggggtttttccccttggggggggggttgggggccccgggggtcccggcttgggtttcccccccggtttttgggctttgttttccccccttttttaaaggtttcaaaaacccccca

SEQ ID NO: 716365 - DNA, 160 bp, Homo sapiens
tagcataaaagaggataaaacaaatggaagacatccatgctcatgggtaggaagaatcaatatccgtgaaattggccatactgcccaaggtaatttacagatacaatgcaatcccagctcttcttactaaccaactttgttttcaccttctcattttact

SEQ ID NO: 716366 - DNA, 165 bp, Homo sapiens
cctggctggagcggggtctgacacgcttctgggacgggccaggttgtgccctgtttcttgctgcgaggaccaggacacggaatgtttgcccggtgagaattcattgggctgcacgcttatgatctatgcatttgtctatctatttcaataaaacatttacctaat

SEQ ID NO: 716367 - DNA, 103 bp, Homo sapiens
acttgcggatccttagacagcggaccccatggcaactcattagcgcattatctgagttgagcgaggcacagagtaggaggcggggggggggccggctgtctga

SEQ ID NO: 716368 - DNA, 712 bp, Homo sapiens
  misc_feature (196)..(196): n is a, c, g, or t
  misc_feature (218)..(218): n is a, c, g, or t
  misc_feature (507)..(507): n is a, c, g, or t
  misc_feature (538)..(539): n is a, c, g, or t
  misc_feature (674)..(674): n is a, c, g, or t
  misc_feature (680)..(680): n is a, c, g, or t
gcgaagaaagtcagccaagtccttgtagtacaagcatttttcagcagagcccgaaaaacagcacttgtttcacatggaggaggatccgatgcctgtgggtgttcggggttgggttctctgtggaaaactcgtcagcccatgtcttgagagtattagaagtaaacaccctgaacccttagttaaaaacgttaacgcnacggcacagccttatgtaacanggctttccgaccgacaaggtgaagttttacgggagccaaggtgatcttctgcgggagctgaagtgatggggttcagggggctgcgtgagccgttgcgggaaaggtcgtgagcggattcgggatcacagtgaaacacgagatttcccaaaggtgaggtttttcggggccgcacagccacagaacccgcgcggtgactgactgcacagttttctgcctgtgcagacataggtgagaatttgcgggacctctttgcgccccgattctgcccatctttaggcaatttggcganaggtgaggtttcacgggactccgcggggatnnggtgtgaggatttccgggaaacgcccgccatttgcacagcaaaagtgctctccggagcctgtgatgccctaaaggtgagccttttcgggagggaaatccgggtttcctgccctgatcgcactaaggtgagctttncggggntgtcggtcacaagacggtgaacggatcacagg

SEQ ID NO: 716369 - DNA, 262 bp, Homo sapiens
aaaattcaactgtatctaattccgccaaacgtctttcagctgtttgacgatttgacaaataggcggctacgtgtgcgtagtgtaaatgacgcttggcttcaccaaattaccacgcttttcttccacttttgccaacaattcactcaagtctgggacccagaacaaatcgacgcgcttacgtaatacttgcaacgttcttgcaaaagttccgctgcgctatccaaatcaccacgctcattcaaaattcaacatgacgttgccg

SEQ ID NO: 716370 - DNA, 157 bp, Homo sapiens
tcagaggatccccttagggaggactaaagtcatttcagtctacaccgtattctttatactctgtctcaataacaaatgtcactgcccaaataaagcacattacatctttgctggctctgcatcattctttctgaagtctcctctatcctaagaccct

SEQ ID NO: 716371 - DNA, 801 bp, Homo sapiens
  misc_feature (166)..(166): n is a, c, g, or t
agagacatcggtgtggttattgccctggcatccaccgagttgaggaacctaggggggacaccagggcatggggccctcctgaggtccgtcgccctgtagttgcccagacagcagttcgtggacagtgcagcttcccccaggaaagggacctagtttagcacattgnccgggagcatgaaacttaatggagcctcaaaggatagatgacgctctgagtttttcagtactccctcaagactggacatcttggtcttcttctcaggcctgagggggtaccatttttggtgtgataaatagccctcacagcctgtggtgtcatttttgaggtgggggggagggaggaggtactattggcaactgcttcatgaacctcctgtgggctataatgttgttcactcgagtgtgactcattatggattgggactcatttcgcgtccctttctcctgtggtgcacagaccttgggggaaaggaaggaagtgcatgtttgggaactggcattactggagactaatggtctttaacctccttataccaaccagcatccctcctctcacccaaggtgaactggagggtactgtggtgagctggccactccagagcatgcagtgccacctggaggagtcagactaccatcgacatcgtagggaagagaggggagatctttttttgtagtgttttaattggggtgtgggaggccggggaggttttctatcaactgtatcattttctcctgagggtggagtgtcccatccttttaatcaaggtgattgtgattttgactaataagaaagaatttgta

SEQ ID NO: 716372 - DNA, 161 bp, Homo sapiens
gtcagtgtcttaaacctctctgcgatttactagaatatatgtgtacaactaactctgtaaatatacatatctataaatatttttcctgtgtaactaattcatgtctcttttagataactagtttatactgatgtctctgaacctaatctccttagcataca

SEQ ID NO: 716373 - DNA, 274 bp, Homo sapiens
tattatcctgcatgtaggcgaatgtaagatgctcttaaattcttaaccttatatgttgtgcttctgaccattttctcgttgtcctctctttccttttttttttgttggtttgtttgcaataaacttaagttcttgtgtccagccttttatttggttaattttttaacattgtttttgtgtgctgccaattgtgtatcatgccaaccgtggaaaaaaaaaattcaaagagcatttgaacatttcttgtactcttttaccaagagagttagtgctt

SEQ ID NO: 716374 - DNA, 528 bp, Homo sapiens
cagtgagttcttcttgcctgctgcctttactgagccagtttatcaagatgggggaattgcaataaagtttaattcacacagagccagctatacaggagaccagggttttattattactctaatgaatctccccaagaattcggggattggagtttttagggataatttggtgggtagggggccagtgagtaagagtgctgattggtcaggctggagattaaatcacagggagtctaaactgtcctcttgcgctagagtcggtcctcggcaggggccacgaaaccagatgagccaatttatcaatctgggtagtgccagctgatgaagccatcaagtacagggtctgcagaatatctcaagcactgatcttaggttttacaacagtgatgtcatccgatgagcaatctggggaggtttagaatcttgcagcctccagctgcatgactcctaaaccatgatttgtaatcttgtggctaatttgttagtcctaccaaggcagtctagtcctcaggcaggaaggagggtttt

SEQ ID NO: 716375 - DNA, 431 bp, Homo sapiens
gccacatgcagaagggtggccacggagcccacaggggaccacaccatgtccgtcctgctgggatccggccacggccccggggtctccccagaagatgctggcactcgagtcagggggcatcagatttctcagcaacccctgaggctagaagacagtagaggggcgttaccatgaccgtcaggagaatgacccctgccccacagccacgcacagccaggcttccagtggaggtgcagtgtgcgtgtgtcatggggacgtggatgcgcctgtgccacagggacagtctgtgtatgtcacagggatgtcggtgtgcacgtgttacgaggatgttggacgcgtgtcacggggacatggttgcctgtgtgtcttggggatgtgtcttggggacgcgggtgcacatgtgtcacggagacgtcgacgcggccgcgaat

SEQ ID NO: 716376 - DNA, 88 bp, Homo sapiens
aaaagaataaaaaattgccatatttgcactaaaacaattgcccgtgtccggggttttttcggagctctttttttccctcacccacttt

SEQ ID NO: 716377 - DNA, 397 bp, Homo sapiens
  misc_feature (308)..(309): n is a, c, g, or t
  misc_feature (325)..(325): n is a, c, g, or t
  misc_feature (355)..(355): n is a, c, g, or t
  misc_feature (384)..(384): n is a, c, g, or t
ccctgttaactgaattgtcaacttctataaaccatttcactgctaataacctttcatcagatcagacagaggaaataaaagttttccacttcttgttgagaaagcaaatgttagctgtgagatttgcaaattattggctatagatctattctgtatacatcagtgaaaggttactttatatttaaaactgaaactagaagcacaagcaacagaagaaaaaaatagataaatcggacatcattaaaattacaaactttagggtgatgcacggtgggctcacgtctgtaatcccagcattttggggaggnncaagggggggagggtncactttaaggcccgggagttttgaggaccngccttcaacaacacaggaaggaccccgtnttcttaccaaaat

SEQ ID NO: 716378 - DNA, 192 bp, Homo sapiens
cttgtccccttccactgtaccgggcctgtccaagggagacgacaaagggctggttctggggcaggctgctggtcaaactctgtcccatcttccagcttccccgtgtagtgcatgtcctggacatcccctttgcgcgatttgatgggacagtggtccatcctgcttcttgaccccggtcacatgcaaggtgtc

SEQ ID NO: 716379 - DNA, 549 bp, Homo sapiens
tgaaacggagtctcgctctgtcacccaggctggagtgcggtggtgcgatcttggctcaccgaggctctgcctcccgggttcacgccattctcctgcctcagcctcccgagtggctggtactgcaggcttgcgccaccatgcccggccaattttttggtgttttgggtagagacggggttccactgtgttggacgggatggtcttgatctcctgacctcgtaatccgcccgcctcggcctcccaggtgctgggattacagacttgagccaccgcccccggccagaaatgaggtttttctctgttgcccaggcgggcttcaaagtccggggctcaagtgatcctccttgcctgggcctcccaggtagctgggactatgggtgtgctccactgacactcaaatgggtttaaatgcctctttaaaatccactcagaggcctggcgcggggactctgcctgtagtcccagcatttgagaggccaaggcgggggatcacttgagggtcaggaagtgaaagccgctggcggtttggtggaaccccgctctgctaag

SEQ ID NO: 716380 - DNA, 487 bp, Homo sapiens
ccccgactagccgacagggaacaatcttgtggggtccaagctcaatgtgccctattactgctccatgttgtgataggggtggagggcagatggtgtagagatgctagggtaagctcccggtggcagttgaggcctctgagactgagtgcctgtggtcagctctgagagtgagcctgtgtgtatggctccattggatggagtcactccaggatggattgtctgacagtgagccatgtcggagggatctattggtcaagtacggaatcctcagtttaagtgagcctggtgttaggaaaagaattcccaacaaggtacaggaaaatcagggtagagtgtggccttaggcaagccacttctccgaacctgtttccttccctctaaaatgagaatcgcgatccagaatctgcctcccccgcaacctgttgggaagtctcagctgaagatgcctactgaggtcaccttggctgttgggtggaggggtggggtg

SEQ ID NO: 716381 - DNA, 106 bp, Homo sapiens
gtagccgttcttcatgctccctctccggatatcagaaccctgatttccccgttacccgctggtcacctataggtaaagcactgggagattacccaatttgaaatgt

SEQ ID NO: 716382 - DNA, 122 bp, Homo sapiens
aaccccccattaggattagggcccagactggctgtcggacactggggttgtgaagaatctctgggttttgatttagtgtaacacacacgtgatgtcatgacccactgggggttggcaagata

SEQ ID NO: 716383 - DNA, 736 bp, Homo sapiens
ggttgagagtagacagtagaaccagcgctcgagaggcttaagacaggacgacgtggtacggtagacggtgacaatgtgactactggcagacgcaatggcatggggccggaggctcagaactcgcggtgattctcgcgtgcgttgctaggtgaggacacctgtgtgtacccaggtgatcgcatgcgtggcgtgatgcgatctgcgggcggtcgaatagaggacgcggcgaagtgacacctgtctttgcacatgcgaaaaatagcgtaaggccgagatgcattggcgccgtggtgatcgaatgcgaagcggatagggttgctcggcgtgggccatctcagctaagcctcggtagagtccacggaggcttgtccttggtagcgccagtgcgtgggttggttccaagggatcgttcacggcccagtcgggagaacgaccctagcggtgctcatgagagcgccgtgaatcgcaagacggtcgccaatgagaagcgaagtccgttgggtggaatcacacagtcgcacacattagttccgcagtagccgtcaggcacacaattaacccagacgcagagggaatctcgaggggagaagaacggatcgatagcgaacgtggcgcaccagaaagggcgaacggcgtgttgcgatttggaaggtcgcaaatggaaggcgttcggactactcccttttaccccctatgtggggcttgatgcagcttgaggcgccctagttgcattaca

SEQ ID NO: 716384 - DNA, 544 bp, Homo sapiens
gcaacagcaggctgggatgaggtaggggatgcatttgagaaggaggaaacgttcaccttgtctaccatcaagacacttgaagaggctgtgggttatattgtgaagttcttggcattgcaccctgctgagaggtcagacaaattgccggattacaagaacacccactcgttgctcctggctggtgtgttccggggtggtcatgacttccaaaatccctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgacttttttttttttttttttattttttttttttcactcctatttactttaataatat

SEQ ID NO: 716385 - DNA, 350 bp, Homo sapiens
gagagagagagagaactagtcgcgagtattgtttttttgttttattgccaggctcacaccacctttctttatttggaatgagtggtactcttcctcccaatgcagggccaggccccagaagcggccctgctgttgccgggggaagccaagtgtccagggaggccacagatccttccatcagaactacagctccacagaccggccggaggattccactccggagggcccctctgggaaatccagcctgcgctctctgacggcagagtggtcattgacctgccatcagtgcgcgtgtgccgtcatcagacgctgatgcagatccccagagcacctactggtcgagccggagc

SEQ ID NO: 716386 - DNA, 571 bp, Homo sapiens
gtgcctggctccgagtgctccgtggcggtcagttagacctgcgctccagtgtggtctcggtcccaggatggtcccatgctggtgtgtgagcctctgtgcttgcatctgtgcagccagaatccttgtacagagcgcataagtgttaccagcccacagcacgcaggaccggagatacttgctgcaacaggcccaggatccgtgagccggtactcatcgccattaccgtctccttgttgcggagagactcaatgctcgtccatgacgcagacaccgccacggaaacggaccgtcacttgctcttcgcatgactaattgcccccacgtgtgctagccactgtggcacccccattgtcgtaccatgcgcgagcatgaagtgccagtacatctactaatcacacggaggaacgacgagcaacgcacgttagacgccaagaccgagggcaataactgtccttcatctgcccctttgcgggaaaaacctcacccgaacgccccatcgcaaccatatcaggcattaggacagcacccattgcaattcccccttggaggtcctcatgcagccccgtcgtgc

SEQ ID NO: 716387 - DNA, 1448 bp, Homo sapiens
  misc_feature (874)..(874): n is a, c, g, or t
attttccattatactttctttcggttgtttgtctacagggtgtcacacaaagtttgggtgtttttgatcgtgtttccttgtggcgcccagggggagcagctcggtggtgtctgccaagcgccgggttggggggacaccccctgtggcaccacagtcaacactggtttccccgcgggtgtagtataatgtcgtgttcgagagtggccccccccgtgaaggtttgtgcacggtgggaacctttctttctcctggggggaacaaacatcagtgggccatttctaaaattcgtcacagaaaagtgctggttcttgttcacagagaatatttttttttcgttgcggcaaacagttgtggttgggtgaaccacgctctaatagattggcgcccccccccagtgggagatcccatacttgggcgcgtctaaatggcctctaagggtggatattatttctctctgggcgcccacgtctctacgggcgccaaaatattatagtctccccggggtaatattgcccccccctcggtgatttgggaggtttgcacccaacacacgggcgttcaacacacttgggcacaagacacaaagtgtttcgttcggaagatttctgagaaagggagaaaacagattttgagttccccccgtttttctcgggtgaaaaaaaaagcctcgggagaaggattggcgccccctcacaaaatgtgtctctggagaaagtctctcgggtagagatgagccgtcgcgcccactgtggtttagaaaataaatggggtgtgtcccttgggcgacacaggccacacatcagtgtgtttgttttgagagagagcttttctcgcacaagagacctatagatccacacactcttggggggtgtcnctctctcttgctctgtgttcgctgagatatatttgagagacccacagaccacacttttgtcgcgtgtggggtgtgtgtcactccacacaagcacacactgggacacacaagagacagggctctgttctgggaggtctcggccacaagcgtgtcacacacacatcagtgtctcggctccacgagaacagtctccacagagaaggggctatataatgagaataatgtatttccctcagatatacctcggccacaccccacacgttcttataatacacgctggtgggagaagaaccgcgttctcacagagaactgctttgtgttcacaattggccacatcttaaagtttaagaaggtaaaagaactgggttaaagagtaacccaatgcactctgtaaacccttcacgaaaggaaaaggagaaatgttttgctggacccacctttggttttctttttttgcgtggtggcacggtttaaaggttattaggtttttaaaatccgtactttttaatgggaaccacttggcccaaaatttgtcaccagaattttgagaccccatttaaaaagtttaatgaga

SEQ ID NO: 716388 - DNA, 510 bp, Homo sapiens
  misc_feature (8)..(8): n is a, c, g, or t
  misc_feature (23)..(23): n is a, c, g, or t
  misc_feature (29)..(29): n is a, c, g, or t
  misc_feature (36)..(36): n is a, c, g, or t
  misc_feature (45)..(45): n is a, c, g, or t
  misc_feature (111)..(111): n is a, c, g, or t
  misc_feature (190)..(190): n is a, c, g, or t
  misc_feature (200)..(200): n is a, c, g, or t
  misc_feature (287)..(287): n is a, c, g, or t
  misc_feature (386)..(386): n is a, c, g, or t
  misc_feature (419)..(419): n is a, c, g, or t
  misc_feature (430)..(430): n is a, c, g, or t
  misc_feature (487)..(487): n is a, c, g, or t
  misc_feature (494)..(494): n is a, c, g, or t
actttagnaagttggttaacagncaagtnacaaaantgccatatncacaatttgattcatgcagctgatgttcacttcaaactgtggcattacataatgcttcatacaggntatcatgcactggctcactgtaactggtaaattttagtcaatgggtctttgtctgactgtccattcatgtattatgagncatacagggnacaacaaacaactttcacattcagacaaggtcagatgttgccattttgtataatgttcgctctgtccttgagaatcaccacgtgagngcagcttatcgacttatgcaagaagaagaaatgaatatcttgataaatttatccaaagatgactgggagggttcttcggaacctagtgattgaaatggntttatctacagacatgtcagggcacttccagcnaattaaaattntaaggaacagtttgcagcagcctgaagggatttcagagccaaaccatgtcctgattntccacgnagcaggcatcagccac

SEQ ID NO: 716389 - DNA, 1315 bp, Homo sapiens
  misc_feature (60)..(63): n is a, c, g, or t
  misc_feature (260)..(260): n is a, c, g, or t
  misc_feature (286)..(286): n is a, c, g, or t
  misc_feature (289)..(289): n is a, c, g, or t
  misc_feature (308)..(308): n is a, c, g, or t
  misc_feature (310)..(311): n is a, c, g, or t
  misc_feature (313)..(313): n is a, c, g, or t
  misc_feature (319)..(319): n is a, c, g, or t
  misc_feature (324)..(325): n is a, c, g, or t
  misc_feature (328)..(328): n is a, c, g, or t
  misc_feature (373)..(373): n is a, c, g, or t
  misc_feature (376)..(376): n is a, c, g, or t
  misc_feature (385)..(385): n is a, c, g, or t
  misc_feature (398)..(399): n is a, c, g, or t
  misc_feature (402)..(402): n is a, c, g, or t
  misc_feature (474)..(474): n is a, c, g, or t
  misc_feature (511)..(511): n is a, c, g, or t
  misc_feature (538)..(538): n is a, c, g, or t
  misc_feature (572)..(572): n is a, c, g, or t
  misc_feature (583)..(583): n is a, c, g, or t
  misc_feature (604)..(606): n is a, c, g, or t
tggagcccgagcggagtgggactcgaggccctgtagccggactgggcccctcgccccctnnnncagcggcctgcgggccttggcatgcgccgcccctgcccacactgaccccgtgtggcggggcctgctccgcgcccccgggccgctctgtaatggtagggcagcctcagccccgagatgacgtctgggtctccgcggcccgggttattgtaggaaccatccggccccgcgtaatcgtaggaactatccggccccgcgtnaatcgtagggtctgcgcgggcccggnccngcaccagacgggactcccncnncncccaanttggnnggncgaagagtctcctcgccccagagtcatcttcgggacgcccagggnccngggtgattnttgggctcgccgnnggncccgggtgattgtttcatctccgtggcccgcggtggtcgtagctgtctccgagaccgctggactcccgtagnggtccccgtggccccgagttgtagtcgggacaccccnggcgcgggtgatcgtcgggtctccacngcgcccgggtcgctgacgcggatccggcctcggngccttctcagnggcgcctgcaaggccgcaggnnnggatgaacattctggcacccgtgcggagggatcgcgtcctggcggagctgccccagtgcctgaggaaggaggccgctttgcacgggcacaaaagacttccacccccgcgtcacctgctgcctgccaaggagcaacccggacaggcaccctgtggggattttacggatctccaagggtcattgtggtggggggaccctgtcgggtgcgggaagacttgcctcaattagtaggttctgcaaaggacaccttttgactaggaatcaacaatggccacccatttgtgacgtggaccttcgacgatggaacgatttgagggtgctgggcattccccttcagtttgcagctttgcggataccgctgggccaggagcaggtcacactgcatttgcatcaaccctatctatagaggagctcaagccatcatcattggtcttcacctgaatgatgtggcatctctggaacataccaagcagtgcttgtccggatgccctgaaaggagaatgaccccttccaggtgtgcttctcctccttgtaggttccacgacggttctgagtaccccttctcagtatgcgctgatgagaaagacgccctcccaggtggccccgggagattaaggccgagaacgggggcggctccatctcctcccgtgggaaagggcggaactctcctcgcggggagcgggggacttggcccatggctgccggggaac

SEQ ID NO: 716390 - DNA, 236 bp, Homo sapiens
tggacctttggggcagtgtgggtggtggtggcggtggctcttggtgtctctgccaggttggtaatcaaaatatggcgggccgcataaaagagttaggcagaatctcccccctctaaagtttggggaacagctccagtaagaggggtcccagctctccttaatacttctggtagaatccagctttaaataaatcgggttgggggctttacctggtgggaagctggggaaccctctag

SEQ ID NO: 716391 - DNA, 184 bp, Homo sapiens
  misc_feature (2)..(2): n is a, c, g, or t
antataagtgtctgtcagaaataaaacacaatgcgataccaccctttactctacaagatgcataatcgaaaaatcaaaaaacatgaagatttggcatggatgcggtgatcagggagcacttctaactgctgataggaatgtaaactaaataatgccaacgcgtggactagttgggtaccggagc

SEQ ID NO: 716392 - DNA, 379 bp, Homo sapiens
  misc_feature (22)..(22): n is a, c, g, or t
  misc_feature (41)..(41): n is a, c, g, or t
  misc_feature (49)..(49): n is a, c, g, or t
  misc_feature (372)..(372): n is a, c, g, or t
tttcaagagaaaaggcagttcncctaataagccagaaaggntcttggantgcccagcttttcaatgtcattctaaagctggaagtaggttgggcatagtgctcatgcctgtaatcccagcactttgggagtctgaggtgggaggatcgcttgaggccaggagttcaagaccagtttcagtaacatagcgagaccctgtctctacaaaaaaaatttaaaaaataaaatttagctgagcatggtggtgagtgtctgtagtcccagctacttgggaggctgagttgggaggatcgctggagcccaggagtttgaggctgaccaagccatgactgcacctccacactccagcctgagatagagtgagaccctatcnaaataaa

SEQ ID NO: 716393 - DNA, 282 bp, Homo sapiens
aaaatggcttaagatgtattacagatcctgaattccagcaaaagagctattgacaaccagttgaagaacgcccccgactctccccaagaggaacagaatcagcatgaaaatgcagtttcttcatcatcaccaatccatgtattcttcaaccacgtgatcccccacctcggtcactccaactcccttaaaactacctagacctaaacggcatcagacaggcagattagaggtttccccctgtctccttattcggcagccttatgattaaactacctactctga

SEQ ID NO: 716394 - DNA, 483 bp, Homo sapiens
  misc_feature (4)..(4): n is a, c, g, or t
  misc_feature (473)..(473): n is a, c, g, or t
  misc_feature (477)..(477): n is a, c, g, or t
  misc_feature (479)..(480): n is a, c, g, or t
  misc_feature (482)..(482): n is a, c, g, or t
ttanccccccttttttggcaaccttgagcgggagaacggtgctcacacagcacctcttgttttaggcggtatttttttaaagtggaagggtgagcagcctctgcatccccccactggggggagagagcaccctcctttgcttttgtgaaaacagacccattggaaagttcgcctccaacacacagtttatttcggatattgacaggccggggtggcagtggggctcctgggacccaagtgaaaggaaaaggggtgggctcactcagtcccccccaaaaggcccgcagaagaatgcaggggaccgggagtttgtgttcatggatccatcccccccatgccggggggggaatgcggggtacatcgctctccatgttgtcgtcctaaaaccccagaaaaatgccccccccttggtaaaattccccttcagctctttttttttgaaaaaaaaagggttgaccttggaaaaaaacacnaacnanncna

SEQ ID NO: 716395 - DNA, 996 bp, Homo sapiens
  misc_feature (583)..(583): n is a, c, g, or t
tgctgctcgcgcgttctgttaggctcgagttctcgtaccccgtttggtctcgacacagatggggtctcggattatcagaagatggtggccacggtagtcttctccacaaggacgtgttcacaacagaacagcatggtgtacatggaacacgttgtagccgggcacgagctacagtccgtgttcctgggtgtatcacgcgctggaacacccgcgttgtggtccacccctcctatgtagggtgggggcggggatcttccccaaccgctgggttggttgttgaaatgttcccccccggtggagaattgttacccacagtgccacatggggggacagccccgcgtcctagagccgcctatctccgggggggtgcgagggcacccatcttgtagagttgccgcccgcgcgagtattgcggttgctgttggtgtctgctctcttgggtccgtttctttcctctgtgggttgggccctcttttttcttctctctccaagaaggagttgcacagcaaagatggcgctcttcttgccaccgtgaaagctcttctcggaactagtatttgtgaacacaggcgggatgggggtnaccgcctcgctgtcgatcttgtaagaaaccccctcgctggggtgccctcccccaccaaggttgtccccgcagcggtccgctctgttgtcagcactgtggtgccccctcggaggagacgaagtcgctgacccgttgtcgtgtcaacggccccccccgtgatgtgtcgctgtgtgttcccccccccaaagtcgctcggcgcgggatcatcgtgttttctcgacgccgcagcccccggaccttctcgcgctcggggcgagggccaccgtgtcggtgttatcattccggtgtccccacggggtttcgtttgtaattcttggctctctgacactggtgcgcaagagaggcgctctgaaacaccattaactccttgaggcttttttaaaaaataccgccctggttttccccaaataaca

SEQ ID NO: 716396 - DNA, 126 bp, Homo sapiens
gaagtggtttgtgtttttccccccccccccccccccttttgggccccggggtggcctttttcttccccctaatttttttttttcccccccttggggggaaaaaaatttaattttttttgggtccca

SEQ ID NO: 716397 - DNA, 241 bp, Homo sapiens
aaatttttcccttaaagaaaaaaaatgccctgaaccctttggactgatgagccccagaacttccgttgaaatttttttccctttttagcctgctaaatatacctctgggtttaaatgttctgtttaatggcccttcataaattccagccccccccctggtcagttttgtgtgatagaataaaaatatgttccctccagggtaagtccagccccctgtcaaattcttttccttaaggggccc

SEQ ID NO: 716398 - DNA, 108 bp, Homo sapiens
agtttgttttttaagaagaccagaagggaactggttggggttttttccgtaacaacaagaatttgggtggggatgattatattattaggagaattttttgggggtata

SEQ ID NO: 716399 - DNA, 273 bp, Homo sapiens
  misc_feature (31)..(31): n is a, c, g, or t
  misc_feature (118)..(118): n is a, c, g, or t
  misc_feature (141)..(141): n is a, c, g, or t
  misc_feature (164)..(164): n is a, c, g, or t
  misc_feature (166)..(166): n is a, c, g, or t
  misc_feature (198)..(198): n is a, c, g, or t
  misc_feature (232)..(232): n is a, c, g, or t
ttaacattaaataaagtggatgaagaatttntggaagaagagacagataatgaagaaaactttattgatctcaacgttttaaaggcccagacatatcacttggatatgaacgagactnccaaacaagaagatattttggantccacaacagatgctgcagaatngngcctagaagtggaacgtgtactaccgcaactnaaagtcacgattaggactgacaataaggattggngaatccatgttgaccaaatgcaccagcacagaagtggaatt

SEQ ID NO: 716400 - DNA, 270 bp, Homo sapiens
gggttttgcaggacattttgaacgaaccccctttgcttgaggctcgcacccccccgatgatcaatgatcgtttcaggggaaaaaaacccttggcgaaaagcaaaggtttaaaggcccaattttgctttccctggaactgtgtcattcaggactttgcaaattccctaaagtaggaggaaaaatgcccatgtccaaggaggcagtgcccttcaaggatgtggcagtggttttccctaaggaggagctggggctgttggcccttgccccata

SEQ ID NO: 716401 - DNA, 136 bp, Homo sapiens
gtacagcaggctcgcgtgaaagcactgctggcaggattgcctttcggccggagacttaagagaagcacagacgcgctttgacgaagcggacggcttgctcaaatcgagccatgaccccacggcacatgcgaatctg

SEQ ID NO: 716402 - DNA, 144 bp, Homo sapiens
gagcgaatatcaccaggtttggatgtttgaaaccgcttgccgactgtaggtgttgcgggtctgttcgtcagcgcaagtcaggcgaggatgtctgttttgcagacttgccgtatgttcgtgtatgtgcttccatgcagcgcctgg

SEQ ID NO: 716403 - DNA, 458 bp, Homo sapiens
tctcatagacactctcccgagtgtctgctcgatccgccttccacccttcagcggatgataactctccagactcctcccgagtgtctgctcactcccctaacaccctcagctccagcctcagcggatgataatctcaagacacctcccgagtagctgggattacaggtgcctgccaccacgcctggctaatttaaacgtatttttagtagagaaggggtttcaccatattagccacaatggtctcaatctcctgacctcgtgatccatccgccccgacctcccaaagtgctgggattacaggcgtcaggcaccgtgaccggctcagactgtactcttatagccctctgaaatacgttttctaggtcgagatagattgtgtaagggtacagctgtgaggataacagaaacatggcagattattttaaatcatcctgaaagtggtgctatatctgatgaaa

SEQ ID NO: 716404 - DNA, 391 bp, Homo sapiens
gcctttgattggaaaccaggcgccacctgctgactcccaaagctcacttctttggtcagtttctgtgcctgggacaaggagtctaagagctcccatccatctagttctcaggcaaagttgcacattgactctgcctttgacattggcaagaggagccccttcctttggccccaagcattagagggtcaaaatgacttattcaaacagcatggcctgtctacaggacattcaggcatacacaatagtggctaaattcagacatctttgatattataccaactttctgtcatttaaaacaacagctttacatatattgatacagagtctgaaatttgtatctgacaaaagtgacactaaactcaaaatatctgctcaggtcaataatacaatg

SEQ ID NO: 716405 - DNA, 170 bp, Homo sapiens
tgtattagggagggaggctgaatctgtaaccaagacctaccaggtcagaatctgcattttaacatgattcccgggtgattcctttgacattaaaatggtgacatgcatgacttagagctatctgaatcacagtgcctccagggcctatgcatcctctccctaagacccta

SEQ ID NO: 716406 - DNA, 200 bp, Homo sapiens
gttgcagtgagccgagatcacgccactgcactccagcctgggcaacagtgcaagactcagtctcaaaaaaaaaaggacgattggcagccctgtctacactggccctctctcaggtgcatcataacctattccattcaggcttttgactccagcacttaggggcagttatcttggcatagttccaaaacctccattgccaa

SEQ ID NO: 716407 - DNA, 347 bp, Homo sapiens
tttttttttaggggttttttttttggggggttttttaaaaaaaaattgggggggaacggccccccctttttttttgggggggggccccccgggaaaccccctttggggttttaaggggggggttccccccttttttttaaagggccgggcctcttttggggccggggggtttgttattaaaagggtgtcccggggggttttaacccccccccttttggggggggccggggggggtttttttttttttgggggggggggggggggtttgttttcaaaattggggggtttttttaaaaaagggggggggagggggggcccccccttttaaaaaactttttggcccttta

SEQ ID NO: 716408 - DNA, 552 bp, Homo sapiens
  misc_feature (475)..(475): n is a, c, g, or t
ttagattttttccattttttattaattgaagcacagcgtatagacgtataaagattaaagaaatttttgttttgtagacagggtgttgggtttacatccaccggaaaagaaaagcagttgtaaaaaacttgcgtaaggcggttcttactaaaattttaatggtggggtgagatgatcttaagggtgaagaaataagcctaaggcaggttgacttgcagcagcaggttttttaccgtgcttggctgagcaagactcattatcgtcaggcttgcattagttctctacaaaagctgggaaaccatccataacagttaacagttgctttatggttgccttgggcttgaatttcacgagctcttcaacagcggaaagtggcttgattcggcgctccttctaaaaaagagttcttataagtgcatggaaagcgaattgtccagtagttgacgtctacgggaacgaatggttcatccacttncagacctggaaaacatgggcgccagtttccatagattttgagctggtttagagactctggcacttagtggtgcttgc

SEQ ID NO: 716409 - DNA, 1086 bp, Homo sapiens
gtggcatgatcacagttcactgtagccttgtcctcccaggcacaagcaatcctacccacctcagcctcctgagtagctgggaccacaggcacacaccaccatgctcgtgtcattaaactttatccttcttataacttttgtagagacaaggtctctctatgttgcctaggctgcgtcttaaacctcctgagctcaggttgatcatctatacctacagcctcccaaagtgctgcgcattacacaggcatgagccaatgcaacctggcttgcgacactacatcacatcgggacaaatatcttgtgagcatggagtctcacttctgtcgctcagtgcttggatgtcgcagttggtgccaatcttcggttacaccggagacctaccagccttaccccaagtgtccattgccatatctaccctgcctcagccttcccgaagtacgcttgggacctacaggtgcttccccaaccaaccactgccttggcctaaattatatatatgggtaactctctcaacgtacgaacgacgggggtatccacctgctgtaaaggccaaggaatgggctcttagaatctacattgaaccggcgttgaatcccatccccgcgcctccagtcttcccaagaagtaggcctggggaattcacaacgttgtttgagaccaccaacggcccccggccctgcaaattcaatttttccacaactgtactggctatggataacgcattcaatatggagaactctcaaccatatgggccctcaaatttgcgccagcgttgcaccaacctaccctggtctggtgctcctgggcaacggtcccactcacacgtctcaactaaaaaccaagaacgaacgacacacacaacagaccaccacaaccaactttttaccgccgcccctcatgcccctccgaccaaaactctttcagaacgcagcacttttgtggggcgccgccacacgcactaactagacaccacacggatagcgcgctgctccgaaaggacctccgggtacaatccaagtcgtcaggtgcttccccacaccaacacagcgccggcagtcacacgctgtttataaccacccactgttc

SEQ ID NO: 716410 - DNA, 416 bp, Homo sapiens
  misc_feature (5)..(5): n is a, c, g, or t
  misc_feature (73)..(73): n is a, c, g, or t
  misc_feature (91)..(91): n is a, c, g, or t
  misc_feature (107)..(108): n is a, c, g, or t
  misc_feature (275)..(275): n is a, c, g, or t
atttnatctttaatctgaggccatttcttacataagaaatcttattgctatctggagagactaaagctgtganacagttttatttttcaangtagaaaattctgatnntattacaattcctttgaatattgcttgcaatctcaagagttctctctttagctcatctcatgcttcgccagccttttcagatgcagctaatggaagccaattgtcactttcaaagttcttcctggtaatatccttagccagatctgcaaattcattaggaatatttnctttcagctaactcagatgacaatttgacactgctgcataacacaaatcaactgttttccaatttccaaaggcagtttccttagcacttttcaaggccataaaaaaattgtgttcactactttacaaggtgtaaataacag

SEQ ID NO: 716411 - DNA, 374 bp, Homo sapiens
attggattgctttcacgaatacgaaggcctggaggtagatctacagaacagtcatagctagaatcaatggggacaaagttacagagagagatattctcctcagtttcaagagtgctacaaagagacttagactcccacacaataatagtgggagactttaacaccccaccgtcaatattagatcaatgagaggagaaaattaacaaggatatccaggacttgaactcagctctggaccaaggaagtccagatatgtcaaagatcagataggttgtagatgcctgatgtaatttctgaggcctctgatctgttccattggtctatgtatctgtaaagggaccagtaccatactgttttagttactgtagccttgt

SEQ ID NO: 716412 - DNA, 597 bp, Homo sapiens
  misc_feature (597)..(597): n is a, c, g, or t
cgcggtggctcacgcctgtaatcccagctctcagggaggctaagaggcgggaggatagcttgagcccaggagttcgagacctgcctgggcaatatagcgagaccccgttctccagaaacaaggaaaaaaaaaaaaaaaacaaaagaaacaaaaaaaaaaaaaaaaaaaaaaaaaaaaagagtgtgtgtgtgcggcgcgcgcgccgcgcggccccgcgagaaaagagttttatacaacaaccactacctgcgcgtgtggggcgcgcgcggggcgccacagagagagagtgataagagagaaaagcgggcgcccacaagagcgggttctccaagagagagagaaaccgcgcgggccgagagagataagaggaggcgcggggatttccccacccatatataaaaagagcgcgcgcgggggggcgaaaccgcgagagagcggtcgcgcgagaaataaacctccccaaggagggagaatccagagagaagaggccacaatatcgcggggggcactctatacaacaagaggggagagccccaaaggggagagacggcgagagaatctataaaatattatcgcccccccgcggggggggggacn

SEQ ID NO: 716413 - DNA, 851 bp, Homo sapiens
gctggcagagatttcccacccggtccgggaacccgcgttatggggggatgatttctccccactgtgccccacgccacaggggggttctccctaggcgcgctgtggcggaggacattccttgccagaattggcgtcctggcgtcgagagtcgcacccagagtttggcgctcccctgaccggggtcttttcttctaggcggtgcccaaactggccccacggccccatggttttgggggcgccttcctggggtctccatctctttcggggggagaactgttagagtaccctcgatcgcctgcgccccggttttggggcttttcccctgggccagatcaagactggggcccctgccgatttgagcgcttggcccagtacaaacgccagctctctccagaattgaagaggacgtgggcccaccaggctaaatttccccggccaggaacttctaagaaaccccctggcgccaagtaatactttgggccagggcaagccccttcggtcacccgttggggtacacagacgccctcccctccgggtccagcgtcaggcgagctcgaggcgccccggcccacacttgcaggggtctctgctttgttagcgccccccccccgtggggttctgtgaccgcttccttagaacttttcccggagcccagcgtccctggggccccgttggccagctctaggtttgccgtcgtgtgattggccccagatccttgtttttttcgccccactttccccccaaggtttagagtcatgtggacctcttgtctatttccggggtggccccagggtagatccccggtggttttgttggtccaaattaaaagcctccgtgacccctgggaatta

SEQ ID NO: 716414 - DNA, 199 bp, Homo sapiens
gataaactggtcaaccacggtgggcacaaaacgaggacccagtggcaaaaccagctgaacgcgccagtactaacgtcctagagcgagcctggggcggcgaccaagacggtggagctccataagcaaagctgccgaactaaagcaagatgtctgctcgtggtttggagaccaagggaataaagcaagatctatccacaga

SEQ ID NO: 716415 - DNA, 478 bp, Homo sapiens
tgtgacattatggtgctgaggatgtggatgatgagaaggagtcaggcagccgtgccctggagtgagatacgcgatgcacgaacatgacgagaaatgcccgtgcagtgtacgagagtccagctgacagtgccatgtgtgtgccagagcgtggagaactggacgacagttcaaatcagtccactggaattgatatcaacagacgggagactgacacttgcgtgtccatgtatggttgttttgcatgatcccttccttaagcctcaactagttgtatgcctcggtttcccctggctgcaggatgctcgtcagaagttccagctctgttctatgttgacatggaagggtgaaagtggattgaacttggtcgaggaagatctggcacatgctgtggaagagtccaagaacgtattggtattgcacagattggtggtgaggaggctcagatggaagctcagaaagcatgaggagttccagaggg

SEQ ID NO: 716416 - DNA, 380 bp, Homo sapiens
  misc_feature (93)..(93): n is a, c, g, or t
ggagtgggtgttcccgggggcatttgccgaccggccccttgggtccccaggtttgcagttttcccttgggccactaaccatcttggcccgggntgcctgtttgacccccgtgccaagtggtggctttccattttgtttcctccccgtgtccccaatgttttcagtggggggcccccttttgggtcccctcttttgccatcacctgaagacccccacgccaaacattgaatgtcacctgtgcctgccgcctgggtcccccttggggcccgtgtttgactcaactcagctcctttaacgctaatatttccggcaaaatcccaggcttgggttttgtttttacccttgtaacgcttgcaatcccaataaagcattaaaagtca

SEQ ID NO: 716417 - DNA, 431 bp, Homo sapiens
taccgggagctcggtgtcaacggtcgagaatctgttattaccatggatggaactggatatgggaaccggagtgagtctctggcagtcatatttaaatcctgtcatattgcctaaaagcagtcatatctaggttgtggtccaacagatacttcgattaaattccttggctacatctagtttactttggccttgagagaaatataacagaataccaccagcatcgtgattgcaaatagatggttaccgtggcaacctgacagtttgtaatattagaatcttcgtgttaaatcaaaacttatgaaattggagacctttccctgactgaaaacattatgctgcctcttatagttggaattacactgtgtccaagcagaaaactgtttttctttattaagaaaacaaacactttgtttgctcagtcgaacggactg

SEQ ID NO: 716418 - DNA, 146 bp, Homo sapiens
tatcgcattgaattcgacaatggggttagcaatccggcacttctctggccgcatgaccttacgaggcataataggcgcatctgcatacccagcgtcctgcgcgccgatacgccagcgactcgccgtcggcaatacggtacagcgac

SEQ ID NO: 716419 - DNA, 805 bp, Homo sapiens
  misc_feature (152)..(153): n is a, c, g, or t
  misc_feature (156)..(157): n is a, c, g, or t
  misc_feature (160)..(160): n is a, c, g, or t
  misc_feature (163)..(164): n is a, c, g, or t
  misc_feature (173)..(174): n is a, c, g, or t
  misc_feature (176)..(176): n is a, c, g, or t
  misc_feature (197)..(197): n is a, c, g, or t
  misc_feature (210)..(210): n is a, c, g, or t
  misc_feature (394)..(394): n is a, c, g, or t
  misc_feature (404)..(404): n is a, c, g, or t
  misc_feature (409)..(409): n is a, c, g, or t
  misc_feature (428)..(428): n is a, c, g, or t
  misc_feature (438)..(438): n is a, c, g, or t
  misc_feature (450)..(450): n is a, c, g, or t
  misc_feature (452)..(452): n is a, c, g, or t
  misc_feature (461)..(462): n is a, c, g, or t
  misc_feature (465)..(465): n is a, c, g, or t
  misc_feature (502)..(502): n is a, c, g, or t
  misc_feature (504)..(504): n is a, c, g, or t
  misc_feature (517)..(518): n is a, c, g, or t
  misc_feature (531)..(531): n is a, c, g, or t
  misc_feature (555)..(555): n is a, c, g, or t
  misc_feature (569)..(569): n is a, c, g, or t
  misc_feature (574)..(575): n is a, c, g, or t
  misc_feature (577)..(577): n is a, c, g, or t
  misc_feature (587)..(587): n is a, c, g, or t
  misc_feature (593)..(593): n is a, c, g, or t
  misc_feature (595)..(595): n is a, c, g, or t
  misc_feature (718)..(718): n is a, c, g, or t
ctgtcatgcaccgtggtggagcgctagtacacaggcaatgccagcgcactattgatgctgactgagcaagacaagatggaggatgtgcaagccaagctgctcccagagaccctgtagcgggggagagactctatggagttcagagagatagnnganntcnacnngccaaagtnntncatctcgagggactataaccngaacgacatactnctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcataatcaccctcctttctgcattagtggagacanggaccattgngcgtntcaacaggcccttcctgangatcattgtncctacagacacncngaacatctnnttnatgagcaaagtcaccaatccaagcaagcctagagctngncatcaagcagtgnngctctcagtaggnacttggaatgcgctggatgcctgngtctctgtgcacanactgnncnctgtgcaccnagtggncntggatgtgtggcgctgactgcttatccttgtaaggtgacagagattgcctgtgtagttctcacatgcacagtcgcacatggactcttcagtctgcagtgtcctgcgcctcctgactagaatanattatctagatggactacacaaccggatgtcaattgatcactcgagactagatctctatctgtgttctctatcgcactatgtcgatc

SEQ ID NO: 716420 - DNA, 285 bp, Homo sapiens
  misc_feature (19)..(19): n is a, c, g, or t
  misc_feature (46)..(46): n is a, c, g, or t
gttttatagacaccccccnctcattatgtgatgggtttgcatcctngataaacccattcataagttgaaaatatgatcataagttgaaaatatgatcataagtcaaaaatgtatttaatatacctaacctaccaaacatcatagcttagcctagcctgccttaaacatgctcagaacacttacattagcctacagtgggcaaaactatccaacacaaaatctatattgtaataaagttataaagaattttgaataaaaattcaatatttgaagtacagttaaaaa

SEQ ID NO: 716421 - DNA, 595 bp, Homo sapiens
tgtgctgcctcccgcccgagtactactgtatcttccaaagctgagagttcaaggatataaggctccatgtcactatactactacatatagtatgtctggaaattcctgaggtgaggtggagtcagcaaccaactctccagtgcgagggttcagagactgggactaatgattctcttatactaaaacactcccttaagacgcactactttagctcattggagatgcaggctcagaccgttggagcatgagctctgtgtgtaccgagtaactggggtgatgtttgacttgtcacagcatgggctacacagcagcgtgtcaacaagagtcaatatggtcaccgaggactgaacctctggctagaggacatattcacagagaaacatagagcgtgtaacatatatgataaggcttctgggacttgaaatcaaatgtggggaatggtgcccttggaggcaagctcccatgtgttagatgtttaaaggaccctatatgtggattcctttctttaaactataggtaattaaggcagtgaaagtaaattgcttctagacactgaaggcaatctcctttgtccatttaactggaaccagaatgc

SEQ ID NO: 716422 - DNA, 567 bp, Homo sapiens
  misc_feature (29)..(29): n is a, c, g, or t
  misc_feature (42)..(42): n is a, c, g, or t
  misc_feature (59)..(59): n is a, c, g, or t
  misc_feature (97)..(97): n is a, c, g, or t
  misc_feature (100)..(100): n is a, c, g, or t
  misc_feature (104)..(104): n is a, c, g, or t
  misc_feature (303)..(303): n is a, c, g, or t
  misc_feature (316)..(316): n is a, c, g, or t
ccccccaatgggggcaagtggtcattttngaccgggtcatcncaaccaggaagaaccgnaccagaaccactccggccgatttgtttgcactgtaccnggntacnaatacttcaccttccaggtgctgtcccagtgggaaatttgcctgtccatcgtctcctcctcaaggggccaggtccgacgctccctggggttttgttacaccaccaacaaagggcttttccaggtggtgtcagggggcatggtgcttcaactgcaacagggtgaccaggtttgggtttaaaaaaacccccaaaagggtcncatttaccagggntttgaggccgacagggtttttaacgggttcctcattttcccatttgcctgagccagggaaggaccccctcccccccccccctttttgggttccatgctccgcctgtaaaatgggggggctattgcttcagctgcttaagggagggggctggcttttaaagccccaggactgggtgccccgtgacacatgctttaaaaagctcgttttttagacctcttcctggaataaacatctgggtttgggtttgctga

SEQ ID NO: 716423 - DNA, 762 bp, Homo sapiens
tgtgctgcctcccgcccgagtactactgtatcttccaaagctgagagttcaaggatataaggctccatgtcactatactactacatatagtatgtctggaaattcctgaggtgaggtggagtcagcaaccaactctccagtgcgagggttcagagactgggactaatgattctcttatactaaaacactcccttaagacgcactactttagctcattggagatgcaggctcagaccgttggagcatgagctctgtgtgtaccgagtaactggggtgatgtttgacttgtcacagcatgggctacacagcagcgtgtcaacaagagtcaatatggtcaccgaggactgaacctctggctagaggacatattcacagagaaacatagagcgtgtaacatatatgataaggcttctgggacttgaaatcaaatgtggggaatggtgcccttggaggcaagctcccatgtgttagatgtttaaaggaccctatatgtggattcctttctttaaactataggtaattaaggatggatttcccaaggctaggtgtggtggctcacagctgtaatcccagcactttcagaggctaaggtgggaagattgcttaaccccaggagttcgagaccagcctgggcaacatagcaaaactccatctctacaaaagcttaaaaaaattagctggacatggtggtgagcacctgtagtcacagctacttggcgctgagcaggaggattgcatgagccaaggagttgagcttcatgg

SEQ ID NO: 716424 - DNA, 858 bp, Homo sapiens
cccgccgccgcgcgccgcatcatgagggaaatcgtgcacatgcagtgccggggcagtgcggcaaccaaatcggcgccaagttttgggaggtgatcagacgatgagacacggcaatcgaccccacgggacacctaccacggggacagcgacctgcagctggaacgcatcaaacgatgtactacaatgagtgccaccggaggcaagtacgtgccccgggccgtgacctcgtggatctggagacccggacgaccatggactccgttagcgctcggggcccttacgggcagatcttccggccggacaacttcgtttatcggtcagagtggtgcatgggaacaactgggccaaggggcactaacacagaaggcgcggagcttgcatggactcggatgcatggatgtaggtgagaaaggaggctgagagctgtgacctgcctgacagtggttaccagctgacccaactaccctggggatggaggggactggatacaggggatggaataccctcctacataccagcaaggataccgggagtgaggtacacacagacgaggatcaaagcagcacgtacagggtgggtcgcctacgccccaaagatgtcagaacacaaggggaggaagccctacacagacaacgcgcctcaaaacaccagcatcggagaaaaacaacgacgagacctacggcagtgaaaagaaggacttcgcgaatgagcgaagaaccaaaagtgacaacgcccactatggtgactggaacctccggtggatgcacaagaggggaaacccaggaggccccaagagacaagaagaggagaggaggaagacgaaacgggagaacaggcgaacacgaaaaggaaaaagga

SEQ ID NO: 716425 - DNA, 201 bp, Homo sapiens
ctagaggaacccagtgcgtagggggtacccacgacacttaaaattaatagagctagtatgagtacaaacatatacctatgtctattaggctctagatcggtagtaagccacagtcctaccccctgacaccactttactatacccgtattaacaacatagattatgacttatctaggctatagtaaagccatataaggagta

SEQ ID NO: 716426 - DNA, 368 bp, Homo sapiens
  misc_feature (71)..(71): n is a, c, g, or t
atgctcaaaaggggaagagggatgactgaggggatgtcacccgggattcccctgtgttcatctctgccctngagtggccagtcgaggtttctgggctatgccaggcagtgaggtcatgccagacgctgtagactcacaacattaaatctctgctctcagctgggtctggttgccccgcatctgcgatggtcgtgcctcttgacattctgcactttcagggtcacgtacgtgttgaatctctctgtggcagtgagagtcggggtcagcgctggggctcaaggactctccaatgccccttcccaagctctagaccatctgctgtgatcccctcaggaatttctgggccactcaccccctaaaccagaatc

SEQ ID NO: 716427 - DNA, 317 bp, Homo sapiens
cgattctagatgatcaccggctatcacattatctccacaaagtacataatatatatttaaaaacctcaacacaaccgagcatcttgcaaagggcctcaggacagcaagggtttggccagtcatggaatgaggatggtgcccagagggtctaaagaaggcactatcatgggagcacgtggaccgctattgggctctcacccagctctagttcacagtctgcccatcttagtgtgaggaaagtagggcttgaggtacccttgtttacttttgcgctgggccaagtcctcatccatcgtcctgagatgataatgtgatag

SEQ ID NO: 716428 - DNA, 209 bp, Homo sapiens
gatccatgcaccatccgatcactggctgtctgcttggcaaattgggcagctggactgtagggtcttcacctcatggtccagctttctctgtgttcatgtaggcctggtgccactacccacagttgaggtgatccacctaaagcttcttgtcaggcatggtctgctgcagatgactcgccgtctctgcctcctacttttccttgcatgct

SEQ ID NO: 716429 - DNA, 275 bp, Homo sapiens
tgtgtattagagatccggtggttcctgcagagagaagcgaactagtgaaatgcaagaatagctgtctgaatctaagggcacttttatggggagcaggtggattatataaaagtatatcaaaactgcttggattacttagcagcaagggcaagtctccaaaaagcctagggaaatgaaaggaaagaaaagcaaaaagatttctctgaaatatacagcagcaagactacatgaaaaaggagttcttctggaaattgaggatctgcaatgaacccacg

SEQ ID NO: 716430 - DNA, 1330 bp, Homo sapiens
gtcctcaggatttcagagcactcacacgattgagctgggactgtagaatcagaactatgccgtctatacatgctctcggtgagggccatcctccttgcttggtgcaatagcctgtgctgactctggttcccatgatcttccgcgtggctgagcgatcgcccagggcagagtagtcttgccacaagaaagaccaggcatacatctccaccctatgatcaaggatcagaccataatcttcagtcaaaatgatcagccaccgcaaatgttgtgcattgacgctttcagccattcagagccctaatatcctaggacacgactaggccatcatcgctatagtctctaaaccatcgccactccatagatagtcgtgttctctcttcacgctcgatgtgtagccgactcgccgatagcaatgtcccgttatttgccacaattggcatatcttctcccctgggtgggatcccagagggcgcctgggtagcaacggatccaacagaatgggacataatcgcgttgtgtacgggggtcccattgcacagtttttgcatcacacccttcttacgcggcggcagaaacttttctcggtggaagggcgtcttcccaagaaagtttaccgcttatgcaacacgccgctttccgcaagtttgtgaaaaacgtacgctgttccacgtgttgaaccacctttgcagaaaacctatgatccaaggtaatctacggtacacaagttctttcccacggactttggagcaccaattccccgtgttcacaagagttgggacaccgtagctttcccccttcaagtcccagcaacgggcagacacctttgtaaggatgtcttaatgtttggagaacattagaacgaatatggtacgtagggacacgctggagatggtttcatggcgcacaacgttatgcttagcccatcattcccagctagagcgcgcgctgttcacacatttgctttcaaacactgtcttcccgctggtgcatccaacccagtatgatgcacgggtcccctatacgaagaatcccacgccacattccagcgccggcatgatatacactgcctcgcgcgtaggaacaaccggcggcgttacccgtccaacttgaggggcaagcacactctggccaggagactcactgcgctccaaagcgcggacaccgttgcgagcacagtacacatgcccatgagagctattcatcggcgttccttgtggcttgcgaaccgtttcagccagttccctcgccgctgtcaacaaacacgagtcccgacgcctgtgcaacgacagcaaccccacatatcgtggacaaagcgtccgacggggtacca

SEQ ID NO: 716431 - DNA, 511 bp, Homo sapiens
gacgtggttttgaactagtagagagctgatagcagagataggtgatggattgggataatctgatgtgtccgtcattaattttactcatgaagggggacatgggccgaggcaagataagcaaggagaagagtttcttggaccttgtggttgagtaggagaaactaaatctggtggccccagatcaactggatttattagaaaaatgcctaaagaacatccacagaatagacctgaagacaaaaatccagaggtacaagcagtctgttcaaggagcagggacaagttacaggaatgttccccaagcagcaatccaaaagagtctcaaggatccttcaaataacttcaggatgataacaccctatgcccatggtcctgatctgaaaattcttggaaatggttccatgtgattaacatggaactgcctctacttaatcattctgaatgattaaatcgtttcattttctaaatgtgttataatgtaggtattagaggaaggaggaatgatgaaaca

SEQ ID NO: 716432 - DNA, 369 bp, Homo sapiens
atgtcatagctgcttcctgaggataaaactacttcagggaaagccgtaatcttggccgtgcttattcctgcccttaaaaaaggggacagtgaagacagctagaggcctcagagagctttgggcctggaaaagaagagcaggaggagcaggaggaagaatattaagaggagccggaggaggactatgacgaggaggaggaagagtccagtgaagatcagcactggtctgacagcccgtcggatgctgacagagagctgcgtttgccgtgcccagctgagggggaagcagagctggagctgagggtgtcggaagatgaggagaagctgcccgcctcaccgaagcaccaagagagaggtccctctcaagctt

SEQ ID NO: 716433 - DNA, 396 bp, Homo sapiens
tcgcagcagaaagaccagcgaaccttacttatcaacactccctacatatgtcaccttatgcagctaacgtcaacactggttacattcagcgatatagaatgctgcatgtacctatcagtggagagccagacgccaacctggatgtacgcaagcagcactcgcttcagtagcttaagcccggttgccaacgccggacagctcccaggccagcaaggcccactcggcaggacaaggctctcggtccacaagctgcatcatccatccagcgccagcgtcgaaggcgcgcacgcgtggtccaaggcgcgccaggcgtcacgggccctactcgcgagcgccaacggcgagtccggaaacagcgcgagtccggtaagggacagcttccgctgcacatcaggc

SEQ ID NO: 716434 - DNA, 966 bp, Homo sapiens
tggcccctgtgggcatttgagtttgcgacccctgtgttaaaccaataaacatgcaaataaatgtaaaaaaaaaaaaaaaaaaaaaaaaaaaaaaaaaaaaaaaaaaaaaaaaaaaaaaaaaaaaggggcaaaaaccccctcggttttttttattttaagggttttgggaaaatggtgacacgaagcagggggggcctctactaagacgtcgaagtgtggtgcgtctccccttttttttccccccctttttaaacccccgggggttctcttttatcagaatttttttcacttcaggaaaaaaaataatccctttaccacatttttatttctctctttttggcaaaaagaactcttttttaacacaacaaacttttacgtatggcccagtatcgttggccccacatcctttggaaaaattttccccttttgtaagagcgaacccttgtgggtttcaccacctcgtggggcagggcggcacactattatattttccccctatcaatacttttatatattcttctcccgagaaagggggggctactaacaacaacatttttaacatggaacttctctgtattatatcccggccaaagggacccttttggtgcttccaaatggggaatcacttggagcaactttctgacaaaaaaatcccagttctcctcttcttctaagccttgtggttggcaggggtaccccctgttgtggcgccgctaccccatgcgccggttgtgtttgacaacgcgcgtttttggtatcaaacccccccgggggtggccatcagaaagctctgcgtctccccacagacccgtgctcgggtcatcttcccatgggcctggtcttcccgtggcccaagggagtgtgacagccctgtacatgggctcggggacacccgtttcggcgcgccctgcggtgggccccggccttgccgtaggatctcccgttcgacgctggaccctgttctga

SEQ ID NO: 716435 - DNA, 167 bp, Homo sapiens
atggagacccaaggctgagggagggaggaagggaggaagaaaggaagggagggaaggcagaagggaaggcagggcagggcaaagcaataaagcagcagcagcagcaaaaagcagtgggcagcagaagtcagggcaggggcagcagcaagtcagggcaaggcaaggca

SEQ ID NO: 716436 - DNA, 767 bp, Homo sapiens
  misc_feature (212)..(212): n is a, c, g, or t
gatacatatatataaatcgatatcgtgtactgtctgtacccggtcgtgattttctacattatgataatagtctcgtccagggtagtgtcaactcatggtgtcttgccatagtgactagatttcgtacctatattaatatagcgtcgacagtaggtactccagtatgctgtactagtgatccaattctcgcatgatcctattcgatcgtcctntgactgggtcatctataggattgggtagctataagctgtggctagtatatgaatatatagcgtacagtgacaggtgggagtgcaagatgcctttttgatgtactgatttcatttcctttgggtaaatacccagtagtgggattgctggatcatatgctagttctatttttaatattttgaagaacctccatactgtttgccttaatggggatactaatttacatttcctccaatagcatacaaaagctttttttttctccgcatccttgccaacacttaccttctgtctttttttttttttcccaaaaaagggccaaaaaaagctaatcttgggcttgaggggaagtggccatttaccgggtatgagggtgacggaggggaaatttacagtgggggaattaggagagtacacatttgcttaaggaattcgggatgttgaaccattgttttcaatataccgtggttggggccattggcgtggctctcttttgggaaaagtctaatacgaggtctttagaccatgtttttgttttgttatagtgtgagaaaagtttt

SEQ ID NO: 716437 - DNA, 389 bp, Homo sapiens
  misc_feature (355)..(355): n is a, c, g, or t
tttgagacaaggtcacccaggatagagtgcagtgatgcaatcatggctcgctgaagcctcgacctcctgggctcaagtcatcctccgatctcagccttctgtgtagctaggactacaggcctgtgccaccatgtctcgctattttttttggtattttttatagagatggcagggtctcaccatgttgtccaggctggtcttgaactcctgggctcaagtgatcctcctgcctcagcctcccaaagttctgggactacaagcatgagccactgtgcccagccaagaagtaaatatttctttcttttttaaaattatctcatggcaacagatggaaagaagtatatattttctttantctgcactttgtaggttgaaaggaaaccaaggtt

SEQ ID NO: 716438 - DNA, 445 bp, Homo sapiens
gccaaagatgctatcaaagtaggtttttctcagttctttgacctgtgttcagaaagcatctttcattttataacatggtattacatattctaaaatgatctaaaaacaaattaatatatatgtttgttttcttatttttttgctttttttaagctataattatgtttgtgcacaagctacataaactagagaaaaattactttgactgtatacatttctgtgtttagattaagtataatttgtataaaatctatacatagtatggattttaaagtggtgtgtcatgagttttttttgcttgtttgtttgtttgtttaatcaaaatcatataaccaaagtgatccttccttagtcttcatgagtaaacatagaatcaccagctggggcagccagactggccttttgaggccaccatggctttgatgtttgtggatcaaaaaaaaaa

SEQ ID NO: 716439 - DNA, 266 bp, Homo sapiens
atgtcccaaatctggggaaggaagggggcatgcagatttggaaagcccagtgaatcctgaataagaagaatccaaagtaatcaacatggagacacattataagcaaattgtcaaatgtcaaagacaaggagtaaattttaagaacagcaaggggaaagggacttctcatgtacaagaaaatctcaatagtattaatggattttgcagcaaagatctcacagtccagaagtgagtgggatcaatgtgctgaaattaagaaaaaaaaa

SEQ ID NO: 716440 - DNA, 986 bp, Homo sapiens
aagggattgaaaatacagccttgggtcacatcaggaagaagcaagttaatcaattcatgcaatttcttcatggaagccatgaatgtcttcagtggcacagatagattgaggaaaatcgtctctctcatggcaatagggacaattaatgggacatatgttgtcttgtgttcggctggggcgctcttagaccgtccaagtgtgcggagcacatgggttgtgcgtggaatccgtcttctcgtacgcctcgtatggcatatattgggacactttcgactgctgttcagtgagaatacccacaataattaagccacggtgtaacgtgcatgtaacatctaggataggttctacgactggatgaataacgtgtatgaaagctgtaggagggggccgctattatgtactcaacaccaagatcagttgcactaggtctcgtcgctagcttaaatgccttggatataggatgacgcttatattgctgagattctatagcagattgaggattagagttgccgctccctgctaaaacttttgtaggtaataggaatgtcagagtgattaacacattgatgagaatcataaggaaagatagagacactatcaatagcataaaggagagatggggggaacagaagttacagaaatttaaaaatcatcaaaagtggatcacacttattcagaaaattagaacataggtggatcggcaaggtgaatctggccctaccttcattccaggatgcggcagaggaaacagagcatggaacttatggaaagagggtcagaagacaggaataattctagtgaccacggtttaccataatgtctggcaacatgaagtccctgcaagaaggattaagaaccctgcagcagggattgaaggtcacgaagacgcgtggttaaatttattcaagaatgggtgaaacgacgtgagtcctagattcggaaggccagattctgcggcctacaacaatcacgagtcactcctctag

SEQ ID NO: 716441 - DNA, 99 bp, Homo sapiens
cactgtgtacggacagtcatgactcctaccagacactttcaataccaaggtgcaaagagtgagtgactatccatagcagcagcaaatcttgaacattct

SEQ ID NO: 716442 - DNA, 131 bp, Homo sapiens
ctcccaagaatgagaaattgagggatccgtgaagtaagaaacagtaacaaataaggtttgtagcagtgatgtatagagttagaaatatgcagttcctcatccttgggacgtggtacctgagctcgaattac

SEQ ID NO: 716443 - DNA, 2047 bp, Homo sapiens
  misc_feature (86)..(86): n is a, c, g, or t
  misc_feature (123)..(123): n is a, c, g, or t
  misc_feature (133)..(133): n is a, c, g, or t
  misc_feature (136)..(136): n is a, c, g, or t
ccctggtggggtgacacgccgtgagaaatcagtttgtgggcgagcacggctgtggctcagacccctgctccgggggtctcagcatncatttcgcagtgtgtctcctctccttaagcctggcanacactcggantcntctgcaccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcggagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctgaaggaggcagacactcccaagtgtgaagagaaggaaaggaggaagagggagttgcgcagctcggccacaggaaggtcttgccgaggggcatctgagcagaggctgggggacgcgccaagctgccgtgtggtggtgcacggcgttcaggcctgcaggatggagggagtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgcctcccagagggaggaaaagcccctgggggcttctggctccctgagattgggctctgagacgagacgggttcccaaggccctggtggggctggagtctcacctgtttgcatggagaaatgggctggccccacagcctcacaggagcagtttgtgggctggtttccccgggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttctaaaaaaaaaaa

SEQ ID NO: 716444 - DNA, 544 bp, Homo sapiens
  misc_feature (322)..(322): n is a, c, g, or t
gaatttgagctcgggtacccccaataacctccgtgggcgcgcgcatcaagcagcggcttgcgaacaaccacagtcttgacctgtggcaggcgcgctgggaacaagcgccgtgcttccagcacattgatcccaaccatcagccagaacagcgcgaccatcacgacggcaaaactgaagtagtggtcaaataacccactgaccagcgccgacagaattcctgccgtgctgcccagccacagggcattgtccttggtcaggcggatcgggcctttttccggcctggcttcacgccaccaacgcaccgtaacggctataaagagcngcatgccgacgatgccggtcttgtagataaagttcagccacaggttggagatccccagcaagtgtgtgcccggtaccggagggtcaaccttgaagccaatgccgaacggatacgccaccatggcctgggggaacatgcggtattcatcaaaacgaacttcggtgctggcgttgctcgacgaaaagatcgtcgccaggcgttcctgcagcggtggggaggggt

SEQ ID NO: 716445 - DNA, 1739 bp, Homo sapiens
tgtgtgtctgattgctccactcacgggccattctgccatctcgccctttctccttgggcctccccagtcccggtgacacaacactatagaaattaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctgaaggaggcagacactcccaagtgtgaagagaaggaaaggaggaagagggagttgcgcagctcggccacaggaaggtcttgccgaggggcatctgagcagaggctgggggacgcgccaagctgccgtgtggtggtgcacggcgttcaggcctgcaggatggagggagtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgcctcccagagggaggaaaagcccctgggggcttctggctccctgagattgggctctgagacgagacgggttcccaaggccctggtggggctggagtctcacctgtttgcatggagaaatgggctggccccacagcctcacaggagcagtttgtgggctggtttccccgggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttctaaaaaaaaaaa

SEQ ID NO: 716446 - DNA, 169 bp, Homo sapiens
  misc_feature (90)..(90): n is a, c, g, or t
ggagccgaagactgttgtgaaactggggctgcttgaagggaagctcttttactccccattcctgtcctccggatggcccccttttccctngcgtgtattgatgtcaacctgggtaagtggctggtggactcacccctgctccccgggcgggcgcggttccccgggcggg

SEQ ID NO: 716447 - DNA, 6160 bp, Homo sapiens
ccccgccgggcgccggcgccaattggagcgcctcggggggcgggggaggggcggagcgcgcctcttgatggacggcggcatttccggctctcgcgagtctgggtgggagcgcgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttcccagccgcatcgagtgtccactcatctaccacctggacgtgggggccatgtaccccaacatcatcctgaccaaccgcctgcagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacatccatcagcacagcaaagcgcctggccgagttcctgggagaccagatggtcaaggatgcagggctgagttgccgctacatcatctcccgcaagcccgagggctcccctgtcacggagagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggtgccaccctctctgggaaggagtgttactaatagaaggctcttatccttggcccttaatttggaaagctaaggtctaagacagggtccattgggcttcccttagtcttaatggcagagccagagaccactgtgtggcgagttttccatagtctattgtctttaccactgtgggggtccggcctggtccctggcgactgttcagtgtactgcctctgacctccctgtggccagaggtacttcacacagagtctttctaaccagggccacttttcgatgtgaccaaaggtacatcacagggatctccagccagctctactgagtatgatgtgtgaggcatcagcacttaggtgtcaggagctgtcggtctgctgcagagggcgtggttgagggtcaggagccatcagtctgcggagagcatggttgagggcagctactcgcattacccaccagcggtggttcatgctgggcaatgcttgctgtgtaccaggaggtgggccgagcacttcgcattctgcctctgtccccacatcagcccagggacggggagcggttattgtctgtttttcagataaggaaactgagtcagagagcggcgacagcagagagggcggagcaggtaccgaca

SEQ ID NO: 716448 - DNA, 911 bp, Homo sapiens
taaagacatacctgagactgagaaatttaccaaataaagaggtgtactggacttacagttccacatggctggggaggcctcacaatcatggtggaaggcaagaaggagcaagtcatgtcttacatggatggcagctggcaaagagaaagcttgtacagggagactcccgttttgaaaaccatcagatcttgtgagactcattcactattacaagaacagtgcaggaaagatgcacccctgtacttcaatcacctcccagcaggttcctcccacgacatgtgggaatgtgggagttacaattcaagatgagattggttggggacacagccaaaccatatcactactcttgtgcttggggccattatgaagtaaaacaagcattatttgaatacaagaactgcaataccaccacagtagatctgataactgttggctactaagtgactaaggggcaggtgaagtatacagcgtggatgcgatggacaaaggggaagatctacctcccagctgggatggagcaggacgatgcaagatttcatcacactactcagaaaggcatgcagtttaaagctcgtaaattatttcaggaattttccatttaatattctcaggctgtggctgaccgtgagtaacaaacccaggaagcgaaactggagaacagtggatgggagacgggtgaattactgtatactcatgagggatattagtccatagttcttttttcctttaacaattttgggttggtatagttgactgattggaatcgggaatatagtcataaatgatgggagcgttctctgttctaaagatatggatggcttttttaatggtgaaatttataaacctttgtggaaaaaagaaaaggggggaaaatcagggaaagacatttgaagggtagggaaagggggaaa

SEQ ID NO: 716449 - DNA, 2081 bp, Homo sapiens
ccccgccgggcgccggcgccaattggagcgcctcggggggcgggggaggggcggagcgcgcctcttgatggacggcggcatttccggctctcgcgagtctgggtgggagcgcgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttccaatcccattggggggcccctttttataccttggagacggggggcatctagccccacaacttccttgttaaccaccggatggcatt

SEQ ID NO: 716450 - DNA, 122 bp, Homo sapiens
aagtcaattcttataccagctcctcatgattctgcttagggtcccaacagacacagagggccatggggccctctccatttctccacatcagcagaagtccaggttcccatgcagactttctg

SEQ ID NO: 716451 - DNA, 2138 bp, Homo sapiens
  misc_feature (1949)..(1949): n is a, c, g, or t
  misc_feature (2071)..(2071): n is a, c, g, or t
  misc_feature (2077)..(2077): n is a, c, g, or t
ccccgccgggcgccggcgccaattggagcgcctcggggggcgggggaggggcggagcgcgcctcttgatggacggcggcatttccggctctcgcgagtctgggtgggagcgcgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatggtgtgcttcttccctgggattcagattcttcccactcttgtgctgtggtaggacccagaagctgcaggggctgtaataaagccccttctccccatcctgtcccacggnccctcaccgggtgtggcttctctggcccagcaccccccgggggcttctttagggcagtgcactgcagattgtgcacatgagtccttctggagctttctcgggcacaacctgccacgtgccgncacagngtcaaacctgaggcaggctagtgtgggtgtgtttcccctctgatgccacatcgaaggtacc

SEQ ID NO: 716452 - DNA, 214 bp, Homo sapiens
ttactgatcatatggtctgggtgctcatagaatggttcattcaatcaggcatcggttggtccaaccagttttacattaaaaaaaaacggggatataaaagtggatatttaattaatggtgggggatgacgtggaggatattctctagtactggatccacaagagaaatctctcaggagtcagtctcagtatggctcagggcggggtacggagct

SEQ ID NO: 716453 - DNA, 1097 bp, Homo sapiens
ccccgccgggcgccggcgccaattggagcgcctcggggggcgggggaggggcggagcgcgcctcttgatggacggcggcatttccggctctcgcgagtctgggtgggagcgcgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgtaagttttgcttgtgttaccttcatcctaaaatttccagttttctggagagaatattcttcagtgctggagagtgaatctgactcaaagatatgtttgctgcttttcccccaaatactttattaaaggaaatatggagtt

SEQ ID NO: 716454 - DNA, 365 bp, Homo sapiens
attcgcggccgcgtcgacctggggacagtggctcatgcttataatcttaccgctttgggaggctgaggtgggtggatctcttgagcccaggagttcgagaccagcctgcgcaacatggtgaaacctcatctctgcaaaaagatgcaaaaatcagctgggcatggtggcttgtaccttggtccccgctgcttgggaggctgaggtgagaggatcatctcatcccaggagatcagggctgcagtgagctgtgatcatgccactgtactccatcctgagctacagagtgagaccctgcctcaaaataattagattagtttataatggttgacgcgggccgcgaatttaatagtagttagtctgccccg

SEQ ID NO: 716455 - DNA, 426 bp, Homo sapiens
ggtggacctgatatagatgagttatgtttctttttactatcataaaaaaacagctcgtcccccctagaagggggcccaaaactttaggggggaaagcaaatatacctttccctaaacgctcaggtaaaggcccagggttggccacttttctttttaagaatttaaaggtaaatttttaaaactagattccccaaaacccaattttccaaggtaatatgccttaaattacttacccgggggggtgcctaaccttgggaaccacctaaaaaatattggattgcccactttaaaggggataaatttgggccgggcgccggggcccacccccggaatcccgggtatttggggggactggaacaggaaaatcccttcaacccgggaggggggggttgcaagaagtcaaaaaggccccactgggccccagcc

SEQ ID NO: 716456 - DNA, 1706 bp, Homo sapiens
ttcaccgtctgttgtgtgggaggcatgctaggtttgttgctggtcgcgccacaggagtggtgttcgtctcgcaggcttctcgtgttgggtgggctcacatgccgctcttggtagaggagtatgtgggttgtcggggtgttcagccgcgcagagtggcgccttgtttattgatggtatgaagggaggccgcttcgtttttcgcagggggcgttcacgcccgttgtttttggtgcgtccgcccctcttgtcggccgcccacgttgtgttgggaagaggcgcccaccatctcttcttcggggggggtttcaccatctatatggtgtagctttggctcccccacgcgagtggtccgtgctgatagcaccgattttgtggcgccgcgctatcatttggtgtagatataatataagcgccgcggctgttgtatccacccgctgcattttgtggttggaagaagcgccccgccccggggggtgcgacgggtaggcgccgactttgtgggctgcttatccccccccctgttggccctttggggggcacgttgttgtgcccccctctttgtaggcggcgacacgtattttttttgatgaacaccacagcggggtgctgcaacagtgtggcgccgtcttttggggggcgtcagtacgtctgtaggcggcgcctgttgttgatagtttcggggccgtcagccactggggggcagcaagagaggttgtgtggttacacataattctagtggcgcacaacagttgatggtgcccccctcttcgtggtagttggtgagtaccaccaccgagccgcccgaccttttggtggtgttaattatgccgcggcagaacagctccccccctcttcggagtatgagtggtttttttaatcaccgcggcgggggcggcagcaaccgcgggataatcattttgttgttgtcagccagaaagatgttggtcggcggccccccacccccggcggggggcgtatttataaaccacatctcctctccgcatctgttatacatattttttttgttgtcggcgccttatgaggcagcacaaagctttcacacagatcttttgcgcgtagtacgcccgcagcgtcttttcaacacacgcgttgtggcgcaccttatcatatattagatcctcgtctcttcttctctcacaagggggagcttttcacaaaacttttatatctctcgcaccgctatatatatagcctctttttgaagagagaggactcttttttgtccacagcactctttcgcgcattaaccctctcgcctcttctatacaccccccccctctctgttatacaccccctctctcgggagagaaaactctttgttctttgtgtgttatgtggaacacacacacgtgtttttctctctgagtgcacacatattatcacacttcttctctcatacttacacacgcgagtactctctcacacactcttattattgtcacacacgccccttataaactctccctctctacacataaattttaccacaccacacacacaccaatggggcgtccacatccacaccccaccaccattgacacacacacattataacaccctctattctcacaccggaggaaaacacacccctctatggttctaaacacacactttctcccccattttctcctctccttatctccctcttacccccgacacatctcatttcccggtttttcttttta

SEQ ID NO: 716457 - DNA, 546 bp, Homo sapiens
gcggtattctagaggatcccatatttctagcagaacaagattcaatagtgtgccatagtgcaatctttatcagcaagagacattgaaattaccagaaaataaatcatagtaatcatactctgtcacttaatctcagatttaattctcaagaaaagccatgcaaaagaagctaacacaagcccgcaaggcttgctatctgagtctgtttgggtgacattctagatgtggctccggaatcatgcagggcgaggaaactagatgtcgcgggagcccggcgctctgtatccagggagaggactgacagcaggggctgtgagtgaattcaggatggagaatgttctccgtcttcacggactaggattctgtgggctgaagaagcacatccgaggtagagaaccaaggaccagagagaaaacctaactggtcaaggtcacgtaaaattcaccaggaaacactatatattctaactgaataatactagatctgggtcaaatagaacttcaagagatttggctacacaacagcattaaaacttaggtcctacta

SEQ ID NO: 716458 - DNA, 1370 bp, Homo sapiens
  misc_feature (166)..(166): n is a, c, g, or t
  misc_feature (189)..(189): n is a, c, g, or t
  misc_feature (232)..(232): n is a, c, g, or t
aaaccggatcacatatctacttgatttaaacgatgttatgcatggagctgttacgttatctatcactcttgaaatccataattccatgtgcgtaacgtgtttggagtgatagtgtaacgaatatcttagtcacgagcatgtccgctaaatgagtaggaggatcatntgtcaggtcggggaccacatgantttattgtttgacatcattggtatcagacactggttgtaactncttggctaggtgagaagtaatctgtagagcgttggaagcacccatcttctatctgatgacttgaatgtttcagcgcaggagcgttgagagcactggctgctttacatgtctaggctactgctgtctgtggtggtagctttagggtccaaaggtaccttcgtcgtttacagaaacataggttaatagattagggaccataggttagttattcttaataaatgcaacttaagacttttttggaaggtggcttgtagggagattatcatctttaggtttgttaccaaataaatattctctattgtatatggtaggggatggttaaaaacttatcgttgatacttccatgtgggtttattattctttgtataatggaatacggaaaagaccctttgggttggttatctaaataaggcggttatccaaattttttagtggttgaagttaggaaccacggaacttaacactgtgaggtacggaagaatttgatggattaggaatcctatttactttcttaccttagatgcgaatgaatacttaacatccggcttaataaaattcgaagtagaacacttaattgttccacggatttggtgtcacgagacaaccttgctttacaaatttaccttccaaaaggtaagggatagatttgccccccatgtattctatccagtcggcaatagaatcccaaattgattaggtcacaattccacaccgaatgacgtttttgtttcatacccatctttgtgcctaaatttaaatagggctgggttgcaagcttcacacatctgtttggccacatccctttggttaaaccttccatgtgtggagccactggtctttgcaggattactcttaagcggaattccctaataatttcctacaccctggaagagaaaaccctaattctaaccagccttcacagtttgagcgtttcaacaggcgggggcttctcaactccacctcccaaacgctcggtacaccgtaaccacgcagcgaccccatcagccctggtgctctacaagaacccggtcgcacacttccaccttggcgcaacacaagagcggcgggctcctttcaggacacctctgtgcgagaacacagtgcaccagcacaccgaaacccgtgcctcacgcacacg

SEQ ID NO: 716459 - DNA, 184 bp, Homo sapiens
ttgagtagtacgaatgcaggtattaattatgataatctagtagttaaattaagaatggttatgttcgggttgtacggtacaactgctattattcatcctgtgtgagttttttatgcgaaagctaagattttgcgtagctgggtttggtttaatccacctcaactgcctgcaatcaagcctggaa

SEQ ID NO: 716460 - DNA, 747 bp, Homo sapiens
  misc_feature (747)..(747): n is a, c, g, or t
gactcggcactctgaacgcggaacaaggtgccggccgacaccgaggtggttgtgctccccctatcttgcctatatcgacttcgtccggaggaagctagataccaagatttgctgttggactgccgggccagaggcttgctacaagggtgcctaatgggggctttaactgggggggaggattaaagcagccgtgggagagtgaatccagagagggagctgccggagacctgctggtggttagtgtagtcgtggggagcacttcaggaagaggaaccgcgcactggtcgattttgtggggaggtgaagaatgcaggcttgcttgggggcccgaaaatggtgggcctcccaattggctttttgggcaggaagggggacccctcccgggcagaatcaaattccagcacgctggccattatggggagtgaccggaaacgacctaaaagaacttcgggaccagccggtgggcacaagtgcctttgcggtcccagttccccaacgttaggaccgcaaaaccagaggtctctaggttagatgcgccccagaatacggcggaacggaccatatcaaaacaggtggcttcacatttcttacaccacgaaacgctacaaatcgtggggtacacaacggtggcacgcattggagacacagtcccacaaagtgtggctccaggctacccccttcgggagaccctatacggatggaggcccccattggtgggtagagggagacgccagcgccggagttacn

SEQ ID NO: 716461 - DNA, 111 bp, Homo sapiens
acgctgcatctgtcttctcttgcagaatgtgtgtcaggacaaggaaaagacccacaattagttatcaacaaggttttatttatttatttatgttttattattattattatt

SEQ ID NO: 716462 - DNA, 341 bp, Homo sapiens
tgaatgcaatccgtagtgtagtaatctcaaaattttcttcatgaagccgggcagtagatgttccgtgctgtttctccatctggtggtggttggtccgaatcccagggcgactgaaacatctccttcatttgagtaggggtagcagtggtggcaagaatctatatcctgaggctttactccatttaataaatccctcactgctcctcctgctattcttaattcgtgattctctttgacaaataattctgagatgagagagaataagatttttattcccaagttctttatttcaatgtgtttattttaaccacaaaagtacaaggcttttccatctagtcgga

SEQ ID NO: 716463 - DNA, 539 bp, Homo sapiens
  misc_feature (85)..(85): n is a, c, g, or t
  misc_feature (89)..(89): n is a, c, g, or t
  misc_feature (124)..(124): n is a, c, g, or t
  misc_feature (136)..(136): n is a, c, g, or t
  misc_feature (171)..(171): n is a, c, g, or t
  misc_feature (185)..(185): n is a, c, g, or t
  misc_feature (278)..(278): n is a, c, g, or t
  misc_feature (372)..(372): n is a, c, g, or t
  misc_feature (396)..(396): n is a, c, g, or t
  misc_feature (473)..(473): n is a, c, g, or t
  misc_feature (537)..(537): n is a, c, g, or t
aagacagaagtggaaaagaaaaaggacaataaaaggaagactagaaagaaatggatatgacaagaacaggaacaagacagactancagnaaaacaaaagacaaacaacagggacagacagaagnaagacctttgtnaaatgcacattgacgagtcgtccccaggacactgnagatgggaaacgantggacccggactgtgtgactttaaccccaagtctagacaagcaggaccaaagatgtctcccgcatgacgcttcagtcctcatctccctcaagncaggccccgctggtgcactgaagagccaccctgtggaaaacactacatctgcaatatcttaatcctacttcagtgaagctcttcacagtcattngattaattatgttgagttcttttngaccaaacctatttgtctttagagttgttcattgtttgtgattgcatgtttccttcttcaactgtgttcttcctggnatttagagaggagggagaggagggagagggaggggagggaagttccaagagtagctaacctgtnct

SEQ ID NO: 716464 - DNA, 1005 bp, Homo sapiens
  misc_feature (271)..(271): n is a, c, g, or t
  misc_feature (391)..(391): n is a, c, g, or t
  misc_feature (395)..(395): n is a, c, g, or t
tgcaaaagctccgactcgtgcatcaatctgaacgcgaatctagagcgactttaattaagctaagcccttactaggaccaatggtgacttaagagcccacataagcgacttagttaacgagcgtaagcaccctaatcgaactggcattcgaatcatacttcatccgcgctctgaccgcggaagacaacaggctgggcagaagctcccaggcaaggattgtgaagcgtgcttcttacgaattatgccaattcgaataatgaccacatcacccntcggagcctaggtaaagacagcagggccataatgccctgatcttgtaggactttacgagaatccgaagtggcgttgcacgtgcagggccgcagtatttagccgtgctaccccccatttgnatgntgtcggcgcggaccggtgtggaactgattgcatctgacaataggcactaatagaccattgaggtaaccatgtattagcctgatctcattcggcgtcgccattgacgcctgggagcttcccttaggaccacgaagctcgtgacatgccgtccgtttgattccggaggcgcagatggcgtgtgggcctagtcgcgaagggcagatccgttgtccctaggcgtacatccggaacaccaaacaattcgttaacaaaaccgctgtaattgccggttctaactagcgcgcgaatgccaatttgtgttacatgtatacgtgcctttacctttcccagttaacgttaaagttaacccgcaagttctacttaaacttcggggaagtggcctttcttggggcaaaaccgttgaatcctaagttttcccccctcgtgaaagtaacaacttctggggctagaacgcacccgcggaattaatttgtgggcagtttattcgccccccggcgcaattgtaaacaaccatatggattgaaagcccttttccttggaaccctccctttaaacccgtttccccatgcgtacgtacccttaaccttcccttgccttccggccaattctg

SEQ ID NO: 716465 - DNA, 692 bp, Homo sapiens
tagatagtaacagacgcaggcaaagggaatcttgacacccgatggagaaagtggagctctactccccaactcccttacccaacagctcagaaagtgcggcacaggtccttccagagacagggtgaaggcagagtccagagcaggatggctggaagtcaagttagtaagcaatccataccacagctccccttgcgcagatggtgactacatctccccgaatttgacaggaaacaggaggttagtctctgaaatgaggtaaaacagaggggtacctggcatggcccaggacagagttaactacaggttgagtaacccttatctgaaatgcttgggaccaaaagtgtattagattctgaatatatacagatttcagaatttaagcattataacttacaggttacacatccctaatcccacaatacaaagtccagaatgctctgataaacatatacttagagagtcatgtcagcgctcacaagatacagataagggagcaattaaggattaacgattagaggattaggcctactcaatctgtacatggacaccgggggaataacgacaaggatgacatttacctgtacgggcttctttcctcttctacgctcgcagaacatggaaactgattgagtccttccccggtagtgatggaaatggatcgacgatctgcccgccagaaacagagtaagtcg

SEQ ID NO: 716466 - DNA, 113 bp, Homo sapiens
tttgccgcattccttttcactttttttcaacctttccttatgcagcatgcctgtgttgggttgcacagtgcagggtcacatcaatgcacttgtatggttgcatctgtcagcat

SEQ ID NO: 716467 - DNA, 420 bp, Homo sapiens
gttgatcttcttggtagtctctacagatcccctcgcattccggggacgctgacggccctgcccacaccgtgaatcgcttggccatgccttgatctgttttcgttgttggcttcatggtttatgggtcaggattacactgtgttgcccacgctaccagtgcagtgctgccacagctcactgtgaccttcaccttctgcactcaagtaatcctcctgcctcagcttcccaagtcgcgtgtatcacaggcttcagcctgcctcacccggccatcacacctggattttcagtgtgaggtttttggtttggagacttcctaagcctgaagccaggtcggtgtgggctcgggctgcattttatgaaactgcccagcaagctgcgctccctggggccccaggatccacctaactggcctggcacctg

SEQ ID NO: 716468 - DNA, 134 bp, Homo sapiens
tggttgatactagtcacggttggctacgagtccacggttggctgaggcaggataatctgcttgaaccggggaggcggaggtttcatgtgagccgagattgtgccattgcactccagccaagctgtggactatgt

SEQ ID NO: 716469 - DNA, 633 bp, Homo sapiens
cgagcgctggctgcgccgccctgagccgctgggccggggaagcactggccgttcgctcccgggccggctccgccaggcgctcgcaggcatgcagcccgggagcaggaggctgctccccgtggcctgctgcttgagcctggcctggggctggctggggaccaagctgcctagctggatgccctctcccaccttgccccgtgggcagacgagcggctgccccgtacacccctctcttcttcctgtggctccgtcctagcgccggcctccgatgagccagaacatggagcatcaataccaacaccccagaccacaggagaacgctggagctacgttggattaaacaagcgcaagaagtgcctgggatttgggctagaggtaatagagcaagaagacgaggcgcaatgagaaacgaatttcaagagccccattgacgaactctcatcgcgccatgaatcacacatcaggagctcatatcaccgtttatcagttcatttggctaagacgatttcaccgacgccgagaaatgaacccaacaccagttccccactgcgagtttagcacaacaagaaaatccacactcaagtaatgtatgagccagtagaagtcatttagaaagagattacacatagtgga

SEQ ID NO: 716470 - DNA, 215 bp, Homo sapiens
cagcaggacccgcagtgtctccaagcattttgctctgctggagcattctcgggagcatgtccagggccagatcctcagcagtccaaccacaccacggataaaattgagatactctggtatcaactcatcacagctgtccatgatgaacacacggcggcacatagagtttgatgttgttctttttcttcttgttctcaaacaggtccaagggagcc

SEQ ID NO: 716471 - DNA, 786 bp, Homo sapiens
ttgccaagatgtgagagggagattctgcaatcatgacttctggagaggccactgcacaaggctctaacgccttcatctgtttatacacaggctcaatctgctagctctataggagattccaggataccaaataatcatcatcataataattattacatttagagacaagttgttccttttttctggtcaaaataatgagactttccagaagagctgaacattcaaatttcaaatcatttcctttagtgtcagtcctaactcctcttaatacaaacctttctttttactcccaaagcaacctcaatccaaagtatttaactaggagctgcaaataaaatttcaaactagagttgattttcctgataataattgtctgtggaaggtgaaaaaaagcactgcctagagcagaagtcagttcatgggccatttctgaggttgtggccctgagctaacctccctcctccccagaccgcagtaagcatctctgtaaagtgggcaggagtaggctatctactaaatccaccaccccttcgaccccattcttggaggtagcagggattccaactttgcaacacacacccctcctctgctgtcacaaagccactctaacttcacagcctgtaaggcaggggcagggtgccacagcctcactaccaccctcctgtggaaggtgaaagcagtccccttctgaatgtggggtgcttacagacatcaaaactccttatatcattagagggtgcaaggacaaagcccattgtgttgtctctctgcaactaaaccataatc

SEQ ID NO: 716472 - DNA, 476 bp, Homo sapiens
tagagatcctcgcgctccagatcaggtatccttaactctagcatcccaggtttggtgatacacgttagctctggcaacactgcctaggctattttctgtattctacgtgcagaggtgatttcatccgatgttggccatgctggcctataagttcttgattggaaaacccctgcctgtctcagcttcccagagtgctgggattacaggcgtgagccactgtgcccagctgagatctgatggttttaaaaagaggagctcccctgcatgagatctcactttttgcctgctaccatttatgtaagatgtgacttgctccttcttgccttccatcatgactgtgaagcttccccagccatatggaattgtaagttcaattaaacttcttttctttgtaaattacccagtctcgggtatgtctttatcggcagcatgaaaacggaccaatacagtaaattggtaccaggagtgggatgttc

SEQ ID NO: 716473 - DNA, 248 bp, Homo sapiens
  misc_feature (71)..(71): n is a, c, g, or t
  misc_feature (113)..(113): n is a, c, g, or t
  misc_feature (148)..(148): n is a, c, g, or t
  misc_feature (212)..(212): n is a, c, g, or t
  misc_feature (234)..(234): n is a, c, g, or t
aaatataaaaaacaagaaaatacatgctcattgttttagtactaaagacaataaatattttgtcatatttnctctgtccttttgctaatactttagctttcattgtttgtttnacatctttgtaatcatactgtatacatgaaagttnatagtctgaaaattctggcttaacagtcatatatatttttcagtaaagcctaacttcttaactntccttcctgggatattagatanggaacatgagttag

SEQ ID NO: 716474 - DNA, 507 bp, Homo sapiens
tggtgttaaggtttctgacaagcaattcagaattttcttgccccgccgaggcccgggatggcgatccgacttgaccgcgcaagtgccgccgcctccgaggggatggccaggggggccagggcgccatggacgttcggaacggaaaggcctggaaagtcagtaggtgagatgagcgcggtgcccccgactcaactgcagattgggagaggacgtcgctccacgtcctcatgcaccgaggagccgagccgctcgggagcctgctctggctctggccctaccctgggtgcctgctgtcgtccgacccccgcacagccacccgccggcattctgcaccagcgcccgcctctcctcacagcacgggccgggccgggcctgggctcatctcatgcgccccgcccacagcacagaaaagcttccgccgccagcacagacacgggccctcggcaagcagtggcgtcccgggactctatcgtgcgcgcccatgcctccatgcagacgagcggtcgc

SEQ ID NO: 716475 - DNA, 441 bp, Homo sapiens
ggattacagatgtgagccactgcacccagccgcactcccctcttaacagggtccctgccatctcatgggatccacagtctccccagcacactcagtgtccacctccatggcagggactgagggtcctgcagtcactgccaggcagcaggcagcacggccctcccaccaacatcaacacctcgagggccctccgttcaggctgggctgggccaggccaggccctctgacttgagtatccgcaacaagtgggtcccaccacccaagacgccgccccgtggagcccagaggtcctgggtagaggggagtggtccctgaaggtggccatcatgccttagcctactcagggactgagaggctcgggaaattcatgcagcagaggcgggaataggcatgggctccaaggaggggcaccagatgccctgaagacaccgggcccggggg

SEQ ID NO: 716476 - DNA, 273 bp, Homo sapiens
agcggggaaacaatcacttacaattttcttctttggagatggagtctggctcggttacccaggctggagtgcaagggcgcgatctcggctcagtgcaacttccacctcccggattcaagcgattcttctgcctcagcctcccgagtagctgggattacaggtatgcaccaccacgcccggctaatggtggcatttttagtagagtcgggattttacggcgtgggttagacgggtcttgaactccggacctcaagtgatggttccccgcggggt

SEQ ID NO: 716477 - DNA, 117 bp, Homo sapiens
tgtcagtgagagggcccctcaggctcccaaacctgctataatacaggactgtgagcggctcgagaggggcctcctttgctctccatccagcgggtcgccgggtctgcggccgcagga

SEQ ID NO: 716478 - DNA, 213 bp, Homo sapiens
agaaagcaacacatattttttttaaaacagagtttggctcttgtagccccaggctggagtgcaatggcacaatctcagctcgctacaacctccacctcccgggttcaagcaattctctcgcctcggcctcccgagttagcccggaactacaggggtgtggcacaatgcccagctaactgttgttatttttagtagaaacggggtttcaccatg

SEQ ID NO: 716479 - DNA, 455 bp, Homo sapiens
  misc_feature (282)..(282): n is a, c, g, or t
cactctagaggacccccctggctctgaacttagggaggtggagcttgcaggtgagccgagatcacaccacggcactccatcctgggcgacagagcgagactccgtctcaaaaagaaaaaaaagaaagtagataaatataagggccacattaatttctcacaggcccttctccctcagttaacctttttttttttggttttgggaacacagggacactttttaaagttagcaagaaaggtacatacatggagtatttatggcaaggcactctaatccgtggtnacatttattctccacagcagcttggtgaggtatagatactatggtctctatccctccacctcattggcaattgaggaaccggaagcttataaaataaggtaacatcaggcagccagaaaaggacagagccgggccaaagttcagagccaggcctaagttcagagccggggggt

SEQ ID NO: 716480 - DNA, 473 bp, Homo sapiens
caaggcgatagctccaagtgctggactacggtgtgagccacacgctggagctttgtgttctttcttctgtgatcttgcttagatcacacagataaacatgacaggacctggacttaacacagttgggtctcaatcctgttctcataaacatcactggcttcatttatctgtgtcatcctcagacctgacacatagtaggtgctcagtcagtgttcactaagtaaatgatgacccagaactctttgactgggtccaaggtgcttatcccaatacttcgccatggctacctccctcattcctcagctgactagctctctctagcctggctgctcctattttatgtcctagacatggagccatggcaatgatgtagagctaacaggtgatacggtagccatcataatttaatgagtatggggctcatgcaaccacaagacacaggagccgagagctagctgtgcccagacaacaaa

SEQ ID NO: 716481 - DNA, 183 bp, Homo sapiens
  misc_feature (3)..(3): n is a, c, g, or t
tgncaagcttgcaacaagcgaaactctgtctcaaaaaaaaaaagaaaagacagtagtttatgttcatgtcaagcacctctcatcacagtctagtttccaaggaaaaaaattcccagcgtttttctacatttcggtgctgcgttcatctagaaactcggcacatttccatggcaggagaggagt

SEQ ID NO: 716482 - DNA, 89 bp, Homo sapiens
tcaagcttctaacgatgtacggggacatgtttgattcctaaccttttgctacctgaataaagcagagtctatttcaacacaaaaaaaaa

SEQ ID NO: 716483 - DNA, 281 bp, Homo sapiens
tgagatgggagtgatgatggccaagggagatgagtgaaggaagggaggtgcagagctaaggaaagccccagaggagctgagagaggaagagagacaggagagagacttccacggagatggggaggccttaagtagggcagcagcacatgtgggagagaaaccgagagggtggtgttagggaagcgtaggaggagccccactcacttccagtacagaaattcacccacagcagaggccaggcctcaattagaggcctacacaatggggtagacgctctcaca

SEQ ID NO: 716484 - DNA, 187 bp, Homo sapiens
gggctgatgttcagacgacgtgactattactctaaaaccacaaagaccttggaacactataactattattcggcgcatgagctgggagtcctaagcacagctctaaggcttcttattcgagccgagctgggacagccagggaaacctatctagggtaaacgaacaacatttacaacggttatccggc

SEQ ID NO: 716485 - DNA, 178 bp, Homo sapiens
ataaaggattcatggccaggcgcagtgctcaagcctgtaacccaacactgtgtggcctggttttgttttgctttgttttgttttgtgtaaccccaactctttgggagctgaggccagaggatggaggcaggagttggagaccagcctgggcaacagagggagacctcgtctgtattta

SEQ ID NO: 716486 - DNA, 197 bp, Homo sapiens
cgtggcaagcacgctggtggagcaaagggttgtcctgacacgaactgagcgacagcgaagccacgccctgtgatggggttccgcccttcccttccctgactcgctgaccgatcattgaccggtgtgtgcgacgagcaaagtgctgcttgcgttctggtcaccagcgttctggggctgacacaagcggcggtgcacgg

SEQ ID NO: 716487 - DNA, 360 bp, Homo sapiens
ggcggtactttcaagtatgcaagaagtaaaatgagtggaaaagtggtatgtcaaaacacatatagaccatgctagaaataacacaagaacagggaaggtactacccagaccaagaacacgtacaatattatgcttaaatatggatggtcattacttcttccaggcaacagctcataaaataaatccatagttctcggccagctaagaagtcacaggaaacagaaactccctcaaaatcttagccggtttctggagggtaaacctgagattgcaggggcactcattctgctcggctacatttttcccggtctttcttttttataaacgaggattggcttcagaggcaaggcagacaactga

SEQ ID NO: 716488 - DNA, 896 bp, Homo sapiens
  misc_feature (175)..(175): n is a, c, g, or t
  misc_feature (276)..(276): n is a, c, g, or t
  misc_feature (289)..(289): n is a, c, g, or t
gagatgtagaaatgttcttgcagttaagggttagtttacaatcagccacattctaggtaggggcccacttcaccgtactaaccagggaagctgtccctcactgttgaattttctctaacttcaaggcccatatctgtgaaatgctggcattgcacctacctcacagaggtgcatngtgagggttaatgaaataatgtacatctggccttgaaaccaccttttattacatggggtctagaacttgacccccttgagggtgcttgttccctctccctngtggtcggtgggntggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttacttgtccttttccttggagacggggtctcgcttggtggcccaggtctgggatgtgggagtgggcgtagatctgggcttactgggagccttggctctccccggttcgagcagtcctggcctaagcctccggagtgagctgggaccccgggttcatggcccaccatggccggccaatttggcatgtcggctcgagatgggggtctcccagtgttgcccaggcgggtctcaaactccgggggctcaagggatccacctgtctcgactcccagagtggctggcatcccatggggtgagcaccatgtccagctgcagggggtcacttttttaacattctgcaagccttcgcttttcaccccagcttccttctctccctttttatatccc

SEQ ID NO: 716489 - DNA, 283 bp, Homo sapiens
gcgctgcgtatgccagaagacaagaactgaggtttgggaacctttgactagatttcagagaatgtatggaaatgcatgtatgtcccggcagaagtttgctacaggagtgaggcctcatggagaacctctgttaaggcaatgtggaaggggaagcccccacacagagaccccactgtggacactgcctagtagagctgtcagaagaaggccaccgtcctcccagacatcagaatgttatatcccactgacagcttgcaccatgcacctggaaaggccacagaca

SEQ ID NO: 716490 - DNA, 669 bp, Homo sapiens
  misc_feature (486)..(487): n is a, c, g, or t
ctcaaaataaataaataaataaataaataaataaataaataaaagactgaacccaggaatctgcatcttaagcagctgtcgcactgatgattatgacccccttggatattcacttgtagacatgtgtgaatgctgaggggcaggctccaagagagagggtgggtgaagctggaggacctagctcccagcaagtctctggagaagacagtgggagggattcagagctcctgagggagagtgagagtgagacttcatctcaaaaaaaaaaaaaatgtttaccagatagacgtacgaatgagaagactgggctcagctccatcacttaccagctaggtggcagtgaccaagtaaactgccggagtctcactctctcccaggctggagtgcagtgagctgagatcgaaactccatctcaaaataaataaataaataaataaataaataaataaataaaagactgaacccaggaatctgcatcttaagcanntgtcgcactgatgattatgacccccttggatattcacttgtagacatgtgtgaatgctgaggggcaggctccaagagagagggtgggtgaagctggaggacctagctcccagcaagtctctggagaagacagtgggagggattcagagctcctgagggagagtgagagtgagacttcatctc

SEQ ID NO: 716491 - DNA, 316 bp, Homo sapiens
gctcacttgaggtcaggagtttgagaccagcctgggcaacatagcaagatcgtggctctacaaaataattaattaattaaaaaaatttcaggccaggtgctgtggctcactgctgtaatcctagcactttgggaggccaaggcaggaggatcggctgagctcaggagttcaagaccagcctcggcaaaatagtaagacccgtctttgttaggttttgagcgatggtgaggttaaagaagatacacagaagaggggggctggacatcaatacaggcttatgtcagcataaacttacagagtggggccacctatccaa

SEQ ID NO: 716492 - DNA, 709 bp, Homo sapiens
tttttctattactttcccccccccctaactaagggcctattactggtcgctgttttaatctttagctcttagggcttagctattggggttccttgcggtgtccggctcccgtctcccgtggctcccccgcccgccctgctggccccaggcgccccttcgctctcatcctcgccctggtgatggatgtgctgggctgccgcgccagcctttaaacgcgaggccagggagcgaggcggtgacctggccgaagatccggccctcgcctcctccctcgggtggcgctatgggctcccggcctctcttcctcagtggcgggcgtgagaatgcagaaagcaggattcgacctcggttggccagccgccttctccgggactcagggctgcccctccccgtgcgcccaacccacccaggtccgggctggacttggagcgtacgccgtggccgtgttcaccccggcagggattgtccgaagcctggagatgagctcccattctacgcctccaactatcagccatctggtcaggccagtacactggttcctcggccgcgcccaggcggctagatccttcccccttgtaccccgcggcgtttaaaatggccctcctactgcatcgtaacattctgcacgccggcgtggggacttggggcggcccgtaaggtcttgagtggctcggcgcagcctcacggcttggtcgttcccgcgctttca

SEQ ID NO: 716493 - DNA, 184 bp, Homo sapiens
aaagagagagagggagaagaagagggagagagagagagagagagagagagagagagagagtgagcacgtgagctctggtgtctctccctcttcttatggagacaccggccctatgggaatcgggccacacccttacgccctcttttaatctgaattatctcctaaagggccctgtctccaaaca

SEQ ID NO: 716494 - DNA, 175 bp, Homo sapiens
tgactctcttctcgcacaggcccctgtatttcctctccccattttctggccctgtgttgctcctgaggttcagtcgctgggatgtaccctctttccttcactgtgcctgttgcctatatgacccggcaggcgacatcccccaagccgattcctttgcatcgggttacttgtgggc

SEQ ID NO: 716495 - DNA, 100 bp, Homo sapiens
gccaagatgcgctagcagttgatggagaaatttaagaagaaagttcatcagctgctatgaccgtggtcagtttccatcaggtggattataccttatgacc

SEQ ID NO: 716496 - DNA, 176 bp, Homo sapiens
aagggagccggtccttgttgcacctgtgccgtccccaaagctacaggccccatttggtcctaagtccctgctgcccttccccttccccccctgtccatttttcctcccattcaggatgcccccggctggagctgcctttttcatcccctttccaataaaaagttccttttgctcca

SEQ ID NO: 716497 - DNA, 404 bp, Homo sapiens
acacaacatgtactggaacaagcagatatccacatgcaacaagaatgaagttggatccctgcctcacaccaaaattcactaacaattgatccaagacctacatatcaagacctaaaactatacaattcttacaagaagaactcaggcttaaaatctttgtgcactttcgattcaggtcatggtttcttcacactcatcaactgaaacaaacaaacacgcaaaaccacatcagcattcactgccatccaaaattcaacacacttctgtacttcaacggaccatccccaagcacagtgcaagcagcacaacctataggctgggagaacgtttaagtaagtagaaatgataaacatatattttagtaaatgtttgtaaatgtctctatccaatatatttttgtactt

SEQ ID NO: 716498 - DNA, 241 bp, Homo sapiens
taaaatacgtaagacatactgctaacgggggacactagtgagtaaccaagaaaagagtcaactactaaggaaaatagtatatcaacttaaacatacttggtatgtcaaacatacatattgcataacaactaaatatgtatctataagaatcaatagtgatgactatagatacaaattttgcaagaatataacattaacaggctcatgtgatcaggaatggtgtggggccctgacgataaaa

SEQ ID NO: 716499 - DNA, 698 bp, Homo sapiens
aagattccaagaaaagttgttttttctagtggctactttgccttaaagaggctctataagttcattcacacagctggcttctctggttttaagattctggagaggatgataatcctagtaacaccgcagtgcttaaaaaaaaaaaaaaaactaccatcaccagaaaattccaccggtctgttctccttttatctatgtgctgatgtgatgtacttcccaactaagtcaactttacctctagtgagagctttaggtgacctctttccatatggtacgtgtgatagaacggacccttcacttgatagatattctatctccagaaaggcgctatactacacatcacttggttgttcctctggaatgagaatgacaaactctcctaggttgcctttaatctagtggaaacttgagcaaagattcaattgtcttcctataaagaaactgacattctggcaacaattgatgagcctattgatcatacagcgtataggatagtgaatggcaacagtttaattatgtgatatttgtttctaatggggcaagtacctatttattctagccgtctaatatttgattgacgccctcgacgcgttatatctccatctcagagttagacgttcatgtcctttttggatgctctcatttggataatatcttttttaaggagggaacacattcattgaactcctttgtgctgc

SEQ ID NO: 716500 - DNA, 670 bp, Homo sapiens
ctgtacacgtatcctgaaaacatggagtggcttcaatggctctcatcgctgctcagtacatgcggggctcagtgtcctgcgtgctctccgcaccaccccacttccattttggccaaaccaacctgcacccctgaatttctccgcaaatttcctgcctggcaaggtcccagcattatgagggtgatgatggattctgtgttgttttgagagcaactgccattgcctactatgtgatgcaatgatgtgagcttgctgtgtgtgaagtactccagaggcagcagcccagtgtggtgcagttgggtgagcttatgctgattcctgatataagttgcccccagccagtacactgggtgttcccaaacttgggcatcatgcaccacaacaaacagggccacttgagaatgcaaaagtgaggaagtgacggctgaattctgtgtgtgctgcttggatgcttacttgaatgacgaggacttttctggtgggcgaacgagtgacattggctgacatcacagtatgtctgacacacctgtatgtggcatctataagcaggttctagagcctacatataccggacaggcctttcccaataccaacgcgctggtatctcgacctgcattaccaagacccagttcagggctgacttggcgggaagtgaactgtgtgagaagat

SEQ ID NO: 716501 - DNA, 586 bp, Homo sapiens
tcgatacagaatagctcctcttgcaagaaactagccttcggccccaaagcagagatcaaagggctagctcatactgcctagccgacagcttgtaggccactctacaatggctgcaaatgcctcctcagcatagcgataagtgacgaagccgtagttgtccccttggacacggaagtggatggtgcactcctcaatctctccaaaaacggagaacctctagtttcagctctgatcgagtcatgcggccaggtatctttccaatgaagaccacccttctttcttctatagcacgctccttttgtagcactctttgcctttggtaatggtcatgtgaacgataagagctgtacctgacaaaagagggtgtcatcagccccccaaacataagacaattcaagactcaactcttaggcacctgcatcccaggtgcatggggctccctgaacacatgctcaccgccgactcctgtcacttctccggcggggggatggggatcgtgagcggcttcgagaaactggatgatgaggatgaggaagacgaagaggaagatgatgacgaagaagagggagagcatcttcgagaacgt

SEQ ID NO: 716502 - DNA, 281 bp, Homo sapiens
ggggggggggcccccccccgttgttttttccccccttttggggggggcgggggttcccccccccccccttttttccctgggtcggggggggggcccctcttttcccccccccccccctccccccctttccccctttttgggggccccccccccccttttttccccccccccgggggggggggggggggggttttttggccttttttttgcccccccggtggggccggttggggtttttgggtgggggttttttggggttttgttataaaaggaggagggga

SEQ ID NO: 716503 - DNA, 352 bp, Homo sapiens
tcgcggtcgatccggtgcaggacgctgagccagccggacgtctcgtcaagcgcagcagccgcctcaccgactcggtggccgccccgaacacgtattcgatctgcccgttgacccccacgtccaagtcgctgcgccattgcaggatggggtccccggggcgtttctcaccaatcgcctctacacgttttcgaagcggggcttttcttcacgtcgtgatgagacccgtagatgctcgagacgagggtcgcgcgtgcgatcgcagggcagtcgtaggagtcctgtcgcgtccagcgcccccttcacgatcagctcgctgcttctcgccgtccggggtgtccgccacctgcagctc

SEQ ID NO: 716504 - DNA, 490 bp, Homo sapiens
  misc_feature (21)..(21): n is a, c, g, or t
  misc_feature (165)..(165): n is a, c, g, or t
  misc_feature (171)..(171): n is a, c, g, or t
  misc_feature (173)..(173): n is a, c, g, or t
  misc_feature (193)..(193): n is a, c, g, or t
  misc_feature (240)..(240): n is a, c, g, or t
  misc_feature (246)..(246): n is a, c, g, or t
  misc_feature (292)..(293): n is a, c, g, or t
  misc_feature (301)..(301): n is a, c, g, or t
  misc_feature (321)..(321): n is a, c, g, or t
  misc_feature (327)..(327): n is a, c, g, or t
  misc_feature (337)..(337): n is a, c, g, or t
  misc_feature (351)..(351): n is a, c, g, or t
  misc_feature (370)..(370): n is a, c, g, or t
  misc_feature (394)..(394): n is a, c, g, or t
  misc_feature (455)..(455): n is a, c, g, or t
ggcatctgagtcatgcatggngtggtacatacaaaccttggcccagcccaaaggagcagtcaagggcctggaagaaagatggtttgctctttccccctcctcctctctctttcctcacgggctttaaatccgtggcaacataaatttttcaaccatggaaatgtncaagcntncaggccgtggcaggtcagtnttggttgttccagtcaacatcaaaaagtagtttcaagaaaaaaaaanagcccnagcttcccacaccatcaccccagtgttggctggttccaccacctgnnctctcacnctcacacaagcaatgcagcnggtgcntgctgggcantggtgttagttttngaaggtgaccaccacaacntttccgtgccctgtgcaacagtcnaacaaacatcaacaccccttcgcgcgcgtccaccctgctcttgctgccaagcaactgctgnaaatgaatgaaaactgggcccaaaaatgtcttgtg

SEQ ID NO: 716505 - DNA, 106 bp, Homo sapiens
cgtactgtggtgttaccgtggtgttacctatgaagcaaaagtccatttatttggcagagaagttaatcagacagcaaaacctctagtgaagaaacaccacagtacg

SEQ ID NO: 716506 - DNA, 410 bp, Homo sapiens
tccgcactgcacagggagacgacaggaaaaagtcagtagggtatcttacatctatctagatcgatgtgttcgttcgtgactcttgtgttttttacttctgtgccgcatgggtacttgtgtcgctgtgtcttctctgtaattccttatccttgttcttgttctagtgtctctttctgtcgtgtcgttagtcttctcttctcttgtttttcccgttgcctatttctgcttattgtctatgtactttgctctacattgcttagtgtcgtacgtgcagttgttcgctgtttccgtgcgtgctcctctgtgcctatcgtgttctttcccgtttgttgctgtgtgttttccctggttgtgtgctgcggttgcgcttgctagtcctttcggtgtgtttctcagttgctgtatctgct

SEQ ID NO: 716507 - DNA, 440 bp, Homo sapiens
cgaatagatactgtttagctcagccagcgacaatgtgcacaggccgccaacacagctcgtccccgtgccgcgaacttcagcgttccctgtcccagatgggccaatggaacgacacggttcacaggctcgccctgctgttggtattgcccttcataggtatagaagaaaaacaacttgtcctttttgatcggaccgccaatcgtccgccgtaaacatcacgtgcgagactcgggcgtggaataccagccaggttgttgaagaaagtgttcgcagatccgaatgtcgggcgatagaaataatacagagatccgcggagttcgtttgtaccgctcttagtaaccagagagatctgggctcctgatgagcgtccctggtttgcatttgcaccgagagtcgtgatgcgaaactcttctacagattcggtggttgctcttaaagct

SEQ ID NO: 716508 - DNA, 819 bp, Homo sapiens
ggtcgagatgcgggtcatggcgcgccgaagccctcctcctgctgctctcgggaggcctggtgctgaccgagactgggcctgctcccactccatgaggtatttcgacaccgccgtgtcccggtccggccgcggaggaagccccggttcatctcagtgggctacgtggacgacacgcagcttcgtgcggttcgagcagcgacgtccgcgagctccgaaaggggagccgcgggcgccgttgggtggagcagggaggggccggagctattgggaccgggagacacagaacttacaagacgccgaggcacaggctgaccgagtgagcctgtccgaaccgtgccgcggcatatctacaaacaagagcagaggacgggtcgtcacaccctccacgaggatggtatggacgtgcgacactgaggagacccgaacggaggcgccgtcctcacgcggggatatgcaccaagatccggcgcgtaacgaacgagcaaaggatataacatcggccatggaaacgaaggaccatggcgctccgtggaaccgccggtggcaaaccgcggcctcagaatcaaccagcgcaacggtggggacggcggcccgtgcgggcggcaccaagctgaggaagcctaccttggaaggggcgatccgtgccgttgccacggtggctccggcgaggattaactcgtggaacagaacctggtcatacggaagatcgcgtagcaaagccgcagcaagtaaacgcgcccgaagaggaaaaaggggcgttgaaccccaactattacacttctcttccgtgatcatggaagggcaacaccggtgaggatg

SEQ ID NO: 716509 - DNA, 505 bp, Homo sapiens
  misc_feature (25)..(25): n is a, c, g, or t
  misc_feature (204)..(204): n is a, c, g, or t
  misc_feature (218)..(218): n is a, c, g, or t
  misc_feature (222)..(222): n is a, c, g, or t
  misc_feature (225)..(225): n is a, c, g, or t
  misc_feature (227)..(227): n is a, c, g, or t
  misc_feature (232)..(232): n is a, c, g, or t
  misc_feature (234)..(236): n is a, c, g, or t
  misc_feature (240)..(240): n is a, c, g, or t
  misc_feature (249)..(251): n is a, c, g, or t
  misc_feature (253)..(253): n is a, c, g, or t
  misc_feature (258)..(262): n is a, c, g, or t
  misc_feature (266)..(266): n is a, c, g, or t
  misc_feature (274)..(274): n is a, c, g, or t
  misc_feature (277)..(278): n is a, c, g, or t
  misc_feature (282)..(283): n is a, c, g, or t
  misc_feature (291)..(291): n is a, c, g, or t
  misc_feature (313)..(313): n is a, c, g, or t
  misc_feature (315)..(315): n is a, c, g, or t
  misc_feature (326)..(326): n is a, c, g, or t
  misc_feature (329)..(329): n is a, c, g, or t
  misc_feature (331)..(331): n is a, c, g, or t
  misc_feature (333)..(333): n is a, c, g, or t
  misc_feature (341)..(341): n is a, c, g, or t
  misc_feature (344)..(345): n is a, c, g, or t
  misc_feature (347)..(347): n is a, c, g, or t
  misc_feature (349)..(350): n is a, c, g, or t
  misc_feature (352)..(352): n is a, c, g, or t
  misc_feature (354)..(354): n is a, c, g, or t
  misc_feature (358)..(358): n is a, c, g, or t
  misc_feature (364)..(364): n is a, c, g, or t
  misc_feature (372)..(372): n is a, c, g, or t
  misc_feature (375)..(375): n is a, c, g, or t
  misc_feature (379)..(379): n is a, c, g, or t
  misc_feature (381)..(381): n is a, c, g, or t
  misc_feature (395)..(395): n is a, c, g, or t
  misc_feature (404)..(404): n is a, c, g, or t
  misc_feature (406)..(406): n is a, c, g, or t
  misc_feature (411)..(413): n is a, c, g, or t
  misc_feature (420)..(420): n is a, c, g, or t
  misc_feature (430)..(430): n is a, c, g, or t
  misc_feature (470)..(470): n is a, c, g, or t
atgtaattcttcttatcctaaaagnctgaaaacattgctctttatagtttgcgggaatttttaatgccctaaacagaaactccaacagcctcatggcttgctttaaagcagagcctgaatacagggggaacacaggtttgcctgagggttaagaagcatccaagagtaagggaagactgggtaagcaaagcaaaataaaggggnaaacaaaacaaacnacanatnanaatanannntatnaaattgttnnnanatttnnnnnacanttttattnacnnattnntttttttnttataaaatatttttttatttntnttttgattgtnagntnanaaaataanaanntnannananttanaaaatntgattaanttnaagngnaacaatttttatanttaaaatgntnttttnnncttaagnatctagaaantgccactatatataattaatacatttttttattatttttnttttattttttttattatactaaatatgaacgaga

SEQ ID NO: 716510 - DNA, 1046 bp, Homo sapiens
gcaggtccatgatatcatctggctaaagtcaaacctccgtgcttctcagtacagatgcccttcttcaccagtgacgctggggtgcctcacttctctcatggaagacaactttttggatatacgttgtcagacatagaacttccctcgtacaatggcaggcgatagactacaaatctacgagcgcgtgtgtgtgaaattaagaagccacgtcaacaggacggtcttcatctactgcggaactacctgcattgtcgcgaaccccgttctctgagatgctctaagcatactgcgagcgtgatactaacggactctaatctccatgatgaacatcttatctatcatacactcatcagagctttatgtaacatctggttctaagtcagaatctctctggtgagcttgggcattctgttcgcagagactcatctgcaggacattggccatgtccagatgcatgaactcggaacacttgctctaagggttgttctcttcgtgcatgtcacctcgtagctgtcatgatgatcctgaaaactgactgagtgcagcctcgattttccactatctggagtacgtattgatcaggctcgtgcacttcatatgactttcagaagagttacttatcgtccagacattcaggctatgccagtagttatgcaaattgtccgtatactatctagaaatataaggactagggtgtgctatcaggtaatcattgaggaggtcccctttatagatcccgcaccgtgacctctcaatctgttgattaactttccaaacagtgaccgaacaaactccattgcatcctggctgacctttaagaatccctttgatggccatgggacatactggaccatttttttgggcaattataggctgagagggcagtgggtcttgttcgaacacagcgaaaccttcccatttggttcaaggcagtgtccacaccactgcgtacatttaacaacttcctatgggagagaacagccttgcaatgattcacattatcaccctaagtacggcgcccatgggtaaccagtgacatattcaca

SEQ ID NO: 716511 - DNA, 161 bp, Homo sapiens
agcgcgtatatcaacaccctgctctgcatacactaccatatgggacaccctggaacatgtgcaccctcctactctccctgagacataccaacatgtgtggactggactgtaagctcccctcccccccctaccctctccgatgatatccatgcgcctatctg

SEQ ID NO: 716512 - DNA, 400 bp, Homo sapiens
tggtcagtgtgtgggttctagtgtgctgtgttccatgcctgtgtgtcagtatcaatggtatgcacttgttgacatctgtatgaaatgagtgtgttcatgctttgcatggaaacttcccagaccactctaccacatgtggctgcaccactcctgcactcccacacagcaatgaatgcagggttctgttgctccacatccttcaaagcactgcactcaactgcaccacaaatgcttgctgtcacggcttctttctcaagagtgttcacggtcccagcagaaattgcctttcacgaatgtgctttagcagttggtcaagccgcaattgcttgtctacggtgagccagtgctgttgtgttgggatctctccatgtcatcatctcacttgaacacggtctctcag

SEQ ID NO: 716513 - DNA, 694 bp, Homo sapiens
caggcacccttggagagcatatatcagatggaccccctgaagctggtggccactttcatgacaaatacttcaaggagagaaaaaagctgttatggaatcatgttccgccacttgccaatgcctttccactggaatgcaggaagaactcaaggtttaagacaggcttgctggaggctggcacgtcacctgaggtaggggagatccaccttctccgatgaagccctgctagaacgggggctgatgtgctggccaagtgtctctgcacagcttgatagaaactcctgctagtgggactgggccaatgtgatgtgccctggccatgctactgcatggagaccactggagatgctatgaggcagccaaatgccctagtgctgaatgatggatccagatttggaaacggcatgcatgcatgcttgtgcatgtggaaattggtctgcatcctgtttgatggatgagccatggtcccacagctccatcggcatgatggttgtgaaagcctggtggacatttattcccagctacagcaggaggtaggggctggttggtggggagctttgagcccaagactccgggcatcgctgactggctcggctgtgatgaagtccttgagaaccctcgtcaccagttgcttcctgcttggcagaagcatgccccctttgtactgaaagactcaaccaagttccagctgaaa

SEQ ID NO: 716514 - DNA, 706 bp, Homo sapiens
ggcctcactcctaactcatctgggcggcggcggcaagtggtgacagggcgtggtggcgcatcatcggcgcggaggcaggaggagcaaatctcatgtgttgccgtggcatgccgtcatcacaacaagatatgggtcgccctcggactccaggatgcgggtccctagacaccacatacttccaggtactcgtgcaccttcaatgcacgcgctacaaatcccgtcgccagcgtgaccttcttgaaagacagcggggccccgcggaagcgtcggactgggtcacgacaatcatggcacgcatcatttcgtccaactccctcccagtccccatgcgaaacggaaccttgtggacccaagtcctccatcttggttctccgatccttcgtgacccatgacccaacccccagggccggcaaggcccccggcggatttccacagagtaaccaggttccggtgaggcgggagcccggaagggaaccgaccgcgaagggaaaacggaaaacgaacggggaaggggcagcgaaaacaggacgggcacggggaacgggaagcggcgaaccaagcaaacagaaacccttgggggcacgggaaagccttggaaagggattgcctcgggggaaggcaggagcacaggccccccgggccacagctcagggggcctaggtccccggcagggcacccccaggtggccacccaaccgagacccacg

SEQ ID NO: 716515 - DNA, 308 bp, Homo sapiens
atgcagagaaccccatatatcttctattcggatttacttattttaagcattttccccttttgctctaaaagttcaatgttgacagggactgtatcatttttcattcactgatgtacctccagtgcctagaataatgcctcatacacagaaggcactcaatacatgattttatgaatgaacaaataacgactttaggatcagagtgaagcaccactgtttcacagtttcataaagagctctgtgatgtgttatataaactgaggggctgggggaaataaaaagagaattctgggttctctgcatcatct

SEQ ID NO: 716516 - DNA, 341 bp, Homo sapiens
gggcttttaaggaaccaaaaggagcatggttgcaaaacccggccttccacgtgggccagtccccggcccctcctcaactggagccgaaaggcccagcagggcaaaattggagggtgcccccagccctgtgccccagttaaaccagctccgcccttatcctttaagcacccagggtggccgttagggccaggatccctgcacgcctcagccctgggtccagttggcagcaagcaccgagcatgccctccccccccaaaggacctccgggcaatgcctgttccccctcatgttggagggtgcctcgggcccctgcctgccccttaaagactggtcagacctta

SEQ ID NO: 716517 - DNA, 773 bp, Homo sapiens
  misc_feature (202)..(202): n is a, c, g, or t
  misc_feature (207)..(207): n is a, c, g, or t
  misc_feature (213)..(213): n is a, c, g, or t
  misc_feature (318)..(318): n is a, c, g, or t
  misc_feature (322)..(322): n is a, c, g, or t
  misc_feature (339)..(339): n is a, c, g, or t
  misc_feature (344)..(344): n is a, c, g, or t
  misc_feature (347)..(347): n is a, c, g, or t
  misc_feature (359)..(359): n is a, c, g, or t
  misc_feature (369)..(371): n is a, c, g, or t
  misc_feature (374)..(374): n is a, c, g, or t
  misc_feature (379)..(379): n is a, c, g, or t
  misc_feature (383)..(383): n is a, c, g, or t
  misc_feature (386)..(386): n is a, c, g, or t
  misc_feature (391)..(391): n is a, c, g, or t
  misc_feature (406)..(406): n is a, c, g, or t
  misc_feature (408)..(408): n is a, c, g, or t
  misc_feature (433)..(433): n is a, c, g, or t
  misc_feature (449)..(449): n is a, c, g, or t
  misc_feature (451)..(452): n is a, c, g, or t
  misc_feature (455)..(455): n is a, c, g, or t
  misc_feature (459)..(460): n is a, c, g, or t
  misc_feature (467)..(467): n is a, c, g, or t
  misc_feature (476)..(476): n is a, c, g, or t
  misc_feature (481)..(481): n is a, c, g, or t
  misc_feature (485)..(485): n is a, c, g, or t
  misc_feature (493)..(493): n is a, c, g, or t
agaaactcgaaaatgtgaggccagttgtacagttcagaggaaatgcttaacgtagaatcagatagctggaagagatcttcgagggaaagtaagttccctaaagtcacatctatgtctcctagctcaggttcttgtcatgtgtgtgtgtgtgtgtgtgtgtgtgtgtgtgtgtgtgtgtgtgtgatagaaagggttataatantttcnttggantggaaaaaaaatttattatcttttacaaatgaaatatattgatttctagtaatctatatgtgaatcagtgtgaaagtatatatagtcttatgtgtaaaatagatncttnagattatgtgaacctgngagangangttacactcaantaaaatcatnnncangattntagnganataanatcactcagtgtgtngnagagttattctaagaagacagagtntatttaataaaaagtngnngtngcannaaatatnttaaaaccntgtgngatntcatcttnacgagtttatgtggtaaaaacaaagatgttttgggtatgtgtcgaaaattccttgaggggcgtgataatagagagtattttccaaattaataagtgtggatactactcactcagagggagtgcaaggattttttggaggtctttttgagcaggtaagatatattggacgtggtttcggaccaggctcacaaaggttattctagcgtttgggaaatttcggatatgggatgtctgttgttggaacttggcgtaaaattgtgggaaccttgttgagggaatc

SEQ ID NO: 716518 - DNA, 874 bp, Homo sapiens
ggtcccgcgaatgggtctcgttcagctccgcgtttcctgtgctcgtaattctaggtccagactattaccaggtttgccgatgcttgtgttcgcagcgcgtcgtgcatagtccatgaaatggagtgaccatgcatgtccagaaatccgctcttcgagaccgagtgaaatggagggtgaaatcatcgatcatgtggagagctgctacagtgataagttactccctgcataggagggaactttctggtaccctgataaaagtgaacgtaactgaaagccttcgagcaaagacccatgatgagaaattataagagttcctttttaagtcatgtcaagaccgggagtacctcattactgcgttctatcgatattccctggccgtcctctcacggcactattgaagaattgaacggaaatgggaatggtataagaggctagaggtgaataaacaaagaacagtcatgatcggtagacaatatggctgacgcctagaagtgatccaagaaatccacagatgttagaattaagaattcagcaacgttggtgaatacaaagtcaatattttttagatgccattcttagttagcacaaaacctaattagaaatatatcttttacagactagagactggcttggataaaattattcgtgtaggtaatccattgatatctgcttttaaactatatggtatgaatacacttattcggctgttaccacacaaaaacacaacaaatcaaacatctgttgcccctccgccccaactttataacctcgttggggcgggcccacgatagaacggcagcggtccagcgaatggcacaggggtctccacaaacgcggggcggcttaacccgggtggcataggaccagaccggca

SEQ ID NO: 716519 - DNA, 298 bp, Homo sapiens
ctttttgtgctggggcttgaagaactgagtatatcagacggagaaaatgtgtgatgggcgtggcatgcaaagggaacagcacaggcaaagaatggaatcttaagcaaagataggggtcagaagaatgtggactacagtcaggaaacaaaaagcagtttggtgggtggagtggaagatatatatgggaataaataacagaaaaggaagcttgaagaagtgggctgtggtcagagtataaagggtctcgtatgcctatttaagaggtttgggccagatgcagtggctcaaacctgtaatc

SEQ ID NO: 716520 - DNA, 889 bp, Homo sapiens
gggtaccttcgtaaagatggcgcggaggctgttggagtccagttggtggagcgcacgtatgcgtgttctggagcatgggctgaggagacaggatgcaagcgtagcatccgtgatctccgatggctgaagcgagctcctccgggagctgactggtccgtcattcgcgtggaaggcgttggtggtgcctaggtagaaatagggaataggccagaggcggcgaaccatctggcggtgcgcggttcctgtgagttcttcacggtattccacgcgcaaggatgcacgacaccgcgttcgtcggtcgtcttggtcggagaatcgtgagcaagatgttggaactgtggattcgaaagctatggtagctccgtcatacgggggaggccggcggatacactcagtgccccggggggtgttgtggatcggacgccatagttcctctatgcctgtagaaagatgatcgatgaggctgagcataggagattgtgggcatgtagtatatcttagatgctttctgacacttgtggttgatggaagatgtacagaattgggaagtgttgagatttcgagaggtcatagttggggttgggtcatcagatggtgctgagaaaggttggagacaagatgtgtgtactatgatagatgacgatgacggattgtgtcacatgggcgttcgacattggtgtagagagagaggaaagcgagaagtcgagtagaatgtggtgctgcgagaaactctgtgtgaatgtgggatgggatctgaggatttttcaggaaaagggaaagcgtgggaccgttaagatcatggcctggaggatatggtgagtcacagaattctggaatgacatggaaatgtgtaataaaaaagggcttaaggtgaggctttaatcggatg

SEQ ID NO: 716521 - DNA, 306 bp, Homo sapiens
agagcgtaggagtaccactctaacaggaagcatacttcctaaaaaattagattaactgcctattttacaaatagctcagtgaaactactcataaaaatagctaaatacattacgttttcgtgtattaactttttaaagaaaaaaatgaaaaactgtcattaagattggaaatagggagagtctcctagtttttatttgaccctgtgtgaaaagccaaaagaaaccaagatgctgatttgtcgatcgattatttctcaaagggtaaaatgacatcaaaaaggcttttttaggatgggtagtcacaga

SEQ ID NO: 716522 - DNA, 304 bp, Homo sapiens
ccagaggcccaaggaggctgaggtgagtggactgcttgaactcaggtgcttgagaccagcctgggcaacatggcaaaaccctgtctctacaaaaaaattgccaggcatggtggtgcacacctgcattctcagctacttgggaggccgagtgggaggactgcttgagcccgggaggcagaggttgcagtgagctgtgatcatgccactgtacttcagcctaggcgacagagccagacccaatctcaaaaagaaaaacaaaagaaaaaaataatcacacagagagactggtgcccagctctctgcc

SEQ ID NO: 716523 - DNA, 258 bp, Homo sapiens
cttggccggagctgccgggtagtggtgacgtcccggaagtgtctctcgaactcgtggccacgcatctcttcgacggtgtcatctgttgtaggctcccgaggtgtcggctgtctctgagtccgcattgcggctccgtcctcaataaggagaggcgagttggccgccaagcactgtcaggccttacgtctcctccacatttcaccggccgaggtttgttcgctccggtgcgcattcatctgtccatgcagaccagggagc

SEQ ID NO: 716524 - DNA, 204 bp, Homo sapiens
gcccccctttttttaaaaaaaaaaaattttccccagcttgggggggtaaccctgttgtccccccccctttaagggttggggtggggggttttttttacccccgggggttggggcccccgttacctttttttttccccccccccccccggttgggttatcccccggggttgggttcccaaaaattatttaatttaaaaattatta

SEQ ID NO: 716525 - DNA, 175 bp, Homo sapiens
  misc_feature (41)..(41): n is a, c, g, or t
  misc_feature (175)..(175): n is a, c, g, or t
cggtggtcatttctgtgtgacatggaagtagagtgagatcncgtcagagagtccagtagcacggtgcctggagagctctgaggtgtccatagtgccagagagttaagagctgtggtggtggttgtgagaacgagccctgagacgcggccagacgtcacggttgagagttccaggn

SEQ ID NO: 716526 - DNA, 905 bp, Homo sapiens
  misc_feature (202)..(204): n is a, c, g, or t
  misc_feature (231)..(231): n is a, c, g, or t
cccttaagatggccatgagactgcagcaaatacactacctggcttccagtgtgaaggtggcccacttgcaacaaggaccgaaagaagtccagctcagagtgccaagcccacaagccagtgggctagcaggagtgtaacaagggctcgtgggagcggagaatatcagagacgggcactgccactgcccctggggtgtcctctnnnctcctgtcagttgcagcccaaacactncagagctcggataccaaggagcagcttctgtggggcagaatggctgcacacagtcagggaacctggcttagcctggcccaagccttctcccacagtggggtacacagcctggacggcagggaaatagaccgtcaggcactacgggaactgacacaggtggtgtctggcactgcatcatactctggcccaaagccttctactcagtatggagctccaggccactttgcagcccctggtgagggaggtgaccagtgggcagccctgctgctgcccacctgagctgctcattcccagcacatggccagtgaggacatagcaagtgacgaggagcacacggtcatccatgaggaggagggggtgatgatgtcattgctgatgatggctttagcaccactgacaccgatctcaagttcaaggagtgggtgaccgactgagagtggggacaactctggggaggagccagagggcaacaagggctttggtgggaaggtatttgcacctgtcattccttcctcctttactcctgccgccccttgctggatcctgagcccccagggtcccccgatccacctgcagcttttggcaaagtctatggtcccaccttgtcctcctcctacacatactcggatgcttcctcctcaaccttggcacccacctccttcttactgggccca

SEQ ID NO: 716527 - DNA, 782 bp, Homo sapiens
  misc_feature (697)..(697): n is a, c, g, or t
  misc_feature (735)..(735): n is a, c, g, or t
  misc_feature (757)..(757): n is a, c, g, or t
aaaccccagagctaatagaagacaagacaaaaacaagctcagagcagaactaaaggagacagagacacaaagagcccttcaaaaaaaatcaatgaatccaggagctgtttttttgaaaaaaatcaacaaaatagatagaccaccagcaagactaacaaagaagaaaaaagaagattcaaataaacacaataagaaatgataagggggataccatcactgatcccacacaaatacaaacaaccattagagaatactataaacacctctatgcaaataaactggaaaatctagaaggaatggataaattcctagataaatacacacttccaagactgaatcaggaagaagttgaatccctgaatagagcaataacaagttctaaaattgaagcagtaataaatatcctaccaatcaaaaaaagtccaagtccagatggatttacagctgaattttaccagaggtacaaagagaagctggttccatttattccgacactatttcaaacaactgaaaaggaggaacttctccctaactcatgctatggggccatcatcatcctgataccaaaacctggcatagatactacaagaaaagaaaacttcaggacaatatccctgatgaacatcgatgcaaaaattctcaacaaaatattggcaacccacattccaatagcaccaaccaaaaggatttatcccgnccggcccgggcgccggtgggcttcacgcctggtaaatncccaacactttttgaaaaaggncccaaggccgggcccggaatcaacg

SEQ ID NO: 716528 - DNA, 469 bp, Homo sapiens
  misc_feature (38)..(38): n is a, c, g, or t
attggttattagttccagtattccttggagtgcaaacncaggagatagaattgctcagctgttgttattaccttatgtaatagtagaaaaaagtacagtaaaaagagaaagtggttttggcagtactgacagtgaaggaaaagcagcctattgagtaaatcaagcttctaaaaacagacctgtgtgcacaatgattcagggaaaacagtttgaaggactggtagacacaggtgctaatatttcaattatagctctaaatcagtggccaaaagcgtggccccgacaaaaggcttctatgggcttgattggagtaggcacagcatctgaagtctatcaaagtgctacaattttacatcgtttaagaccagatgggcaggaagtcaccatccaacctatgattactttcattcccattaatttgtaggggagagatttgttacagcaatggggtacagaaatctctccccta

SEQ ID NO: 716529 - DNA, 142 bp, Homo sapiens
aaggcagggttcagacaagatagctagggtagcaaggggctaggcggagagggaggtctagagaagtagactatattttattttatataaaaggacagagatactacacgctagcctacccaggctaggagtcgcgtgtgga

SEQ ID NO: 716530 - DNA, 236 bp, Homo sapiens
tgttgtttgtgcttttggtgtcacatctaagaatctattgccaaatccatggtcatgaagatttactcctgttttcatttaaaagttttatagtttcagttcctacatttagggtattgatccatttttagttcatttttgtatatggtgtgaggtaagggttcaacttctttctctggcatgtgtcccaggtgactttttcccattgtctcagcaccaattgttgaaaagaggta

SEQ ID NO: 716531 - DNA, 1543 bp, Homo sapiens
  misc_feature (876)..(876): n is a, c, g, or t
  misc_feature (1133)..(1133): n is a, c, g, or t
gtactccaccaggtttcccgtaacgagggccacgagctgtcgccatacggttgccgggaaaggcccgttgcgagatatgagtgtaagcagggttactcactccatgtgctgcagtcccggatgaggcggcggctcgtcctcagtgcttgatcgataaggacacagtgcgggagcgagagcacgacgcatgcgtgcctgaagaatcctgtcccacatggtactgtctatgagcaccagactgcgattatgcaattgggcgcagccaaagagctagcatgcgcgactaacgacgaggtccggagaagccagtcgaagcagtgcgtattcagtcttttgggaagagccacttgtgagtggcccctctaaatcagggcgcgtgattccacaagttgttggctagcgtcgcccaagagaacttggcttcatcaaatcccagcatcgcattgcattacctacgtaggttttttcgcttcctccgtgccccgaggacttctttgggtcgaccttgcggagggggcttttcccttgtgttgcagagggaggcgtacccccttttcccataccccacggcacacctagaggataccgcccgcattttacttcagccggggtccccttgctataccttcccagcgtttggccgcgttcccccgaatggacgctttcttcgggggcactcagaccaatgcttaagggaaaccctgcacacccatggtggcctttctcccacacccttttgtctgtggcggtaagaacctaagggggcttgggaccctccccatttttgccatttatacccggtgttgaagctgcggcaccacgcctcttcgggccactttacatggactcccttttacgcgcggcgcgcgccacttnccgcgagggcttatggcgtcttcaccacacattcactggcgcttttccgaaaacacctttctagggaacgcgccaacaaatctgaagcacaatcgccttgtaggcgcctgatcgcccacacttaaagaccccagaagattggtggctcacaccaatcggactccgcatataatgtcttgccgaacggctcatctcaggtgtccgcactttctgctcgtagccgtaatatcccgtctagcgcacatagccaccgtcanataccttttacaaatttagacccccaaagtcaatgtccgacggaaatgccgtatcctccttggctcacagacgctccatatccccgattgtgaccgcctatgtcgtgtggccgctatccctagttgcgtcatggcacgccacttcccgggtagggccacttattgcggcactcggcttacgccggggtccgcgccaccgtcttcgcccatagttgctcgaagttccgtattctcgacttgtattgtgcgtgtcgcttccatcagtgcgtgcagtccatttcatactgccacgaagccaacgtatttctcctctgtgtgccacccgcggtcgacgtttgtcccgcttccccagatattcttccccaacccatcctggcttgactttgcaggctcacacgggtcgcgctccg

SEQ ID NO: 716532 - DNA, 351 bp, Homo sapiens
ggcacgagaggaaatatacatcacattgaagagacacacagggccaacacattcaggatatgacaatatattaatggaggttaggaggctgagatacaatgggcaaggaacatgtgcatgaagtagatatatttaattagcgagcattatgaggaatcacagcaattcagtgaaagagtaatgatatgatcgttaattagagtgatgatcttcagaagcattaatctggcactgtgtacagaatagataggaatcaagaggaacctggaggtgtgaacacacagttgcgagaatgcaatgattgcacgtatttgctgagcactatgtatgtgatagattgtatttcgtccc

SEQ ID NO: 716533 - DNA, 866 bp, Homo sapiens
gggaactggaaaatgccgcgcacgtgaccggtggccagatactggggagattgcgcagtgtgatgagaaaccacaaggttaaaggcgacaaatggggacaaccggacccctagtgcacgtcacccgcgctcaaggggcctccctgtactcccagagggccccccgaggaagactgggtcacgaggcactacccagaaaagggttcccctacgaatggtgacaatacactccgcaacgtgggagaggccacaagtgaagcctgcgactatatgggtctgtgagggattacttacaacgtcagtcagagtcctcaaaaatactaataagcgaccaaacttttactccgacatctgatctaccctctccccgagaggaatgaggccgttccacaaaatccgtttaccccatataccccccctaaggatatctcgaacagtatactccctgtggacctattatcggaacacgcaaaactgggcaagatacttcctgtaggtctgctataccctctcttcgaacattctacacccagcttctggtacgccagaaacaatgagtctgagtcaaacccctcgtggatccccacgcaacaccaaagaagaatcttgccggcctctaccaacatagacaccatataaagattggggaagctcccctgcaaggaaacaattaaggttcaactctcttacaacaagtataaggtgttatgcagactcctttggatcccttatactggtgttaaacgagtatagtcacaaattgctccgcaccaaattcctcccctgcttgagctcccccccaagtaaaccgacctatgctttccacttttaacgcttcccattaaaaaccccacaacaaacaaaaca

SEQ ID NO: 716534 - DNA, 368 bp, Homo sapiens
agtctcatgtcgcaggctgagtgcagtgggcaatctggatcactgaactctgctcctgggttaagcgatctcctgctcagctcccgagtagctgagactgcaggcacctgccacacgcccagctaatttttgtatttttagtagggacgagtttcaccatgttggccaggatggtctcgatctcttgacctcgtgatccacccacctcggcctcccaaagtgctgggattacaggtgtgagctaccaagcccggccggtttttgttttgttttttttttttttggaaaagggtttccattttggtcacccaggttggattgctggggcagaatttgggttaagggaaccctccgcttccagggtccaa

SEQ ID NO: 716535 - DNA, 602 bp, Homo sapiens
  misc_feature (13)..(13): n is a, c, g, or t
  misc_feature (34)..(34): n is a, c, g, or t
  misc_feature (110)..(110): n is a, c, g, or t
tgaattcagtgcngaattcacactccagtctggnactccgggcgtcatttggttgtctttcaaaatgaaggtatacgtacttatgataggatttaaaaccagtacagacntcggcctttggttttattcatgatgggaattttcaaatactgtgtaaactgaaggtctgatcctcgcccttgtctggaattcccgcagattacccactgaagatgttaataatttccatgggccttccacaaacttccttggtaatcacaagctcagacctctgaatattccatacaagtgagatcccacttagatactattctgtattaattctttaagataggccaggcatggtggctcatgcgtgtaattccagcactttgggaggctgaggtgggaggatcacctgaggtcaagagttccagactagccaggccaacatggtgaaatcctgtcgctactaaagatacaaaagttggctgggcgtggtggcgggtgcctgtaatcccagctacagtcaggagaatcgcttgaacccaggaggtggtggttgcaatgagctgagattgtgccgctgcactccagcctgggcaacagagcgagactctgcc

SEQ ID NO: 716536 - DNA, 148 bp, Homo sapiens
  misc_feature (23)..(23): n is a, c, g, or t
  misc_feature (59)..(59): n is a, c, g, or t
  misc_feature (103)..(103): n is a, c, g, or t
  misc_feature (117)..(117): n is a, c, g, or t
gaaattagtaaaatatatttatnagatgttcttaactcctacagagaataacgtatgantagtaattatattcttgggaattaagccagagaaagttgaggantaaaagcttcagcntttttcaacattagtgaaaaaaatagtaata

SEQ ID NO: 716537 - DNA, 724 bp, Homo sapiens
ttcacgattcttgacatcgttgtaatctgttgctgccctgggtaactaattcgtagtaatagcctatatagctcaggaatctcttctgaaagcttcttaatcactagtgcctagacacgagaacgtaaaatcatcggattctgtgtagatatcaatgtatcatgtctgcatcgtctatcagtcgcatacgattctccatttacacatccatgtgccaacccatatgctgtcgaataagtggatccagaatctccatgtggatatcaaagtattgcaggcagtgccttagtagctcatccgatatgcccgcatggtttgcgatgagaaaatcgcttatcatcaagtctcaacaagttaaatacgttactgcatacagacttactcgatacggcactctgatggatttcgatcttacccatgtggcttatgagtctcctcacacacctggattccttggaccttactaggccattatgctggtgatgaactaaaccaaccagacagtcttaggtcctaaaacgttgcatacaggcgctgtttgccatgttctgggctgctaggactgttcctgccatggttcagtgggtatcaattgatccctgtgagagtggcaactttagagtacactacgagtcgatgaccctagaaccagcaggacatggtctagctatacaagctcagactctcgtccgaatcctctcacatggtggcttcaggaagatcc

SEQ ID NO: 716538 - DNA, 913 bp, Homo sapiens
tttgaccctgcctttatgtttactggcctcccccgtaataggagtgctttggagacctcttctcgcagtgtccctcattctaatccgtttgccctgctcttattcctataatatttggcctcttgtccctcaaatactagctcaggagggacgattcatctgcgcctcaggaaaagagggggtcacgcggactccgcgactcctggtccccccgcatgttgtgcgctcctccgacacctggggtttccccccgaagctgccttgtttggtgtctccccgcctccttacccgcgttctccttcatagctctgttccggagtgtgggaacattctaacatcccgttttctaggcagatcccccacaacacttggtggagagtttaactccctgctttagttctcataagaggagttcttttcctcccaccccgtcgggcaccacaagggcaaggacgctcccacaacacggttggagaagacaaccaatcgtacagtaaaaaattattgtgtccagagtcgacaccttggtacttacaccacgtctcgtcggtgttgccacacgtgcgagtgcccaaccttgcgagttttattcaatgaccgcagcattgcggtgagagctatccaactctcggagatagactcaggaggggaccaacatcttcgctcccgaagtagttatttcggacccctcttcaagtcctcgccgcggctgggatcatcagactcccccctccccacgcaggagtgaagaggcgagacggtcccggcaggaattcacagagcctcccctatgggaagatctccccccaatctcttgagcacggccccaaaaatccctcttcttcctgtggcgaaatttaaaaccaagcaagaagagccgcccccaatttttaaattgagacccacaaaaaca

SEQ ID NO: 716539 - DNA, 449 bp, Homo sapiens
  misc_feature (431)..(431): n is a, c, g, or t
tgagatggagtcttgatctgtcgcccaggctggaatgtagtggcgcgacctcagctcactgcaacctccaccttctgggttcaagcaattctcctgcctcagcctcctgagtggctgggactacaggtgcacgccatcacacccggctaatttttgtattttagtagagacggggtttcaccatgttggccaggacggtctcgatatcctgacctcatgatccatcaactcagccttccaaagtgcagggattacaggcgtgccaaccgcgcccggccaagaaactgatttttttttaaggcacccccactgcgactatactggcccaggtgattaacttcagcaccaggtggtaacactggaaattggttcccagttgctccaagtttccagttagggtccttatgatttgaaggataaaatgtgaaatngggttcactattagttca

SEQ ID NO: 716540 - DNA, 997 bp, Homo sapiens
  misc_feature (104)..(105): n is a, c, g, or t
  misc_feature (140)..(140): n is a, c, g, or t
gtgccgctggcaaccagcacaccccggcacctcctctgcggcagctgcgcctcgcaagcgcagtgccgcagcgcactgccggagtggctgtagcttgccctggnngctggcgcctgccctgcgctgggctgtgggctgcngggcttgtgcccccgctgctggccagctctgcacggctgctgggctctgctggctgccctggtgctctgcaacgcttgcgtgcgtggctggcattgggataactgcggccatggttgcgcctgagatctgcctccggcaggattgacgggccgttggttggggttccagtgtgtggtgcttgcttggcctgttgcccgctgctatgcttgctgtaccttgcacatccgcaccccctcagctctcccctgcccttcactcatggaagtcttcaggcaagtttttcacttacaagggactgcgtatcttctaccaagactctgtgggtgtggttggaagtccagagatagttgtgcttttacacggttttccaagatccagctacgacttgtacaagatttgggaaggtctgaccttgaggttacatcgggtgattggccttgatttcttaggctttggttcagtgacaaaactgagaccaatcactattccatattttgagcaggccagcatcgtgggaagcggcttttgcgggcatctgggggctccagaaccggaggatcacacttctttctcatgactatggcagcatactggtggcccaggaagcttctctacagcttccaacgccgaattggactggggcgcgcttaccataaaacgtctctagcgttgtcacaattcgaggaacttattcctggagaactctacggtccactcatttctcaagaaggtaactcaaaaattgcgcgttggtctgaccccgacttttacaccgactgtatgacacccttgtgcattcactcaagagtctacccacaagtatgggacgcaataacagcgccttttataatacgct

SEQ ID NO: 716541 - DNA, 299 bp, Homo sapiens
  misc_feature (29)..(29): n is a, c, g, or t
  misc_feature (53)..(53): n is a, c, g, or t
  misc_feature (73)..(73): n is a, c, g, or t
  misc_feature (247)..(247): n is a, c, g, or t
caccccccaatccctctcttgaaacttanaaccagtgggaatataggaaaggnaaccaaatttcattaattanttgttctcccccattacccccctgaatgaatggccatacaggctagctgaataaatacaaagttgaaaggaccaatccagccccttttataggattttgaaatgttttgcaaatgaattggtccctgtggtgtattttggaacccttttcctgggcttcagctcccctacttcntgtatgtggatgcatactgtagctaaccattaaagtcatgacacacaaaaaa

SEQ ID NO: 716542 - DNA, 282 bp, Homo sapiens
gctttgccagcccctgttcatccaagttttaagtcctcccccctgttttaaaagactgttccaacggctttgggcctcagtggtcacttgacccccattgtttcaaaactgccccctttgtgtgtgtcacatgctgcctgagtcacacggacattttatttttgcctctagttttgtaagctcctggagggcggataacatcttatactacttttgtattttcatggcccctagtgcagtgctgggcccaaagtaggtgctccataaaaacctgttgaatta

SEQ ID NO: 716543 - DNA, 253 bp, Homo sapiens
ggtgaatcccataatcgctgtgtatactcagtatctttgtgtagtaccaaaggcggatgtgatcatctgaggtcaggagtacgagaccagcctagctaacatgacgaaaccgccgtctctactaaaaatacacaatcagccgggcatggtggctactcgggaggttggccctgaggcagaagaatcgcctgaacctgggaggtggaggttgcagtgagccgagatcgcaccaatgttactcagcctgggttga

SEQ ID NO: 716544 - DNA, 192 bp, Homo sapiens
ggaaccccgaaagctgagggacggaggtcagtgactcttggggtcttggggaccccgagacgaaggaaggcaacctttttccttaagagggagtatcccgtttcttggcaattattccattgaggtttctcttacctcttaacaaaggacacaggagagaggtgtgtccccaacgagaaagcacttttgggg

SEQ ID NO: 716545 - DNA, 377 bp, Homo sapiens
cctaccggacccccacataaattcttctccttctaatcctgacaattattgacctggacaaacctaattaactcttaggtgctggaactcaagtgaatgctactgcccaagtgaggctgactgggtctcactttaaatggatcacaaatattgagccctcagcaagtctatcaatccttttacatttttcctaagttagctctcctatacctacctcatctctgaaggttctccctcactcttgaggtgatgaccttcagaaatgagatgttgccaggaacatctcatttcttgtggagttatatcacaagtatccattccgtgttacctattgcaagagatgagatgttgggaggcgaaatgagatgttggacggc

SEQ ID NO: 716546 - DNA, 887 bp, Homo sapiens
gaggcgcggcgagggcgccagatggctgagagctacgcaaggaaaactcaggacccatgatggctcagtttcccaacagctatgaatggcagggccaaacatgtgggctattacctctgacgaacgtactacgcatgacaggcagtttgataacctcaaaccttcaggaggttacataacaggtgatcaagcacgtaatatttttcctacaactcaggtctgccggcccctgttctcgctgcacctatgggcttaatcagacctaaacaaggactgggacagactggctcagcaagagttctccatagcctatgacacctcatcaacactgaagcttcaaggccaacagctgcctgtgagtactcactcctatcatgaagcaaacccctatgatatctccatataatttctgctcgatacaggaatgccgaacgcactgcccaatactgtccatccctccagccattgcctccagctgcacctcataacatcatagtccttctgcgactccagggaccaaccttcctccccttaactgatgccaatcccctaagtgctttctggcagcaaatcatcattaccacatggaaccgccagtctcattcaagccttacccattctttatacttactcacacacttggcctccatggagtcatcctaaaacgccggaatgatgcgcacgactccgtcacgctgctcagctttcgccgaaaggcgcgcttctgcattgcactctagcaaacttaataagaccaaccactcctcgaaagggttcaccatcatcgggcccttccaccattcatggcacctcatcatgtgaaaaatctcaaacctcccccgactcccccttcggctcaattccaaactctgtccacagataaaccg

SEQ ID NO: 716547 - DNA, 429 bp, Homo sapiens
gtcctctgaggatcccgcgcgttgtgtttacgtctgtatcccagcactttaggaggcaaggcgggtggatcacttgaggttcaggagttcaagacgagactgggcaacatggtgaagtcccatgtctatgaaaaatttaaaaagtaagctgggtatggctgggcacggtgactcatgtctgtaatctcagcactttgggagggcaagttgggtggatcacttgaggtcaggagtttgagaccagcctggtcaaaatggtgaacacccgtctctactaaaaatgcaaaaacttacctggccgtggtagcgagcacctgtaattgcaggcacaagaactgcttgaactcgggaagtagaggttgtcatgaagcccagatctcacgcattgcattccaacctgggtgatggagttagactatctcacaacat

SEQ ID NO: 716548 - DNA, 868 bp, Homo sapiens
gctagatcgaatcgcggtgcgcacgaaggagtaggtggtgtgatctcaccgtgagtccggatcagcctttattctgccttggttgattgagcgcattgcgcaatacgaaatggctggcgggtaaggctggaaagggactccggaaaggccaatacaaatggtggctgttcccgctcgcagtacgtaatcaggatttgcgatgtatccgcaggtggtcccgttatttacatcggagcccctaaacactgctaggacgaccagtcaatggaaccggtgtggggcgcgacttggccggctgttgttaccggcgcagcccatcctggaagttaccctcacccgcggaggtactttgaacctggcaggaaatgcattcaaaagacttaaaggtaaagcgtattacccctcgttcactgtgcaacttgtgctatccgtggagatgaagaactgggatcctctcatcaaggctacaattgtgctggtggtggtgtcattccacacatccacaaatctctgatgtgcgacgacagcggacaccagaagactgtctaaaggatgcctgatccctttgtattctcaggactcctaaatactctaaccagctgtccagtgtttggtgatcccagtgcactgtattctctgtgaaaaacacaatttgtgccttttgtgtaattctatttgaaccaagtgggaaggttacttaagttccaaccaaccaattctgcttcgagttcttaccatatttaggtgtctgtggttccaaaactattgttctgagagggttgagagtgcatgtcaaccccggtgtttatgggcgcgccacttcttccacattgttgtcgacattcccggggatcaagcttccccaaaa

SEQ ID NO: 716549 - DNA, 872 bp, Homo sapiens
ttatccctcacaatcatgggaagccacgcctaattatccagtgaaccactatcacgaatgaaaactctacctctctatactaatctccctactagtctctttatttataacatgcacatgccacagaactaatcatattggatatcctcttcgaagcacatcacttaatgcccgaccttggtctagtcatcacccgtatgaggggaggcagcacagatacgtcgcgtgatgcgcaggcactgtacttcctattgctgaacaccctagtaggactctcttacgcagatactgatcggactaattgacacgcacaatacgctaggctcactaaatattgtattacgtcagtctcactgcgccgaagaaagtgatcgaaattgcaatgagccaatcacactgtaatatgatctagctttagtacaatagctttatatagtaaagatacctcttgacggtactccacttgtgactccctaaagcccagtgtcagaagcccccatcgctgggtcactggtacttgccgcagaagtcttgaatctaggcggctgatggtataagtacgcctgacattcattctgaatccccttgagaaagtgttataggctagggcgtttcattgtaggaatccctaatgaggcataattatgaacaggcgccattctgactacgacaaacgagacttaaaatcgctcatgggtaatctttaagcaggcagatagcctcgttgtgacaggcattctcttcaaaaccctgaagttacggggcgtttctcataatgcccaggatagatcccattaaatttgccggaataattggaagcccgcgggtaaatcccccgggggaaacttcccaattggggaaaaacggacctt

SEQ ID NO: 716550 - DNA, 730 bp, Homo sapiens
  misc_feature (24)..(24): n is a, c, g, or t
  misc_feature (64)..(64): n is a, c, g, or t
  misc_feature (66)..(67): n is a, c, g, or t
  misc_feature (70)..(70): n is a, c, g, or t
  misc_feature (79)..(79): n is a, c, g, or t
  misc_feature (96)..(96): n is a, c, g, or t
  misc_feature (98)..(98): n is a, c, g, or t
  misc_feature (111)..(111): n is a, c, g, or t
  misc_feature (116)..(116): n is a, c, g, or t
  misc_feature (119)..(119): n is a, c, g, or t
  misc_feature (126)..(130): n is a, c, g, or t
  misc_feature (136)..(136): n is a, c, g, or t
  misc_feature (140)..(142): n is a, c, g, or t
  misc_feature (151)..(152): n is a, c, g, or t
  misc_feature (154)..(154): n is a, c, g, or t
  misc_feature (164)..(164): n is a, c, g, or t
  misc_feature (172)..(174): n is a, c, g, or t
  misc_feature (184)..(185): n is a, c, g, or t
  misc_feature (189)..(189): n is a, c, g, or t
  misc_feature (208)..(208): n is a, c, g, or t
  misc_feature (217)..(217): n is a, c, g, or t
  misc_feature (341)..(341): n is a, c, g, or t
  misc_feature (355)..(355): n is a, c, g, or t
  misc_feature (661)..(661): n is a, c, g, or t
  misc_feature (701)..(701): n is a, c, g, or t
gcttccaccagtgggcctccatcnggttacttaacctacctgagacatggtattttcatttaananngcntagcatganatgaaattagtattaananaacagtaattacngttgnganaaaaaannnnncaagcnaacnnngggggcctnngncagaaagggntacttttnnntctataaagnnttanacattacaatattccctgnggatatgangtgttctctaaagcagagagaaatcctttatcgggatttctaggagattatttttttccttcagttcactttatttatttatcccaggcatagtacttttcttaatcttttaatcacattttgntatacttttttggnttcctcttcagtccctattgaaacaagttttctcttcatgcaatcatgaataaaccttactcatttctattcagtaatgtaagcattatcttttgtaacattaggataaattttagcatgcaaatgaactaaatagcaagggcaagagacaagataaggtgtctgttaataaataaatgacatgatgttaggtgaatggaaacagctgggagacctacttttaattttctcgttatctaaaaatcagaaaggccaaatgcatcaagtttactgataattcacttctgtttgctagccatgaatccntcatgtaaagagtggtattgatgacaagagcagtattgtnacctacaaaatgtacttggtactaatgta

SEQ ID NO: 716551 - DNA, 719 bp, Homo sapiens
tctgccttttaaattgagcatctgggccgggcatggtggctcacgcctgtaatcccagcactctgggaggtcgaggtgggtgggtcacctgaggttgggagttcgagaccagcccgaccaacatggtgaaaccccgtctctactaaaaatacagaaaattagctgggcatggtggtgtgtgcctgtaattccagctactcgggaggctgaggcaggaagaatcacttgaacccaggaggcggaggttgcagtgtgccaagatcataccactgcactccagccctggtgacagcagtagaccccgctctcaacaaacttgattgactcaattcagcactctgagggctgcaagctacagacaggaatctattctcagcagcggcatagggcacgcactggcttaacagttctagtatataaggctcaaatagtctatacctgcaactgctataagcaacggtcgatagcggaaagtgcggcactagcattgcttcagcacaagtgaaactgtgcagatctccaccgacagagcggacacacgatctgatccacaatgacgaacaccatcggcctcttgcaggtactcacagcctaaaagaaacttatcttccctggccaaagcaactatcaactgatttagcagtctcccacgtgtgtcaatgtttcaaccgtgtatcctaatgtctttccccggctgtaccaactgcccccacaaatct

SEQ ID NO: 716552 - DNA, 123 bp, Homo sapiens
cctggtgcagcatcactcatgaaatctggtaacttgtaccaggtaactggcaagggaaaaaggacgggggaggcatgcaatgagcgagaatccaaacaaacaagcttgaaattggcttagggg

SEQ ID NO: 716553 - DNA, 771 bp, Homo sapiens
tgtccaaaaagggtttgttttatggcaattattttaaagcgggtccctggggggagggaaagggggaggggaaggggggggggctcgggatatcaacgtggacaaatgtttggtacacctggagaagataatttggtggaaaaaaagacaaaacacagaaattcccttcaagatcactgaggcgccccgtgcacgcagcacaaaaggaccctatcgccccggaggttgccgccgccctctcttgcgcaccctctagtgctcaccttctcttgttgtgtaccctctcatcatctctctctcaattctctgtaaacaactagtgttactctataatatctccttcaccaaaactatcagagggggttctcacatactccccacatttcttggtcttgccacaacgcccccaagtacacctggtggtgggcggaggccaagacaaatggggcgtccacaccgggcgcagggacgcagacttcacctgggcgagcacggtgagagagagaccacaccacccaacaacacaccgagcacagcagggagacatatccatgggcaacagcagatggagggcccaaggcccccgcgccagacacgggccccccaggtccccccaaagaaccagcccggcaagggcgccaaaacatcggcacaaaaaattcaacgccactcacggtaacaacagacacaccatggaagccccccccgcgttgatacccacacaaatcgaacagcacgcatctccaacttagaccatcgacacacagtgac

SEQ ID NO: 716554 - DNA, 107 bp, Homo sapiens
cagagtgctcgggcggggacacacacttggtggcgctagacaatagtggggcaggtccttctctatcaccaggtgctcctccatgggtccgtagcgcttcaccacgc

SEQ ID NO: 716555 - DNA, 519 bp, Homo sapiens
ggtctgatgctgaattaactgcaatggctggagccgttacagtcgtggcatatggggtcagtgtcacctatactgcacattgtcatttttgaggcttatttccatactttattcagaatgggctatggagaacttacaggctggtggaaacatgcctgtcttctctgatcggcagataccctgacaccagaaggcatgatgtaaattaatcctgtcttttggcatggttcgtgcagtcattagtttggaatgcgctttgcttcgcatcaggccatggtttctagcggatatgctgtccgcagctggaggaggtaatcccgtacaaacttgtccccgaagcgcaagagcgatcatccgccagatctggtgggagagactgcagtggatggcagcgtatcgtaacggacggacagaaaatccttatggtgcgtgtccctatgtggtcagccctcatgacagacttgagaatctgggtcaagtatgcaagcctgtggcgagccacgagtgggaggctggctc

SEQ ID NO: 716556 - DNA, 346 bp, Homo sapiens
ctacttggcagtgtggtgtcaggcagagctatgatgtgtcattcaattttgtatccaggcaacatttgctgaattattttatcagttctaggagcttcgttggaggagtcttctgggttttccaggtatcaatcatatcatcagcaaacagtgacagtttgacttcctctttaccaacttggatgcctttattctttctcttgtctgattgctctggctaggacttccagtactatgttgcagtggtgaaagtgggcatccttgtcttgttccaattctcagagggaatgctttcaacttttccccattcagtattatgttggctgtgcgtttaatcatctgacca

SEQ ID NO: 716557 - DNA, 1014 bp, Homo sapiens
ctgctcatgctattgtgaatctggttgaactgagcttgttagtgaatagatctctgctggcgtaggtctcactcgcattgctgatgtaccaatgccggtgtctaactctggatgggtcgcagtggtgagcaagttgctgttagtagcaccgagtgaaatgcgattcctgtagtttatacacatagtttgggttgtatcatctgtactcagtacaggtgcctttacgctatggatattatattgtgagtatctagatagtaaataacacgtaggtatagattgtttgcgatgcggcacgtggaggattgggaaagattagtgaggagttcggatgtatatcggtgggggacaaaaagtagtatgtctcgcggtgctgttgagactataagacattatatcgagatgagacctagttgatgcagtgtgtggctctctgtaatcattgcatgaacaatccagatccttaagagtggtccacttggggattgacgtgcaaagactacgaggtattgataagtcgaaccgtgaactagattagtttaaattgagaaatgaataatcacttctgtatgtggattcactcgttcggtatggcatgcgatcatagtcgtattctcgtcaaatgggggatgatgtagatagggttttggcttggtgatacatctgtggtggcccattagtttgaagcatttaacaaagtaattgggatgaccatctgtgcatggaaggtgagggaaaaagggcaaaggagggacacattcttggtggtgactgaatttgagggcgaggcccagtaggagattgtgtgttttgactaggtaatcgatttcacagaggctaagaaggtaagaaaggggagcggtccgtgagaattttggacaagtggggggggcctcggagtataggggcttaaggggcgtatggacagatgccgaaaaaaagggggcgagaacagcggttgaggcaacagaagccacgggggaaaaaaggggtatgggaatatattgaagcaga

SEQ ID NO: 716558 - DNA, 84 bp, Homo sapiens
  misc_feature (47)..(47): n is a, c, g, or t
tttagaggtgtcgtgtttactttttatttaggagtacaaactgaganaaaatcatccttccagttagtgaggttttgagggatc

SEQ ID NO: 716559 - DNA, 217 bp, Homo sapiens
ctgttatagcaccgtggtaaatatgtatgagcggagtatagggctgtgactagtatgttgacgtccctgtaatgctatggatgagtgatatttgatcagtgagaacgtggttactagcacagagagttctcccagtaagttcatacgtggggggtatcggcgatcgcttagctgaggcttgctcagaagtcatcacaaaagctattacgtggtgaga

SEQ ID NO: 716560 - DNA, 940 bp, Homo sapiens
gtagtcccagctattcaggaatattgcttgagtccagcttgggcaacatagcgagaccctatctaaaataacaataatatatagccatcccgcctggccatatattattgttattttagatagggtctcgcctgtaatcccagcactttgggaggctgaggcgggcagatcacttgaggccaggagttcaagaccagcccaaccaacatggtgaaaccctgtctccactgaaaatacataaaattagccgggtgcagtggtgaggcctgtaatcccagctactcaggaggctgaggcaggagaatcgcttgcacccaggaggtggaggctgcagtaagtcgagattgtgtcactgcactctagcctgggcgacagaaaaagaaaatttaggtggggaaaaaaatcagaattgcgtctgtgggaacaggaataaaggagaaaccactattgactgggaagacacacaaagaacttgtcaaagttgtatggctgaggcccacacggtggctcacttctgtaatcccatcactttgggaggcttaggcagaaggatcacctgagatcaggagttccagaccagcctggccaacatggcgaaaccccatctctactaaaaatacaaaaattagccgggcgtggtggttacgcctgttatccagcacttgggaggccagtgggcggatcacaagtccggagtcgagacagctggcatatggtgaaacccattctactaaatatagaatcagaaaaaaattagcagggtggtcatgatgcctgtatctagtacgggagtgggaggaatggtgaccgtgggagttgggacggaaatgggttccacgtgagggtggacttaaattaatataattttgaaattacgttcggaggtatataaaaagggatcggcgcagtggatagggggttgttatatagttacgggaaa

SEQ ID NO: 716561 - DNA, 130 bp, Homo sapiens
gtagcagcgagcacgttagcaccttcagtaccaggctggtagagagcccgagaggggggccggggggggcagtcaggaccctgcttcgctgcctgggccctttagatgccttctccaggccgtccaccac

SEQ ID NO: 716562 - DNA, 318 bp, Homo sapiens
gaaataccccagtcattttgcgggaaacataatgtgcaatggtgaatgatgcacctgaccagaatacacttgatgcctggaatgcacaggtatgcccacctgtccacgtcctggaattcccatgatcacaaggctgttcacgccaggtatcttaatagaccacctgcaccacagcaactgtacctgcccacagctcagttactaagcctctttccccagtgctggacaggctcaggcagctgtccaaggacctgttggtacagatttcaaacccttaaatagtacccctgcaacaactacagaacccccaaagcctac

SEQ ID NO: 716563 - DNA, 578 bp, Homo sapiens
atctcacctccaaagcttagaaaattaagcaaacccctaaaaaccacaaaacagaagggacaatcacaaaaaaaccctgacacaaaaccccccccgcccaacacaaaaaaaaccccacaccaaccccaaccagcccaactcaaaaaaaaaaaaaaaaacccggcaaaaaaacaaaaaaaaccgccatcacgcgcaacagcgggacactgccacaaacacaattccccacaaaaacacaaacagcaattctcaaaaatagacccccaccaatacaccaaaaaaaccccccaacaacaaaacacaaaaaacaccgtacaacccaccaccccgggtccagtaaacaaacaccaccaaaaatttgaacaaaataccgcacccacccaaagggcaaaccaccgcgcacccttcaaacacaaaaaagccccgcacaaacaacaggcagccacaccaaaaacacggcccccgagcagaaaacaaaatcggcacacaatcaaaacaaaaaacacccccacaacaaaaacaaaaacatcccgggcgccacaaacaagaaaaccccctaccaaaccccgcgcaaaaac

SEQ ID NO: 716564 - DNA, 137 bp, Homo sapiens
agactcgggaggggctgatatacgggcagaaagaatagtaatctagagacaataaatcttgggccaaaaactaagaaagagcttcatagagatggccagggtcttggctgggcatggcggctcacgcctataatccc

SEQ ID NO: 716565 - DNA, 139 bp, Homo sapiens
ggttgcagtgagctgagatcagtgccactgcactccagcctggcgacagagcgagactctgtctcagaaacaaaaagaacaaacctccccccggccaaaaaaaaccaaaaaacaaaaacagagtctgacacaggaagga

SEQ ID NO: 716566 - DNA, 109 bp, Homo sapiens
ctattgatcccaagcaaatcttagaattacttcatttaaatatactgagcggtattgaatacttcgaagcagaacatgcaatgtgcagcccttcatttatgacgaaaac

SEQ ID NO: 716567 - DNA, 212 bp, Homo sapiens
gttttaatttttccagcacgattcccctttggatgtatagcactccaaaagggttaggcctttatggctgtgcccaaaaatgagctttcttatactgtatatcatgccacttctggtctcgtcggagactacggagcttcctagcagtacgaagtccacaaacttgccatcctgtcggcgccacggcctgagcgaaagaggagggtgctcgt

SEQ ID NO: 716568 - DNA, 421 bp, Homo sapiens
ctggttaaaatgttcttttccccaaaggggccctagggccatgatttaaatatttttattacccttttgaaatggagaagcccttttgcataagcctttgaattcctgcccctttttacccccttttcctccccctcaaaggaaaaacatttcatcccagtaaggtaacggcattttctgtaggatttttttatgccctgccccctttgggcctcccctgcaaaaacagttccccccctgccaggagcatttgcatgtgggacttttcttttcccccagttgatattttttatatgatattttaaatactatagaaccccatttgtcagattcagtataaccccagattttgttacctgttttttaaaaaagcagattttgtcaaatcaaataaagatcaatggatgttggggataatcca

SEQ ID NO: 716569 - DNA, 399 bp, Homo sapiens
caggagtgagcctgcacttcgtgctctggggctgctgcaggtgtaccagcgcatgatcgacaaggcggaggatgtgtgcctgtcgtagcgcagcccgggaactggtggggcagctggcggtgctcactggctgaacctctcatcttcacactgcgagcccaacgcgatgcaccttcctgcggatctccaagtccgacttctatgagaatcatgcgcgcacagaccagtgtggttgctgagtgcggctgcacacggtggaaagcgcagtgatgtcgcccttcgtgcgccagaatggacttcgccatctgactgtgacctgccagttggtagcgctgtggacagcgcgcttgtacaggcagggcgacagatccgaacttgcaattaaatcgtgcatcaatt

SEQ ID NO: 716570 - DNA, 263 bp, Homo sapiens
  misc_feature (68)..(68): n is a, c, g, or t
ggctcccgggttcaagcaattcttcccacctcagcctcctgagtagctgagattacaggggcacacgnatcacacctggtaatttttccatttttgatagagacggggtttcaccatgttggccaggctggtcttgaactcctgacctcaggtcatccacctgcctcggcctcccaaagtgctgggattacaggtgtgagccaccttgcccaacttcgtgtctttattgaaaatacaaaaataggcccttctgtcgtcttctc

SEQ ID NO: 716571 - DNA, 86 bp, Homo sapiens
ttttggggggggggggcccccccttttggggggctttaaacccttgtttttgttggggggtcccctttaatggttttttttttgga

SEQ ID NO: 716572 - DNA, 209 bp, Homo sapiens
acttattacctcaattcttatttcccaaaatgtcacagatctcctaaatgtaattgcatacggtatctttcatgtatattccttcagatgctttgtagatctagctgaaatataaatcacaaattataaatcaaagtaatttggtcatatatagcaaaaagaaggctgtatactatgtaaagggcctcccaaagtagcagactgtactg

SEQ ID NO: 716573 - DNA, 189 bp, Homo sapiens
gactgatcttgagtacctggtagtcgcgatgtcatacataggatgatgctttggtaatcctgataacgtagtacttcccaactgcggaactgaaggacctggagggataccgaaatcctttgagagatccagagaggactgctattagatattaaagccataacctgtggtgctttccgtcctcgtctg

SEQ ID NO: 716574 - DNA, 379 bp, Homo sapiens
  misc_feature (46)..(46): n is a, c, g, or t
cccataggcttcaaatacccctgcctcaatgtgatacccccctccnggcctgaaggggccccatcctacccacacccattccccttagttttcccacgccctataatccctagcactttgggagaccccaggcgggaggattgattgaagacaagagttcaagaccagtctaggcaataaagagagaccttgtctctacaaaaaaaaaaacaaacgataaaaaaaaaaattagctcggagtggtgacacatgcctgtaatcccagctacttgggaggctgaggctggtggattgcctgagcccaaaagttggaggctgctgtgagccacaatcacgcgattgcactccagcctatgcgacagagtaaggccctgtctca

SEQ ID NO: 716575 - DNA, 174 bp, Homo sapiens
  misc_feature (170)..(170): n is a, c, g, or t
cgagtcggtaccggtcccatgcacagttacatcctaatctcatcactatcacagtccaaaagcaagctcagcacatttcacaacttccctgtcttccaactcccctctgttcccagtgaaccttcagcatcactaatgtagttgatgcttgccatcgtgctgctttctanaggc

SEQ ID NO: 716576 - DNA, 400 bp, Homo sapiens
aattcggcacgagggggatccgcagaagaaaacattaggtctggctcatgggcgtggcctcccccaggcccctcaggcagaaatttagaacaaggaatgggctcagagttctgcctcaactgcaccttttccgaggtctgcgagcaggggacgcatttggtctgggtttctgaaaagcgactcgggcacatcatgaagagggtctctagtttctaccaggagctaaacgtctcgtgactgctgcttccttggctattgttttaagctactgttaccttcttgtttgtgaagttgttcatttacttctcagggcgagctgggtacctgaaatttctcttgaaagaactcaagattttcctttattttcatgcttgggggtgggggataagactcctaagca

SEQ ID NO: 716577 - DNA, 249 bp, Homo sapiens
aactccccaggctccatcatctaaacgatattttgtttgtctagctacggtgctcacgttccgacggaacttgtacaggaggcatgcaccgcagtggtgaatacacatcgaccaggctaccatctttacgatatttggaggtcatcacggttctcacgtgtcgacggaacttgtaccagggaggcatgcaccgcagtggtgaatacacgtcgacctggaggcatagcatgcatagctcgggtaactgga

SEQ ID NO: 716578 - DNA, 173 bp, Homo sapiens
actgagcagctggcaggtaaaggcagctacacacccccacaacctcacacaggcaccccgggcgcagtcaggctgcagcacccagacccccgaggtcagtggaccgtcatagagatgactgggagcttcacagaaggtcaccgtgcgacccatgcagagccccctagcctcag

SEQ ID NO: 716579 - DNA, 222 bp, Homo sapiens
cggggggccccccccccctgtttttttcccccctttaaaggcccgggggcggtccccccccccggttttttctttggggggggggggggggcgtttttttccccgggggcccgttttcccctttggccctttttgggggcccttttaaccccggtttttcccaaaagcggggggggggggggccgggttttcccgggtttttttgccccccggggccccgga

SEQ ID NO: 716580 - DNA, 83 bp, Homo sapiens
taagatttcaaactgggttacacactgagataaggctgggttaagggccgaaatttaataaatctgtactgcaagtagacatt

SEQ ID NO: 716581 - DNA, 231 bp, Homo sapiens
cttgtgtgagatcacttgaggttaggagtcacgacagcctgcggagatggtgaaacgccatctctattaaaaatacaaaaagttagctaggcaaggtggcacacgcctgtagtcccagctactccagaggctgaggtgggagaatcgcttaaacccaggaggcagaggttgcagtgaacctagatcacaccactgcactccagcctggacaacacagcaagactccatagc

SEQ ID NO: 716582 - DNA, 170 bp, Homo sapiens
acaaccggcacactctaaacttatcaggtgacatgctgtctcataatcaaatacttcatcataggctgaacataattcattcaaaagcagcaaagtttccccctccctttcttcatttcaaacaaacaccaacacagcagtcagttttcattctggcaggcggcatcctc

SEQ ID NO: 716583 - DNA, 117 bp, Homo sapiens
ggtggtacagagcaatgttggatatgtttcagagcccttgttccagctcttgggacattatagtcaacacagtgtcctgctcgttgcatcttcaaccagtggaaatcatgaacctat

SEQ ID NO: 716584 - DNA, 527 bp, Homo sapiens
ttcaccaggacagatcgacatgaatggagccatcacacttgggacctgccctctttaggacaggggcccaaccccaactcaagatttgcacagatcagaacaacgctgacttcttacgaggaaacacagtttaatttctgcttttcccatataaaagtagggagcagccagttagtgcaacaggtccctttctgggaaagcaaagaacggagatgggatctacccgccgtggcatcttcatgcacttcttaggcacaattcgcatttgcggaaaagctcggagttgccttcatcgcctctgagccacccaccgccctgtctcagtgggccgcatggccaccctcacgctgcttcccgagcctcctcagggctgcctggcggcaccggccggaacagcacagccatattctcgtgtccaggtgcacgtgcctggccctcaccactgtgtggactcaggtcggctccactctcccgccccggttatttctgtgcatttttagcatttgtgtcacctcggggtgactgtg

SEQ ID NO: 716585 - DNA, 396 bp, Homo sapiens
agaaaacttttaagagatatttgcatattctctgccttgttcttatcaacttgaaatgttggcattttctaaccttggttttgttggctacaataattcagtattcatgtcaaaatttctgtgcccatttcaaagaatgatatttaacactatttattattattattatttttagagacagggtctctgtgtcaccccaggctggattgcagtggcacaatcctagctcactgtaacctcgaactcctgggctcacgtgatccccccatctcagcctcccaagtagctggaaccacaggcatgcaccatcatgcccagctaatttttgtattttttgcagaggcagggtctcacctgttgcccatactggtcttgatttctgtgcccatatacagg

SEQ ID NO: 716586 - DNA, 241 bp, Homo sapiens
ggatcccccgaggagtaagtcccattgtattttgactcacagttaaaccatgaaattcacgcatcaacactcacttagacataattcatctcaggacaggtaacgggtgtacaataaaactccccctgccctcaaaatatggcagcttggattgtgggcaaaaaaaatgaaacaataaataacttaacatctttaatcattaagctcacaaattatttaaaattcatttaaatcccagtgt

SEQ ID NO: 716587 - DNA, 838 bp, Homo sapiens
tggtgccacagcaaaacctgtagtacatgatacagtgtgctttccctcctccttttccttccatatatattatgttttgttaaggggcatgcattactttaacgaattttaaagaatctctaaaattagttctgaaggatgttctgagggccagacgattagaagttagtgagtcgtgtggttgctggttgtactttcctatttagaagacagacgcgtctgacagttgttgtgtagcttcatgccgttcccccagtaactaacccatgaacagtacaccccttttatctgacttgtggataatgaccttaaaaatgttaggaaatgggccgggcgcggtggctcgtgcctgtagtcccagcactttgtggcagggccgaggcgagtggatcatgaggtcgggagatcgagagcatcctggtcaacatggtgaaacccgactctactaaaaaaaatacaaaaatgggcgggcgtgttggcgggcgcctgtggtcccagctgcttgggaggctgaggcaggagaatcacctgaaatccaggaggcggaggttcgcggtgaagccagacgattggcgcccactggcacctcccaggcctggggcgaacgaagcgagactcccgtccccaaaaatatagaatacatcaaagcaacacaacaacgaactgttcgggctttcaggccctgaagaaagctctaaaaccacttgtggagacgaggccaaggatatgaaaaatggaagggggccagaggaccgcggcacacaacgggggggtctccccaaaaaaggccggggcacgcttctacaatctccgggtcggggcaggcttcaacgggaca

SEQ ID NO: 716588 - DNA, 807 bp, Homo sapiens
  misc_feature (3)..(3): n is a, c, g, or t
cgnggagcgcagagcggtttggtcgttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggaagatcgcgcaggatttcaaaaccgacctgaggtttcagagcgcagccatcggtgcgctgcaggaggctagcgaagcgtacctggtgggtctgttcgaagataccaacctgtgtgcccatccacgctaagagagtcaccatcatgcccaaaagacatccagttggctcgccggataccggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctagagaaggaggcctgtccgtaagactacagttggtaatttggggatggggatccttctgcttttatggagcaattcctgtatatgactagtgg

SEQ ID NO: 716589 - DNA, 343 bp, Homo sapiens
gacacagacagaaagttcaagtgaggctggattgatgtggccacaagccaggagtccctggtcgaccaagagctggaagaggcaggaaggaccctttatctccaagtctcagagggagcatggctctgctgacaccttgattttgaacttccagcctcggaactgtgagactatatatttctattttaagccacccagtttatggaaatttttatggcagccctaaaaaactaatacaatcgtacttctgataatataaaaatgcatcctcaggataaaaataatctcattataaaaatacacataagtacaaaaaataaagaagagattaaaaatcttcaaa

SEQ ID NO: 716590 - DNA, 1179 bp, Homo sapiens
  misc_feature (256)..(256): n is a, c, g, or t
ctcttgggtttttgtttgttttgtgtgtgttttttgtgtttttgttctttgttctttttgttcttgttgttgttttatgttctgtgtttctcttgttgctatatgttcttgatattgttcctggtagtagccttagagtgctgaagagagaagaggagcgacgcgggagcgagagtgacgtgtagcttctgattcatgtgagcacgcgcgctgcacagtcacacacaactctaccgggtgactagcgggccccttnaaccgagcctttcccccccctttcctctgataccgcctgtgtcatcccagatccgatgacgccggtggtcccctccgccccacctcgggtttccccgccccctgcctcttctgttgaggacttttttgtgcttttcgcttttggcccctggtgctaacccagagtcctcacccggggttttccatgaccatggtgggcaccgttcccagtttcgcctatctctttttgctgattcacattttgtcccaaaccaacccctctctttggacccgccattggaaaagggaaccatctggtatctgaagtatcattgcccttgaggaagaagaccatgctcttaccgggcgtccaatctttgaggtcacgagaagagaatgcccttttagaacgccaaatctacctcccaacccagacccacttgtttcttgaacttgccctgttttggcccttagctgccttataaacgttttaccacgccaccctttggaatgccctagttttacccaatgcacgcgtgtgtttcccttgccctttttgcacctttggtgaatttaacgtgcctccactaacctgagaactgtgccgagactcccccaaacgcatttatgtacttctcttctgaggatagcaagatagcctgtttctttctgaagagattacgcttactctctcctctgggaatactcgtggatattgaagatggctcctcgcctctttcaccgctggggaatacagctgaagatgttttagaaactgctgcccagcaccaaacccgaacttcccgatggggtggtccaataggagagcaccttcagagggaagagaccatttccacaagaatcgccccccactataccttccggatgaatatttttctttttgccctcttttgggataaataattttcccccctttctatggga

SEQ ID NO: 716591 - DNA, 801 bp, Homo sapiens
  misc_feature (3)..(3): n is a, c, g, or t
cgnggagcgcagagcggtttggtcgttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcaatcggctaacaagggccccggggaaccggtggacagcattcgacgcagcattccggtcagtaaatcaaggcaaagttcagaacctggagctaggttcaattccaggggaaagcctggcccctttccaagaaagatttagaggtggaagagggaagaatccaggaaccaaggagaaattctccaaaaaaaaccccaggaatcttgggaaaaggttatcccgagtaggccggccaagccccaaatcgcaggagatcgagccagacttggcaacggagagaaagggaataaaagccaggcacaacagacgtagaaataaccccattgtgggacagtagaacaaaacagtatgagtacacaaaaaaagaggacaatttttacacgaaaaaaacccccgggggtcgtggtgtgtaacgcccccaatattccccacaaaaaacggctcactaatagagagggatagcgcagcagggctattcacaacacacacaaatatcgctagagtgggcgccccacaaagagaagggggaacaaatatttgcccagag

SEQ ID NO: 716592 - DNA, 405 bp, Homo sapiens
gatcatcttgaggtcaggagtttgagaccagactggccaatgtggcgaaaccccgtctctactaaaaatacaaaaatagcaggacaggccgggcgcggtggctcacgcctgtaatcctagcactttgggaggccgacgcgggcggatcacgaggccaggagatcgagaccatcctgactaacacagtgaaaccacatctctactaaaaatacaaaaaaattagccaggcgtgttggcggacggcctgcagtcccagctacttgggaggctgaggcaggagaatggcgtgaaacccgggaggcagagcttgcagttgagcaagatcgcgccactgcacttccaagttcatatcaagtaacattggggtaaccgaagctcgaaattccgtaatccatggtcattagc

SEQ ID NO: 716593 - DNA, 459 bp, Homo sapiens
cggcacgagctggagcagacgcctccaggatctgtcggcagctgctgttctgagggagagcagagaccatgtctgacatagaagaggtggtggaagagtacgaggaggaggagcaggaagaagcagctgttgaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaattagttgcaggcgctgattgaggctcactttgagacaggagaaagaggatgagcccgatgagaggctttctcaacatgatgcatttgggggt

SEQ ID NO: 716594 - DNA, 644 bp, Homo sapiens
  misc_feature (3)..(3): n is a, c, g, or t
cgnggagcgcagagcggtttggtcgttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgctggaacagacctgtaatccctagactttggccggccgctgatcgcgaagctgcccttccagaggttggtgagggaagatcgcgcaggatttcaaaaccgacctgaggtttcagagcgcagccatcggtgcgctgcaggaggctagcgaagcgtacctggtgggtctgttcgaagataccaacctgtgtgcccatccacgctaagagagtcaccatcatgcccaaaagacatccagttggctcgccggataccggggagagagagcttaagtgaaggcagtttttatggcacattggcctcatacggacttattggcccaaggcccttatgcctaactagggacgttcccgcggctgtccccg

SEQ ID NO: 716595 - DNA, 471 bp, Homo sapiens
  misc_feature (223)..(223): n is a, c, g, or t
cggcacgagctggagcagacgcctccaggatctgtcggcagctgctgttctgagggagagcagagaccatgtctgacatagaagaggtggtggaagagtacgaggaggaggagcaggaagaagcagctgttgaagaagaggaggacttgagagaggacgaagacgagcaggaggaggcagcggaagaggattcttaagcagaggcttagacccaggagaccanggcagaagaagattaagaagaagaggcagactgagcgggaaaagaagaagaagattctggcttagaaggaggaaggttctggccattaccaccttaattaagatcaacttagggagaaggccaaggagctttggcaaacatctataacttggaggcgaaaagttcacctccagagagttcagcagcgaattttagatcattttctccaacaggatcacgataccagaagtctccaacccgcggaggct

SEQ ID NO: 716596 - DNA, 750 bp, Homo sapiens
ctcgttgttcggttcaagcaattctgctctcagccttcctgtgtgcctgggacagcgggcgtgcaccaccacacacggctaatttttgtatttttattagagacagggtttcaccatgttggtcaggctggtcttgagctcctgacctcatgatctgctcatacctgtaatagccgcactttgagaggctgaggaggacagattaatttgccgtcagtaggttgaagactagactgtacaggatggtgaacgtggggcttatgagattcgtccggacatgatggcatgtgcctggaattccagctactgtgcttccagaggttggtgagggaagatcgcgcaggatttcaaaaccgacctgaggtttcagagcgcagccatcggtgcgctgcaggaggctagcgaagcgtacctggtgggtctgttcgaagataccaacctgtgtgcccatccacgctaagagagtcaccatcatgcccaaaagacatccagttggctcgccggataccggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctctccctggagcgctctttgcttaaggagtatcacgtgcccacatatgtttctggttgcgtcc

SEQ ID NO: 716597 - DNA, 282 bp, Homo sapiens
atcgtggtgctgatatggcttggatgggcttagagatgtcagctggagtgagtctgaaataatgtacttgtgggcttcagtgtgcccggctgcacaactgcatttcgtgggtaatttatttcctttgaaatggattctcatggaactccagccggggcacctttgaccactgattgaccaaaactcggtctgaaacccgggcacctcggaaagccgaggcaggcagaattcactcgcggtatagcagcaccaagattccgcgggggactcctctagagtcac

SEQ ID NO: 716598 - DNA, 489 bp, Homo sapiens
cggcacgagctggagcagacgcctccaggatctgtcggcagctgctgttctgagggagagcagagaccatgtctgacatagaagaggtggtggaagagtacgaggaggaggagcaggaagaagcagctgttgaagaagaggaggacttgagagaggacgaagacgagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaattagttgcaggcgctgattgaggctcactttgagacaggagaaagaggatgagcccgatgagaggctttctcaacatgatgcatttgggggt

SEQ ID NO: 716599 - DNA, 397 bp, Homo sapiens
  misc_feature (3)..(3): n is a, c, g, or t
cgnggagcgcagagcggtttggtcgttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctgcgcacggccgccagggcgctctctctaccgccggggcgaagaaccctcatcgctacaggcccgggaccgtggcgcttcgagagattcgtcgttatcagaagtcgaccgagctgctcatccggaagctgcccctctccctgctccccccccgacccgccaccacctccacccaccccccttcccacgcgccccccccc

SEQ ID NO: 716600 - DNA, 1753 bp, Homo sapiens
  misc_feature (3)..(3): n is a, c, g, or t
  misc_feature (1306)..(1306): n is a, c, g, or t
  misc_feature (1693)..(1693): n is a, c, g, or t
  misc_feature (1695)..(1695): n is a, c, g, or t
cgnggagcgcagagcggtttggtcgttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggaagatcgcgcaggatttcaaaaccgacctgaggtttcagagcgcagccatcggtgcgctgcaggaggctagcgaagcgtacctggtgggtctgttcgaagataccaacctgtgtgcccatccacgctaagagagtcaccatcatgcccaaaagacatccagttggctcgccggataccggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacgggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatatggtagtatcaacatttttaaattaaatggttttacattcacaagtggtgggggagtctggtcattaaggtgtggtgtaatttagagtccagttgggttttcttctgactgcactgggtctcatagtagtaaaaggctatgcgcatttatacctggcataagtcctcattctaccacatgttaaccctctagctgataatgcaaacactaacggggggatttnatttataagggctctagaaaaaacgagttattcacaccagcatcatcttaactaacattctgaactagttagtgcagcttttcatggtgttgtgtggttggtctcataactaggttgagtttttctcctctgctgaggaaacagtaccgaagttctttttcttgtggcatttgtattataaaaacttggtgtgggggaggagcacaaaactccagcccattgaacctctgccaattaagatggtgttgggttaggttacatctggttactgtcctgggaaaatcattttatagagatggccttccaagtggttttaaaatttactgaagtttttaggtcaattatgtatgttgactaaatttacaaataaacttgtttatccaacananaaacaaaaaaggcaagaaacaaaaaaaaacggcaacacacacgagggggggggccaac

SEQ ID NO: 716601 - DNA, 1798 bp, Homo sapiens
  misc_feature (3)..(3): n is a, c, g, or t
  misc_feature (1306)..(1306): n is a, c, g, or t
  misc_feature (1738)..(1738): n is a, c, g, or t
  misc_feature (1740)..(1740): n is a, c, g, or t
cgnggagcgcagagcggtttggtcgttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggaagatcgcgcaggatttcaaaaccgacctgaggtttcagagcgcagccatcggtgcgctgcaggaggctagcgaagcgtacctggtgggtctgttcgaagataccaacctgtgtgcccatccacgctaagagagtcaccatcatgcccaaaagacatccagttggctcgccggataccggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacgggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatatggtagtatcaacatttttaaattaaatggttttacattcacaagtggtgggggagtctggtcattaaggtgtggtgtaatttagagtccagttgggttttcttctgactgcactgggtctcatagtagtaaaaggctatgcgcatttatacctggcataagtcctcattctaccacatgttaaccctctagctgataatgcaaacactaacggggggatttnatttataagggctctagaaaaaacgagttattcacaccagcatcatcttaactaactagttcagaatgttagttaagatgatgctggtgtgaataactaacattctgaactagttagtgcagcttttcatggtgttgtgtggttggtctcataactaggttgagtttttctcctctgctgaggaaacagtaccgaagttctttttcttgtggcatttgtattataaaaacttggtgtgggggaggagcacaaaactccagcccattgaacctctgccaattaagatggtgttgggttaggttacatctggttactgtcctgggaaaatcattttatagagatggccttccaagtggttttaaaatttactgaagtttttaggtcaattatgtatgttgactaaatttacaaataaacttgtttatccaacananaaacaaaaaaggcaagaaacaaaaaaaaacggcaacacacacgagggggggggccaac

SEQ ID NO: 716602 - DNA, 1671 bp, Homo sapiens
  misc_feature (55)..(55): n is a, c, g, or t
  misc_feature (66)..(67): n is a, c, g, or t
  misc_feature (303)..(303): n is a, c, g, or t
  misc_feature (1224)..(1224): n is a, c, g, or t
  misc_feature (1611)..(1611): n is a, c, g, or t
  misc_feature (1613)..(1613): n is a, c, g, or t
aagagcctcatcgctacaggtaggtcggcggggaacaatggcccggcgtggccgntttgtgcggcnngtccgctcactcctcccctgctcgctacaggcccgggaccgtggcgcttcgagagattcgtcgttatcagaagtcgaccgagctgctcatccggaagctgcccttccagaggttggtgagggaagatcgcgcaggatttcaaaaccgacctgaggtttcagagcgcagccatcggtgcgctgcaggtaagacaaaggcctggagccgggggagggctgggcggtttccgctccccnagtgggattaatagtgcggctctcgtcctcaacaggaggctagcgaagcgtacctggtgggtctgttcgaagataccaacctgtgtgcccatccacgctaagagagtcaccatcatgcccaaaagacatccagttggctcgccggataccggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacgggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatatggtagtatcaacatttttaaattaaatggttttacattcacaagtggtgggggagtctggtcattaaggtgtggtgtaatttagagtccagttgggttttcttctgactgcactgggtctcatagtagtaaaaggctatgcgcatttatacctggcataagtcctcattctaccacatgttaaccctctagctgataatgcaaacactaacggggggatttnatttataagggctctagaaaaaacgagttattcacaccagcatcatcttaactaacattctgaactagttagtgcagcttttcatggtgttgtgtggttggtctcataactaggttgagtttttctcctctgctgaggaaacagtaccgaagttctttttcttgtggcatttgtattataaaaacttggtgtgggggaggagcacaaaactccagcccattgaacctctgccaattaagatggtgttgggttaggttacatctggttactgtcctgggaaaatcattttatagagatggccttccaagtggttttaaaatttactgaagtttttaggtcaattatgtatgttgactaaatttacaaataaacttgtttatccaacananaaacaaaaaaggcaagaaacaaaaaaaaacggcaacacacacgagggggggggccaac

SEQ ID NO: 716603 - DNA, 833 bp, Homo sapiens
  misc_feature (12)..(12): n is a, c, g, or t
  misc_feature (15)..(18): n is a, c, g, or t
  misc_feature (20)..(20): n is a, c, g, or t
  misc_feature (23)..(23): n is a, c, g, or t
  misc_feature (25)..(25): n is a, c, g, or t
  misc_feature (345)..(345): n is a, c, g, or t
  misc_feature (348)..(348): n is a, c, g, or t
  misc_feature (360)..(360): n is a, c, g, or t
  misc_feature (363)..(363): n is a, c, g, or t
  misc_feature (368)..(370): n is a, c, g, or t
  misc_feature (374)..(374): n is a, c, g, or t
  misc_feature (381)..(381): n is a, c, g, or t
  misc_feature (392)..(392): n is a, c, g, or t
  misc_feature (400)..(400): n is a, c, g, or t
  misc_feature (406)..(406): n is a, c, g, or t
  misc_feature (410)..(410): n is a, c, g, or t
  misc_feature (412)..(412): n is a, c, g, or t
  misc_feature (441)..(441): n is a, c, g, or t
  misc_feature (727)..(727): n is a, c, g, or t
tcggctaggtangannnngngtngncagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttngtngatgtggtagtnatnccggnnnggantccccanaaagccaggcntgacccgngacganctgntncaacaccaatgccacgattgtggccaccntgaccgctgcctgtgcccagcactgcccggaagccatgatctgcgtcattgccaatccggttaattccaccatccccatcacagcagaagttttcaaagaagcatggaagtgtacaaacccaacaaaatcttcggcgtgacgaccctggagcatctgttgagagccaaaactttggtttgcaagcttggaacgggtttggatcccaggtccgagtctaccgtccctgtcacttggttggccatgcttggggaagaacatcattcccctgatctctcagtgcacccncaaggttggacctttccccaggaccagtgacagactcactgggcggatcaggaggccggacggaggtggtcaaggtaaaagcggagcaggttctgtcaacctttca

SEQ ID NO: 716604 - DNA, 422 bp, Homo sapiens
  misc_feature (138)..(138): n is a, c, g, or t
  misc_feature (281)..(281): n is a, c, g, or t
  misc_feature (289)..(289): n is a, c, g, or t
  misc_feature (371)..(372): n is a, c, g, or t
tggttcagtgtatccgaaaatctagtgaccaaaagaaggaatgataggaggtgaagtctttcagcctcaataagaaggtgaagtgcactggaagccaattgaaggatttaagaaatggagtatctggccgggcgcagngtgtcacgcctgtaatcccagcactttgggaggccgaggtgggaggatcaagaggtcaggagatggagaccatcctggctaacatggtgaaaccccgtctctattcaaaataaaaaatttttttaaaaattagccaggcgtgntgcgggcncctgtagtcccagctactcgggaggctgaggcaggataatggcgtgaacccaggaggcagggcttgcagtgagccgagtacnngccactgcactccagcctgggcgacagaatgtcggtccgtctcaaaaaaa

SEQ ID NO: 716605 - DNA, 658 bp, Homo sapiens
  misc_feature (12)..(12): n is a, c, g, or t
  misc_feature (15)..(18): n is a, c, g, or t
  misc_feature (20)..(20): n is a, c, g, or t
  misc_feature (23)..(23): n is a, c, g, or t
  misc_feature (25)..(25): n is a, c, g, or t
tcggctaggtangannnngngtngncagctcctgtgcctgccagtcggtgcccctcccgctccagccatgctctccgccctcgcccggcctgccagcgctgctctccgccgcagcttcagcacctcggcccaggtatggccagacgaggggctggcctgcatggctggatggccccccgtgccctgggccactgtgctgtcccctgtgttctgctggtgcatgctctagaccactctccatgtgccatgccctggacctgcatggtgatgccctgtgcacttggcttggatgacttgtgagcgccctgtgggcatgtgccctgaacacttgtgccttgtgaaggttgcagagtggagatgaaaaagcctgtgtgtgaaaaatggtgtgtgctgatgggtaagtaccctgactcccaggtggacctgtggtcccatatttgatcatgtgagttcccccacaagtgtcgtcaccaagaatattgcccaagatgggaccccttggcttcgtattgggccattttgccaacctggcactttcgacaatggtggtcttgggcgacacaacccaatggggccttcatagcaattacgtaggaaaatggtaaaaagcgttacccagatttaatttatccttggcaaggcggattcccatttgtgc

SEQ ID NO: 716606 - DNA, 933 bp, Homo sapiens
  misc_feature (552)..(552): n is a, c, g, or t
tcaaaaatggtcgttggttgttgtatgcgcgtcgcaacgagagtaacaataaggttcgctgcttgaagaaaaagcgtgtgttagtatggcccccctaaagcccgggggtgtgcccgcccccactaagtgctccccacacatgttcgcgcacgggttgaaaacaccagcccggggttacaccacagcccgtgcgccaaaagaaggtcttcttaaagcaccgctttagaatgtgtgggcgccaccccacacgcatgtataaattgttgcgagggcaacaacccctctcctgctgtctgtcatcatttatatctttgcgtgagaaaggttctctgtggagtctctctccaacattatggtgtgagagagacttcgcccgttagttggcccccccagatcggaggtgtcttgtacaaagcgctggggtagatagcccaccggctagccacaatgtgggcttttacagagatattctcccacccagaggatagttcgataatttctccgaaaacacatatctctcccgcggcacttcaatgtctcttcaagtcgcgncccctgtattatctataaccccacagagaggcctccccacgtactcaccattattatttagccgcgcaccacccaccgccctcccttagttaaaatggaaggctatataatagcccccttcttttgtccgaaaatataatttacaatgtaccccctgaaagcagtctgccttattacaacctcttctcgagcacccccaccatgttgtatcatgcggttatccacccttggagctccccccgaacgctcttttttagtttttgaagcaatcacctccccttatttaacaacggtccctactttcctttttaactcttgcaaccacttctcctcttacaacgagacaccccgggaaccccattttaaaacccccccataaca

SEQ ID NO: 716607 - DNA, 219 bp, Homo sapiens
  misc_feature (64)..(64): n is a, c, g, or t
  misc_feature (78)..(78): n is a, c, g, or t
  misc_feature (80)..(80): n is a, c, g, or t
  misc_feature (87)..(87): n is a, c, g, or t
  misc_feature (90)..(90): n is a, c, g, or t
  misc_feature (95)..(96): n is a, c, g, or t
  misc_feature (101)..(101): n is a, c, g, or t
  misc_feature (140)..(140): n is a, c, g, or t
  misc_feature (142)..(142): n is a, c, g, or t
caggttctgacagctttacttgcgaagacaagtgcttcttttcacgactgttatttcacggtcntgacttggaatccncntgagctnaanatggnncctanatgcaatgacaggtgttcttgtaagagacaaaatagaananggaaaaggccatgtgaagctgcaggcagagccaaggaaggcctggaatcaccaggagctggaagagggagcgtgtcc

SEQ ID NO: 716608 - DNA, 702 bp, Homo sapiens
catggaccgaggtggctatgttggaggaagacgaggcgaccctcgacccctccgcagtacaccgctgagacacgaccaccgcaagtagtgtacatccgcacagtccacagactcatctctagcccttgctatgcctggccatcatcactcgatgccgatgatgccagcactacagaccatctctgtatttatagacaccatgctgtcctccgctctacctaccgtttctgcctgccacttaagcacttatgcgtatccctagtattcacaatttcctccactatcttcctgcatcctcgcccctcttttactattccataccacctcctccctactctatctcgcctagcgtctcactctgcactactctctaccctcttctccccttctttccttccctgtatcattctgctcctctcccttcctctacctttcagctcctcactcattactcccctctcccctcctcctatctcctcttccccccctccttccctcctctactctttctccctccttctctctcccctctttttctctcctcctcctccccacctcagtccgctcattatgcctacatctacttcccttccgccatttctctctcacactccctacttcttctcgctccctccatcccctcactcctgctacttcctcctatcctcctcctcctctctctttccccctctctctcccccg

SEQ ID NO: 716609 - DNA, 492 bp, Homo sapiens
ttataactcccaatcttgctcataaatatctactttattttctgtaatccttcttctcttctttatcttgcattgacaaggtctccccagcatcatgaactccacttttcaacttctgaggctcaaccttaactctgattcttaacttgctgtactttcttagatacaaatctcatgttcaatttgtaatacgtaatttatttaattttaaaatgttgtcaaatatgacaacatagtaatagttctgggtagtggtatatgatatttctttgaatattctatgtgtttttcatattttacagcatttttcaaaataaaaacaaaaattctagtaatccttattttatcaaattccatacagttttaaccttcctatagccattcaacgggtgccctgagtgagtgattcctttcttttcgacccttacatttgtagttttagatataattttctctattcagcagtaaattataatctaagctatttatctt

SEQ ID NO: 716610 - DNA, 113 bp, Homo sapiens
atccatagcagacaaaagcagaaaaaggcaaacgagaaagaacaggaactcaaggaactccaggatgtactatagacactacagagtacaaacctgagtacgtgaagtcccca

SEQ ID NO: 716611 - DNA, 203 bp, Homo sapiens
gtatgtactccatcagatagaatagctatagcacacacgatagtactacagcatgtatatagtcatataaacataacttctacatgccttaggaaaccaaaaacctagagtgactagctacatagagattagctctgtagtggatgtggagctgaaggtgcagtacctccaacgctttcctgtatgtagtagcctataccaaa

SEQ ID NO: 716612 - DNA, 396 bp, Homo sapiens
ctcgaactcctgacctcaggtgatccacctgcctcggcctcccaaagttctcggattacaggcttgagccactgcgcccggcctatttatttatttttgagacaggatcttgctctgtcacccaggctggagtgcagtggtgtagtcctggctcactgcggcctccgccttccgggctcaagtgatcctcccgcctcagcctcccaagtaactgggaccataggcttgtgtcaccatgcctggctagttttttgcgtttttagtagagacagggtctcactgtgttgcccaggctggtctcgaactcctgagctcaagccatctgcccaacctcgagccatccacaacagtggctaggcgacttacagcacatagccaccatgcctggtctcatac

SEQ ID NO: 716613 - DNA, 275 bp, Homo sapiens
ttttcttaccctactttttttttttaacagaaaatttccaacccctgaaagtagagaaaatagcataatgaacccggtatgctgtcagccatcctcagcaatcatcgggggagggccaatcttgggtcatttaaaacctcccttttttcctcccttaaagggtttctttaaagcaaattccccataaaatttcagcgggaagggcttctttcaatatatatttgtaagagataagggcttttgaaaacatatggcccccaacctccttttcccta

SEQ ID NO: 716614 - DNA, 225 bp, Homo sapiens
ccccttccttaaatttcccccccccttttgaaaggcccggggccggactaaaattttccttttatggaatctctgggggggccttcccggccctggattaagggtttccccccccccagccaatttagggccccctaaaaaccaatctctgggggggtggttttttagggctggtttttttaattaagggggttttgttttaattaaatttttttgtggttttga

SEQ ID NO: 716615 - DNA, 211 bp, Homo sapiens
  misc_feature (33)..(33): n is a, c, g, or t
  misc_feature (36)..(36): n is a, c, g, or t
  misc_feature (39)..(39): n is a, c, g, or t
  misc_feature (49)..(49): n is a, c, g, or t
  misc_feature (70)..(71): n is a, c, g, or t
  misc_feature (81)..(81): n is a, c, g, or t
  misc_feature (93)..(93): n is a, c, g, or t
  misc_feature (103)..(103): n is a, c, g, or t
  misc_feature (113)..(113): n is a, c, g, or t
  misc_feature (123)..(123): n is a, c, g, or t
  misc_feature (134)..(134): n is a, c, g, or t
  misc_feature (142)..(142): n is a, c, g, or t
  misc_feature (146)..(146): n is a, c, g, or t
  misc_feature (159)..(159): n is a, c, g, or t
  misc_feature (166)..(166): n is a, c, g, or t
  misc_feature (181)..(181): n is a, c, g, or t
  misc_feature (201)..(201): n is a, c, g, or t
ccccaacatgaccacacgtgggtgctgaactcnggncgncgtgcccacncggcatggtcctcccgagctnncgacagcatnacctcacccggncccatgctgntggcccggtncagccctggntgggcgcgcgnctgcgtgntgtnctgattgcccctnagccgcncaccccacgtttctngtgaccgggtgctctgcagntgttaaacgg

SEQ ID NO: 716616 - DNA, 250 bp, Homo sapiens
agcacttctgcagctctctctgatgctctcatgagcccgaaggcagcatatacagctgctagctgttctctatcaatgaataccggagttcagctcctttccatagttgggaccaaaaagcctactggcattcttaggcgctctgtgcaatagccaacaagcctcaaccaaaaccgtctgtggccacatgcacctccagctcaaacaggtgcccctggttaattacttgtagtggcttgtaggctgctga

SEQ ID NO: 716617 - DNA, 950 bp, Homo sapiens
ggccggtgcagatcacgggtttgctctttgcatcataagaggggactcgcatgtgcattctagcacggcaagcttgagtcaggacccttaattcagatcctcaagttggctggagggcagatctcgcgagtagggtacctaggtgactatgaaatgatctattttcgtgggcaacgcggtgaaaaaatattgcttcgcgctggtgtgacggcaggtacatgcctgcaccagaaggtggcgttcgttaacgggaatgcccgaagctgtgggaataaaggtgagcggtcgtgcggaagacaggggtatgagctcaggacagtagcccgtaggccatggaagagtaagacggccagcaaagaaaatctgacgaaagaggcacgcaggagagggcccagctcctgtatgaggaccccccagtatcagaaaacctcacccagatggtggaaaccatgcgcacactcaagatctgctctttgagaatgtggatgggcttcgagcctggcattagtgacatgcacgaggattagattgggtaaaggaagaagccccagatatactgtgccttcaagagaccacatgttcagagaacaaactaccagctgaacttcagagagctgcctggactctctcatcaatagtggtcagctccttcggacaaggaagggtacagtggcgtgggcctgctttcccgccagtgcccactcaaagtttcttacggcataggcgatgacggagcatgatcaggaaggccgggtgattgtggctgaatattgactcggtttgtgctggtaacagacattatgtacctcaatgcacggcgaggtctggtacgactggagtaaccggccagcgctgggataaagcttcgcgaagttctgaagggctgggttcccgaaagcccctgtgtggtttgggaactcctgtggccttgcgaattgacctgaacccag

SEQ ID NO: 716618 - DNA, 322 bp, Homo sapiens
  misc_feature (38)..(38): n is a, c, g, or t
gtctggatatctttgatttataatctttcttatatttnagataactgatatagctcactactatttaatgtttatctgccttgataactctttatgttgtgtttataggccagagtccctgtagacacatgtactaattgaccagaattacacaataaaattgcagagctacatagtagcagaatagtaatttgccaaattattttaataggtcaatactgaaaggataatattatttgctgacttttattaagacctatattaagattctatagtgttatatttctaaggttacaagtttttttcaagaagcaggaactgg

SEQ ID NO: 716619 - DNA, 155 bp, Homo sapiens
agcggagtactggcctcataactgatctacacagtccctgcaaagggttcctaactttgtggtcagtaaagaatgtcactttctaacagagtccaggagctcagaaggtttatacttaggacctcaagaagaaaagggtcacccacaactcacag

SEQ ID NO: 716620 - DNA, 1828 bp, Homo sapiens
  misc_feature (1389)..(1389): n is a, c, g, or t
gtacggaggagcttcctggaccccgagcgagaagtgatgtcattcatctcaagactgatagtccaagggtagaagtatgtcacataacatgagtacattcgtaaagagcacgtgcacaacgttcactgatatgcagctaatggcgtcgcacgtgagtggtactatcacgccgccatcgtcgctgcgtgcatccatgtgacctatatgtacgctcggctgtcttgcgctgcctattgtctcacatgaagaggcaggggctcagtcgacaatctgacctcataggcacgtcctactcagctacaagtgcgcgtgcaagacctcgcacgccctgcagcgccagagaccccttagtcaccctgcctgaactaccacttctctgtactcgactagcgtcatgcgcacgtcattgaactgcccccaatcttggatctacgactacagatccagacgatcctcccgcgataagcttccgctgcgtcagcggaaaacgacacgaggaccagcgaccacgtcctagaatagtaacgctcgtcacgaggctcgagtctagtacgggtggctcccccttagactttgagggcaacaaaagccaaaggggcacccaagcgtggtgatagaaaaggtatggccacgactatggcggaacactctcgcaaaaagtgtttaccccccacgtgggaattccgacggtaagcgagccctagcaggttaggcgactccctgcgaggtaatgccattccacttgagcaatacggggcacggccatctgggtaatccaatccactataggtttaaccttcgccaccatatggaggggaaaacggtggtaccgcctcagggccctttactaggactaggcggaactgcgtcaacacgctctagttccttaaccagccgcaatagggccacgcgacacgtctctggtccactctgaagcgaggtgtggctcgtatggaccgctcttccaatataatcgctacatagtcgacctgtagcccctaaactttcctacaagaggaggaacccgcttatggtcacaccagggtcctcacctagaaggagaattatggcaccaggaacttgaaccccataaggggggccttaccaggaaaacgtagtgaggtcatgaaccgcaatcacaacatttagcaggcttccccaagtcggaaccggctatatcccggaatcttgtaacatcaaccgggctatttcatgtgtgcccccttatctacattatatctccgctgcagactatcatcgcactttaaaccgtttgaaaagagtcccgccacattatccgcttttgtgcgcacgccaaccgcgcggtcaacacgggagatgccccgtgaaccaggtaacgacatcaatggcgttatttcacacaggacnctcacacaatcgttgtccccaaatctttcagcgacgatcggagaatgcctaatcgcgcgcaatatacggtgatgcctatgcgcgcacacacatggagtatagctctcccaaaatacctgatgcctgtgccttccctgttagggcgagctgttccctcttccatcggcgctgggaaatctacctctcccatacaggtctcgtgatagtctcccgtgtttgacctgcggatctccgtcgctcgcgacgaggctccgcatcgtgccggttaatcggtcaagcgcgctttttcgtcggctttgtgtgctcataagacgccctgtcctgtgtagttcctcccatcggcggccgtctcctgagctcgctctatgccctgcgccggttttgtgtcacctctgatcagtgctggctgccgtgtctccattcgcccccgtagccgcgg

SEQ ID NO: 716621 - DNA, 189 bp, Homo sapiens
aacaaatccatgtctcccatcaggaaagatcattggaatgccacgggatactcctccttcatcctgtaacggtcagcaataaaaaccaaattatggggctgctattgtcacactagcatagagaatgtgttgaaatttaactattgtaagcttgtatgtggtcctagatctggtaattcctttaagacc

SEQ ID NO: 716622 - DNA, 1006 bp, Homo sapiens
atatgacattgtgttggaaatggatgagatcaagccatgattcttccagatactgatattcggtccttgctaattggagctaatgacactgttaattcagcagctcatggaagatccctaattctattattgcaggctatgccatgctccttgaggtctggaaatcaatagcagtgtgattagttcatgaaggaggtcttatgggtgttggctatgctgcacgtggacaatccatatcttctactaagacctaacatggccatgcttctatgtgtgatgccaagaaaacatgtgacgcgctccagggcgaaatgttagtagaatcctatcagaagtaaactgttaacggatcaatctgttagctaagtaagtgcctacctctgcagttcctgggatacatggcacaactataagtactctagtatacatggtgatgtacatctgtagcaaagctcttggagaaaatgatcgactgaagaaagcaaagcaaaaactgtatagagagatttttcaagatagcagtaatccctcaatgttctcacacaacaatggattgtaaaattctagaatgtcttttctgtgcatatttttgtgttaggaatcaacagagtatctgataaaaggagtacagacacagcctcattctagatgtagtcctgtggattttatgcctcctcagtaaccagaaatgttttcaccaaactaagtgtgtcaggatttcaacgacaacattatacatgggctctgaaatatctgacacaatgtaaacattgcaggcacctgcatttatgtttgtctttttcacccaaaggtgactaagtttgggaactttaatagacttttgaccgttccctttaattcaccgcagttggattagtctgttcaatcggtctaatttgaaaaatgggctcagagttattttcaagggcatttgtcacaacttttgtaaacacagggggtaaatactcacaaagtcgggaccaagcagggttcgttgcttcaaccg

SEQ ID NO: 716623 - DNA, 313 bp, Homo sapiens
aattatttcaatttttgaattccctggggattttttactgccccttccaagcccttaagtgttagatttaacgtggtccagggtctgtttgaggggacttaaaaaatccgaaccaaacttttattatcccgagttctgggaaaggtcccccccttccaggaataatgttttgggaaaccctgaaaaggaattttccccggattataaattgggggtttaaaaaaaaaaaacttttttgaatgcccacccggcgggggaaaccaggcagtgggcccgttttaaaaaatgaaaaaaaataaaaactttttaggga

SEQ ID NO: 716624 - DNA, 211 bp, Homo sapiens
cccgagacgcacgtggctgagtctgtgagccagcagattttgcgccagaactttggcgcaatgcctgtgacgtgcctgtgaccaagaccaagaagaagaaggctgagggcacgtgtacaccgacgaagacttccagaagttccagcaggaatacttcggaagctaggctccctggagggcacggtgaagaggcctatcaagccctgaaggc

SEQ ID NO: 716625 - DNA, 155 bp, Homo sapiens
gcagctcaatggttgctctgcgtctcgtcccgaagtgacctgcttgttcctgacaaggacactgaggattgcagtgcctggaagcaagatccttccaggagagcggctccacctgagccccacggtggcctgaggccaagagagaaggctctgag

SEQ ID NO: 716626 - DNA, 446 bp, Homo sapiens
  misc_feature (26)..(26): n is a, c, g, or t
  misc_feature (28)..(28): n is a, c, g, or t
  misc_feature (146)..(146): n is a, c, g, or t
  misc_feature (211)..(211): n is a, c, g, or t
  misc_feature (245)..(245): n is a, c, g, or t
aacctgtatgatatctacttatgtcngnaatactcactctacttcacttatttaaacccgaccggactgaaggtagttgcggtatagactaaaggcctgggttcacagtttcccagttccttttgagagagcgggagggagtgaancagagggaggtgatcataaggattgctagagaaaagatgcacacctaaaaacaaataaacaaccnccggctgtcatgatttgcgcctgacaaagggctncacctgcatgtctctggacttagtataagcaatttttccttcaaaaataaaatcttatcagtcaccactaaatccatgaaccatattactgaatagaacctccacaaaatccatgaactatgttgctgaatagaacctttactattctgcttctattttccaagttacttgtgacaaaaaagcaaccaaacactcttagcc

SEQ ID NO: 716627 - DNA, 920 bp, Homo sapiens
  misc_feature (10)..(10): n is a, c, g, or t
  misc_feature (62)..(62): n is a, c, g, or t
  misc_feature (69)..(70): n is a, c, g, or t
  misc_feature (72)..(72): n is a, c, g, or t
  misc_feature (74)..(74): n is a, c, g, or t
  misc_feature (76)..(77): n is a, c, g, or t
  misc_feature (85)..(85): n is a, c, g, or t
  misc_feature (89)..(89): n is a, c, g, or t
  misc_feature (135)..(135): n is a, c, g, or t
  misc_feature (181)..(181): n is a, c, g, or t
  misc_feature (185)..(185): n is a, c, g, or t
  misc_feature (201)..(201): n is a, c, g, or t
  misc_feature (211)..(211): n is a, c, g, or t
  misc_feature (215)..(215): n is a, c, g, or t
  misc_feature (221)..(221): n is a, c, g, or t
  misc_feature (223)..(224): n is a, c, g, or t
  misc_feature (236)..(236): n is a, c, g, or t
  misc_feature (245)..(245): n is a, c, g, or t
  misc_feature (265)..(265): n is a, c, g, or t
  misc_feature (267)..(267): n is a, c, g, or t
  misc_feature (276)..(276): n is a, c, g, or t
  misc_feature (278)..(278): n is a, c, g, or t
  misc_feature (282)..(284): n is a, c, g, or t
  misc_feature (308)..(308): n is a, c, g, or t
  misc_feature (314)..(314): n is a, c, g, or t
  misc_feature (329)..(330): n is a, c, g, or t
  misc_feature (337)..(337): n is a, c, g, or t
  misc_feature (347)..(347): n is a, c, g, or t
  misc_feature (349)..(349): n is a, c, g, or t
  misc_feature (354)..(354): n is a, c, g, or t
  misc_feature (372)..(372): n is a, c, g, or t
  misc_feature (374)..(374): n is a, c, g, or t
  misc_feature (379)..(379): n is a, c, g, or t
  misc_feature (431)..(431): n is a, c, g, or t
  misc_feature (436)..(436): n is a, c, g, or t
  misc_feature (455)..(455): n is a, c, g, or t
  misc_feature (462)..(462): n is a, c, g, or t
  misc_feature (472)..(472): n is a, c, g, or t
  misc_feature (482)..(482): n is a, c, g, or t
  misc_feature (495)..(495): n is a, c, g, or t
  misc_feature (521)..(521): n is a, c, g, or t
  misc_feature (524)..(524): n is a, c, g, or t
  misc_feature (541)..(541): n is a, c, g, or t
  misc_feature (544)..(544): n is a, c, g, or t
  misc_feature (555)..(555): n is a, c, g, or t
  misc_feature (573)..(573): n is a, c, g, or t
  misc_feature (578)..(578): n is a, c, g, or t
  misc_feature (582)..(582): n is a, c, g, or t
  misc_feature (587)..(587): n is a, c, g, or t
  misc_feature (607)..(607): n is a, c, g, or t
  misc_feature (609)..(610): n is a, c, g, or t
  misc_feature (615)..(617): n is a, c, g, or t
  misc_feature (622)..(622): n is a, c, g, or t
  misc_feature (626)..(626): n is a, c, g, or t
  misc_feature (640)..(640): n is a, c, g, or t
  misc_feature (648)..(648): n is a, c, g, or t
  misc_feature (675)..(675): n is a, c, g, or t
  misc_feature (685)..(685): n is a, c, g, or t
  misc_feature (694)..(694): n is a, c, g, or t
  misc_feature (697)..(697): n is a, c, g, or t
  misc_feature (702)..(702): n is a, c, g, or t
  misc_feature (706)..(706): n is a, c, g, or t
  misc_feature (721)..(721): n is a, c, g, or t
  misc_feature (732)..(732): n is a, c, g, or t
  misc_feature (757)..(757): n is a, c, g, or t
  misc_feature (766)..(766): n is a, c, g, or t
  misc_feature (791)..(791): n is a, c, g, or t
  misc_feature (795)..(795): n is a, c, g, or t
  misc_feature (825)..(825): n is a, c, g, or t
  misc_feature (832)..(832): n is a, c, g, or t
  misc_feature (913)..(913): n is a, c, g, or t
atattcaccnaatagttacagaatattgccagaccattcatcttctttttaattcctttcanattctanntnananngaactctnattncctaaagattttttatatcaaggggacagtaatgcaaagcaatccntttctgaggcttttgctcttacaaagatacaacacaccatagtacnaaangacacacgtccccacnttgttacatnagantttaananngcaataaatgcnttgaaaaanacacattttaaacttaaaangntattgaaancnattnnnctccaggaaattaccaataaccanaaaggntggtagctgtaaaannacttgancagaaaaaantnttggncttattcaaaagtaaaantnaagtnaagggcagttgattatgatttctttactgttcccatctgagagaagtatggnatttnttaattgggaccatttgtnggaagangttgagatanctcctttgtnatatttttttttntgcttggtcaaatgctctagatagtnganaggtgaaggtgggtggnganagtggtctggnccaccaccctcccggctnaacancatnttatnctatttccaaagataactcncnnttttnnnaaatnactncaaaacaccagganatggatanaaaaaaaaaggctttaggtgcacgtgnggccccccancctggggcnccnagggngggngagaaaaatccgttnagataaaggcncatgccttagggaatttccccccgngggtccccnaggtccagtgttcttgcagatccantggngtccttgtagaagggaaggtggatggtgangcctgcnggggtcatgtagcggttgtccagtcagcgttcttgggggccttgcatgtgtgcacatccagagcttccaggcagttctganagcgcac

SEQ ID NO: 716628 - DNA, 87 bp, Homo sapiens
  misc_feature (16)..(16): n is a, c, g, or t
  misc_feature (62)..(62): n is a, c, g, or t
tcattaatctacaccntgttaactaataacctgtgatgtgttagacaagctggatatgtttncctatatattgctaagggtagacag

SEQ ID NO: 716629 - DNA, 379 bp, Homo sapiens
  misc_feature (36)..(36): n is a, c, g, or t
gcaattcaggacccaagcccagctcattttgggaantgtgttcccagcatttttgtccttttgattaaaagattttccttccaggcctaagcctgggatttgggccaaaaataagaatccaaactatgagggtagtttttgtttaactcaagactgttttggaatgagggtccaggcctgtcaaccatggggtttttgccctgagccccaaggttgagggacaggattaggcagggtttgtcctgtggccccctggaaagtcccaggtgggatttttttggggacacttggggtccccaatcccaggtccatattttaggttttggatcccatgagtatgtatgtttccctgggcctaataaaggagaattatgaaata

SEQ ID NO: 716630 - DNA, 492 bp, Homo sapiens
  misc_feature (39)..(39): n is a, c, g, or t
gttgcatgaaagacatatggaatcatgtagcacctgttntgacattgattctcacgtatatgagttgttcctctgattttagatcacatttgtcctcatcactcggcatatccacattgagattgacacggttttattttagtttttgacacgtgacaaatcatataatgtttgaaattgtaagggtatatttcatggagcctgtgttccctttttcagtgtatttctgtcatgttctgatccccagacacaaagtagaagccatcaaagcctccactaatacaggcaggaggacagaggttgatgctaacactgtgtgaatgtatggataactttatcatatttacatgtgagtgattatgtatcccttttgcttttcagtgtcttctcggaaaaaaccagccttgaagttcttctcagaaacaaccagcattgaaggctatctgtgacaaggaagattctgttccgaatacggccacggaaaaaaaaaaa

SEQ ID NO: 716631 - DNA, 184 bp, Homo sapiens
tatagaggatcccgacagccggaccccccggacacaatgagtctactgtggccacgatgtacaccagtcaacaacctcaagtttgcacgcatcgtgagccctggcaatgccggcatccgggagaagctggcctgggccaaggagaagtacagcatcggggagcccacagtgccatccaccctga

SEQ ID NO: 716632 - DNA, 933 bp, Homo sapiens
tacgtttgctccccgagctgttcgaagatgggtgtctggtgttgtactctcccggtgcccctgtggtttccggcgtcttttcgcgtgtttttatcttgctgggtttatatgccgccggcactctttgatacacgggccctatgggggtcggtgttggacccctgtcccgcggtgcgcgattagtcccaccgcgcggcgcaccggtgggctccccagcgtgtaagcctgtaagccctgggatcaacgtgctgcgacgaggcaccgtgtggcttccccccccggttgtgtggctagggtctcaccgcgtgggcggtccccccgccgtggctacccgccggtctttttagggttgctggtcaataagaaggagtccggccccgcgagacttttttaaaaaaagagttgtacaaccgggggccccctcccgaggcatgtgttgaacggaaattttctggaaaacgttaacattgtttctacgaagagaaaaacgaagagaagattgtgtaagcaacgggcaagctcccccccccccctcgccgtaggattatgaagagtaggatataggctcctcattggtggtagacagcgggcagcacacactcgctgggcagtatgaggtatcatctccaccaggtaacgcacgcgcggtcttctcaagtgttcgagtacccattcaaaaacagtaagtagcgtttctccccaacaaaacccgcaaaaagcggggggtccaacaccccccccttgtgattgaccacatgtgcaaccaccttgttttaccacccgcctctcctaaactttagtaaaaacaatcaaattattaaatactgcgacccaatgtgaacatagcacataacacaacataataggtttttatcgaaaaccacaacatgggttccaaagaagccctcaagggcaccccgccccacaaagaca

SEQ ID NO: 716633 - DNA, 761 bp, Homo sapiens
gaagacagtccagcagggaagacgaacgcacttaaaactggagataaaatacttgaggttgcagtgagccgagatcacaccatgcactccagcctgggtgacaagagcgagaccccatcccaaaaaaaacaaacaaaaaacaaaaaaaaaaaaaaatgtgtggggggcgcggcgctgggggcccttgggaagaaaggtttcttataaaacacccatttcgggggtggcggggcggggggggggcccagggagggggtacagtgggacaaaaaggtggggccataaaagggtggggtacccaaataagggagagaaacgcccgggcgccacaagagaccatcagggtgcggtgtgggcgagtttccccacccaccaatataaagaacacaccgcggccgggggggggaaaaaacacgagacgcgcgtctcgctgggtacccacactctccccaaagatgggggcatgtgcaagcaaggcggcaccaatgacggggggagcagtcattctacaaaaccggagggagatgccccaaacgagagaaggacgccccgagaaactaatcaaaaaaatgtaagcgcgccccggcccgcggggggatgacaacagaaacagaaaagcaaaagacaagaagaaagacagcaacaaaagaaagaagcgaaccagcaaacaaacagaaacacacagaacaaggagacagaagaaagacagaaaaaaggaaggacaaagagcagacgaagacgacagagcagaaacaacgaga

SEQ ID NO: 716634 - DNA, 432 bp, Homo sapiens
actcctcgatcagctgcccggcgaggtcggcatcccagttcgcgaagacccacggtgcgatgcggaagacatgcttgcccctgaagtcgtcaggatacctctggctctcattgatgaacgagacgcgtcccagcacgctggcgttctccaccggcgactgcccgaagacgcggatgtcgccgtcggtgacgaagtcctgcccggtgagcagctgcatgagggtcgtcttgccggcgccgttgcgcccgagcaggccgtagatcctgttctcgtcggcgctgaacgacacgtcgtcaacggcggtcaccctaccgaaacgcttggtgacggagtcgacctcgatgatggcggtcatgccccttccgttctgatcatgtcggcgagctcacgagagccgatgccgagattggacgcatagtcgagcagcggccg

SEQ ID NO: 716635 - DNA, 199 bp, Homo sapiens
cgattctctgagggcagggggagcggccgcagggcccttccttatcgccgacaagtggcccgcgctgccctgaagctggactcggtctttgaggagccgctctccaagaagcttttcttcttctctgggcgccaggtgtgggtgtacacaggcgcgtcggtgctggcgccgaggcgtctggacaagctgggcctgggag

SEQ ID NO: 716636 - DNA, 107 bp, Homo sapiens
ccggtaacgctagactggctattgaggagtatcctgaggcatgggggtcaggcgttgaggtcttggtgagtgttttagtggggttcgcgatggaggtaggattggtg

SEQ ID NO: 716637 - DNA, 126 bp, Homo sapiens
tatttatgtggtaatacatgttacatacattttaccatttcaataatgttttaagtgtacagtgaagtggcattacagtacagtaaaagaagacatttttaataaggatcccctagggataccgag

SEQ ID NO: 716638 - DNA, 165 bp, Homo sapiens
gcttcacgtagaatgagtctctcctcttgtcttcggagtgaagtggaggacacgcggaagggcaagagatgcgtttttttcgaaatttttttaggggtaagaaaggatgtattctttgaaagggaaaaactctttagatattgttccagctgggaagtagatata

SEQ ID NO: 716639 - DNA, 251 bp, Homo sapiens
cagaacattgacataccttgaaatgattcatagacgcatacaggtatgctttgctgagatccagtgtgcttagggattgaggtgaggtctaaggccctgggcctcagtggatgagaccctgagtgccccaagagtgcagctttggtttaaaggtgtgtcctagctttgggagattgggatagaactgaaaaaatggtctagtggtgacctagaacactatgtatctttttaaaaggagttagccagcctgt

SEQ ID NO: 716640 - DNA, 181 bp, Homo sapiens
gcgaggaaggaagctcctgcccctcctaaagctgaggccaaggcgaggcttttaaaggccaggaggcagtgttgaaaggtgtccacagccacaaaaggaggagatccgacacgtaccaccttccgcgccgagcaactcgactcggacagcccaatatctggagaccgctccaggagacaag

SEQ ID NO: 716641 - DNA, 795 bp, Homo sapiens
  misc_feature (2)..(2): n is a, c, g, or t
  misc_feature (73)..(73): n is a, c, g, or t
  misc_feature (75)..(75): n is a, c, g, or t
  misc_feature (86)..(86): n is a, c, g, or t
  misc_feature (138)..(138): n is a, c, g, or t
  misc_feature (188)..(190): n is a, c, g, or t
  misc_feature (213)..(213): n is a, c, g, or t
  misc_feature (216)..(216): n is a, c, g, or t
  misc_feature (253)..(253): n is a, c, g, or t
  misc_feature (302)..(302): n is a, c, g, or t
  misc_feature (316)..(316): n is a, c, g, or t
  misc_feature (322)..(322): n is a, c, g, or t
  misc_feature (354)..(355): n is a, c, g, or t
  misc_feature (361)..(361): n is a, c, g, or t
  misc_feature (366)..(366): n is a, c, g, or t
  misc_feature (368)..(368): n is a, c, g, or t
  misc_feature (372)..(372): n is a, c, g, or t
  misc_feature (377)..(377): n is a, c, g, or t
  misc_feature (379)..(379): n is a, c, g, or t
  misc_feature (396)..(396): n is a, c, g, or t
  misc_feature (405)..(405): n is a, c, g, or t
  misc_feature (430)..(430): n is a, c, g, or t
  misc_feature (443)..(443): n is a, c, g, or t
  misc_feature (456)..(456): n is a, c, g, or t
  misc_feature (465)..(465): n is a, c, g, or t
  misc_feature (473)..(473): n is a, c, g, or t
  misc_feature (492)..(492): n is a, c, g, or t
  misc_feature (518)..(518): n is a, c, g, or t
  misc_feature (526)..(526): n is a, c, g, or t
  misc_feature (536)..(536): n is a, c, g, or t
  misc_feature (556)..(556): n is a, c, g, or t
  misc_feature (558)..(558): n is a, c, g, or t
  misc_feature (563)..(563): n is a, c, g, or t
  misc_feature (575)..(575): n is a, c, g, or t
  misc_feature (649)..(649): n is a, c, g, or t
  misc_feature (691)..(691): n is a, c, g, or t
  misc_feature (696)..(696): n is a, c, g, or t
  misc_feature (699)..(699): n is a, c, g, or t
  misc_feature (724)..(724): n is a, c, g, or t
  misc_feature (774)..(774): n is a, c, g, or t
anagtttcacaattctgcggcgcattcagatagacagcaaaagcaaatatttcaatttgtggattacaaaagnanactttaccaantgctgaagaaaaaaagttcataaatctggcagaatcaaaacattcaaagaancagcacattttccaataaaaaattatgaaaacattatccttttgattatnnngtccaataacattgagttttttnccnctttgtcttgaatttcatgaaggtatcagcctgttcnttttctcagtgtctcagttgttgcagtcacgactgagactctgtcaggnctccatggcagggnccaganactttgactgtcatggatttggagatttcctnnccagtngctgncntatnaacanancaagcatagagcccgcnatgatttcnagtaattcgggggataaagagcttncgtcctgattgcngaaacttcgcgcngtgaattgnccaaaaanactctgccggtgggttacnctccgtgaagcaggacaaatcgaggntttccccngaacggtaanaggtgaatgaagggtaaatncncgggnggtccggaccanagaggacatttaggatgaccgggtgtaccgccggaggccaccatatcggtccgcggatttcacattgatagggncctgtttcatttctcgtgacactggggtagaatgagtatccngtttncantgggtcgctttaccccgggactganggggaggctctgaccgtttagccaccaaatgtaggtgtagttctcactcnttaggttcacaggtgaaggct

SEQ ID NO: 716642 - DNA, 594 bp, Homo sapiens
gtatcaacgcagagtggccattacggccgggattctagagtgccgaggcgggccgacatgtgttttattatttattttttattttttatattttattattatatattatttgtattattatattattataagagagtggtgaggagggtataatataagaattagaatatatgaggtgtagataaatatcaacacaaaagaagacaaaaaataatagaaaagaaaggagagggagcgatgattatatactacgcgaggcagcgggatgagatataagacaggacagaaggaagagagaagagagaggggggagagataatagagaagaaagagagagtgtgtgagagaacagacaagaccacgcaagcagactgcccgcggagtcgcagacggaggagtaagaaagaaggggagaggggagagaggacagaagagggacgtgcgggggcgagcggggcgccgggaggcaaccaacgcgcgcagagcgcactcctgacggaggcggagagcgagagcggcagggacggacgcggacccggagggacggagaaggcgacgcgaaggaagcgacgggggcggaggtgaacgcgggca

SEQ ID NO: 716643 - DNA, 487 bp, Homo sapiens
tttaacgtgctgtttttatgtctgacgatagtaataattcaggagaaaagtgtcacggcataacactttgcatgacccatgtacatgtctgtaataacctgtctgaaatgacgtaatccaccagccattttctcattggataactaaaccaagtggaaaataacctccaagttgaagagtcacacttgtttgaagttccccaacattatttcgaaggttaaaagtgatttaatttgatttgtttaacaactaaaagagtagcacatgtgactaaacaacaatgcctttgtgtgagggttgctcttcctcatgtggatattcatctgtcataacacactctttttttaatgtttttatttgtgtgtgttgctgtttacttctccttaatttatttccaaacgttgggaaaagctatcaaagtgttctaaaagcagttcatgagttttgtataagtgggcttcaaaattaataaatgcaagaaaactca

SEQ ID NO: 716644 - DNA, 398 bp, Homo sapiens
tgggtcgtaggaacctggcatgagcgcaaaccccaatcgccagcttaaagaggaatagtctcccggatatcacgaaaaaattccgccgagagagcaaaaaacccaatattcacagcaggttcaaaagtagttattatccaagaaagtgcctaagtctaatactcatcattcaaaaaactttaaatacacaaccgaatcttccatatttaaccggattaactcactatttcacagaagaatcaacgccagcacaagcaatacgaaaacacctcttcttgtacaagttcgtgctagaccaaaatatcgaatcgataaccaatagcttaacactcataactaattaataagccaccaccatttccatcgctaatttaatataggtacgtctacacgggccg

SEQ ID NO: 716645 - DNA, 377 bp, Homo sapiens
  misc_feature (66)..(66): n is a, c, g, or t
  misc_feature (79)..(79): n is a, c, g, or t
  misc_feature (88)..(88): n is a, c, g, or t
  misc_feature (192)..(192): n is a, c, g, or t
  misc_feature (197)..(197): n is a, c, g, or t
  misc_feature (200)..(200): n is a, c, g, or t
  misc_feature (289)..(289): n is a, c, g, or t
  misc_feature (308)..(308): n is a, c, g, or t
  misc_feature (314)..(314): n is a, c, g, or t
  misc_feature (316)..(316): n is a, c, g, or t
  misc_feature (355)..(355): n is a, c, g, or t
  misc_feature (358)..(358): n is a, c, g, or t
caggtgctcatgattctccggcgtcagcctcccgagtagctggtatacaggaggaaaacagaaatnatttctcatagtnctggaagtngggaagtgaagaccagggtgctggcagatgtgatgtctgattaaaaagtcttacttatatgagtataaattataaccaactagccagcattcctagagaacttngtttnctngagaatctggttgaacttcaacttaactacaatcagctgatatgcatacctgaagagattaaattcttgaagaagcttcagaagctttngctagccagaaacaacatnggagtntngccggaggtaagcaaaacatggaaccacagtagttggcngtnggagaagaactcaacatga

SEQ ID NO: 716646 - DNA, 1389 bp, Homo sapiens
  misc_feature (516)..(516): n is a, c, g, or t
  misc_feature (792)..(792): n is a, c, g, or t
  misc_feature (1042)..(1042): n is a, c, g, or t
ggaatctgtgacccattcatgtagcagggaaactgaagaaagaccaagaccttccctcttacttatggttcttcgttagaacaagattaggtaaggtaaagaagaacacgttactggtgtatataccctaatcaaatcagtgctgcgcacattgcaactgctggacgtttgcgctagttacctgttcctcgagcttatacgtgtcttttggcatatctatcacgagctttagcaccagccactgcagcagcccaaataccaaaaagatgtctcggtggacacagccccggaagtcgaacgctgggtccccagtctcacacaggctcagacgaattagcttgggccaccttttggagtgggcctattaggccaaggtcaccccaaggaagggcccaggaaaaaactttttcccaaggggcaaaagagcgcctaaggcggaattgagaaatgaattccggacattaccccgagcggatttttgtctccaacggcagtggagggccattcacctttcgntagggttagaagcgaggcctttccgtggcatttccttaagaagcttgtgaaaacgtgcgggttttgtatgccccgtttccgtttgcccattaaggctttctaagaacacggtttggaagcgtggggctacacaacgtttgttaggcgggccgacgtttatacacgttctcgcagggcccagcaggaacgggcacagccggaacttatgtctaccgcccagattcgcaatgggaaccaacatcgtgggcggccgccctattgggagacccttttgtncggcctcttttgggagcgcgacgatgagaagacaacacttggggcgccttgcgcagagacatttcccagggcccttttatcatggcccaaagcggaaggggttgggggaacggacaaaattttctccttcgcccgaagatgtggccttcctagaacatattctgcgagacaagtcgggcgggcacaagggcgttccccctttgccgacggggcttttaaaccataaggtcgccaaggccgacattttttngccgaagttcgtgacagtctgtgttcacacacaagcagacaggcagcattaaacttctacgggagaccacttggccccaatatttagaggggaaacattctcccccaacagttggggcatttgcgtacgtcatcataaacagacaagtctgagcgccctttgttagtctaccttaaaagacgaacgggagcttgtctagtacataacactatttctattgggcccatctacgggttagtgtataaatacaaggcccagagcgagtatatgagcagactaggcatatagcacatatactacgaggcacatcgcgacaaccccactcgggagctaagagggcgtaccat

SEQ ID NO: 716647 - DNA, 276 bp, Homo sapiens
ccccccccccgttaaaacccgttcaaactaaattttttggttcaagccccccaaagggagaaaaacggggggcccccctcaaagtttaattttgggttttccttaaaaaaaatttgctttccttgtttttttttttaattggtagggttcaaaaacaatttgggttttatgccctttccccccggtttgtaaggcaattttttttttaaaagccccgggggccagggtcataaaggaggagggttttacgggttttttaaaaaacccttttgttta

SEQ ID NO: 716648 - DNA, 906 bp, Homo sapiens
gggttgttccccaaaaattttcggggaataaaaacgggggtggacacccccgtgggcccacgccgtgcgtccttgtttttggccgtggtaccgtctcctcgccgcggcccgtgtgattggttgcccccccatttcccgcgcttggtcccctagaatgttccccccaactgtgcctctggcgcccttgctgcccaatgctcgtcccccgggggggaaatttttcgggccacaaatgccgcccaactgggttctcacgcaccgccacacgtggggtacatactatacggtgttgtgtatggttgcaattcttatccgcgcgcgcacattaggtgtttgccccccctgggcaccaccgttcccttcaagatcaaccaacactatgtttgtttctctttacaaaaaaatttccctccatctcccaggaactttctctctcccaaacagaataatattctccgtgcgcaggaaacttggcccccccccctctctctattttccctccggcggtggacgcgaaacccaccccccggacatgacacccccttatctgtctcttaagaaaataaattcccacgtgccacacacaccaccatttgctctcacgtaagtaagggccacggaacccacacttatcggcggaacacaccagtgctcacgatatacctcggctgaggttccacacacaggggctcctcttatggtcgccccgccctttctctgaggagtaagctcacgacccgtggccaagcttaatttatgtacacacagggcgatcgtattcgtttttggagagtctttatctccaaataatacatggaggacttgtcttctgtctacgaaagcagggaccgaagataccacccccctcccccccattcaaaaccctttaaccccgtctacatgaca

SEQ ID NO: 716649 - DNA, 1657 bp, Homo sapiens
  misc_feature (1296)..(1296): n is a, c, g, or t
agttgtgtgtgagtctgtcttgtatggttgtgcgttgtgctttcggtgctgtgttgtttgagtggtgctgtcgctcgtatatcgtcagctgtcgctgctagcagggctcaagctctctgtatctagtgctagaggtatgtattgcttcatgctcgttaagctgagtgtagtctgtggtcttgttagtcgttagtgtcgttctactctcgttttctgaagtgctcgtcgtctctgtgctctgcttggtggttatgatgggtatgtatgctgtcttctgtgctacttcttcttgaggtcgtccgtggttcaggctgtgcttgtgaatcactatcgtctactatgtccagctgtgtctagttttgttgtattatgtatttatgagagcttgtttgttagttttatgtagttgatgagatgtgaagtgtaatagttgattggtttgatatgcttattatacttgtatatatcaaactaggagtaagaatttaattgatttagatgcgttacttttttgttctcattctatattcctattcttagttttttattattgaaatactattggtatgttatctgtgagtgtttgatagtattgtggtggtgatcagtcaatgtctaatggatttgttcgtgaatgggtggagtcgtataattgtttgtgttcatttttgtgattttgtatacgtttttgtcttgtagtatagtttggatgattatgtggtataggtggttgtttgtgttggtggtggttgtgttgtgttttgggttgtgaggcgcgccgcccggaggggggggagggggggggttgctctaatatatattacagcacgcggagagagcttctcgcgtcttttttagtgtggggtgcaccgccgcctctccgtcgagattttcgtcgcccgtcgcgtgagagagcgccccctccccatctcccccaccgcggctgctggtgatgttttgggggaccactccccccccccctcttaggtagagaggtagcaccacccccccgcgggggggccgcctgatgttcccgcagccccttctcccgcgggatctcttcttggtcactcttcttaggcgcccgcgcgcgacgagagccgcggtgatgtacacacacatgttgtgtcgcacacaccccagagagacacacacactttattgcgcccacatctttagacgcgctctcatatttttagagggcgccacacacatctcatatgagagacacacacacatgttgtgtgcacacacacagaaacgacacacggcgtgtgggtgcacaccgcgtctccncgcggaatttcccccggcgggaaattctcttctggcacccacagcggttctccgcgctctaagagcgccttctttgtgcggtggaaccacaatctgcgccactctttgtgtgcgctgcctgccccccgtgtggcgcttcttgcccacaccacacagagagtgttcttctctctgttgcgtgtcgctgcagcccccagcactaagagttgtaagacccagagagaagaagatcgcggagaggagtctcgacggagagatatgggatttggtttcttttggacataatctcaccccaaaagccacaccccacttagccaggttttatttgcccaaaaaaggaaaaaaagggttatttttttta

SEQ ID NO: 716650 - DNA, 1480 bp, Homo sapiens
  misc_feature (919)..(919): n is a, c, g, or t
  misc_feature (936)..(936): n is a, c, g, or t
  misc_feature (1284)..(1284): n is a, c, g, or t
  misc_feature (1288)..(1288): n is a, c, g, or t
  misc_feature (1337)..(1337): n is a, c, g, or t
ttcgcagcgggtgcgggaacgcctgttgtctgtcgtcttctacaacacgagggtgggtgctacatcctgctcctttcgcactgtgtttgtgatccagccccccaacaagcgtggtgtggagaaagtcgtggggaaagttcgccccagaaaactatttcgttcggcgagacaaatttctcaagatcaggttggggaggaacgcacccataatgccttcctagctacacatttttttctctggggggtttgcccaccatctttgggttgaagacccttcttgtaacgcaccattgtgtttttctcgtgacggcgtggggtgcgccccacacacctctccagacaccgcaaaagttgttttgagatgagttgataacgactccgcagagaggtattcccactggtggccgatgagaattgcgcttcccttttggttgtgtcttcctcttggcccgcccacaaaaccctgtgtgataaaggggcaccttcctttgagagcagcgacggctgttttaatatgggggaaaggggcacggcccttgttttttccttggtgagaaactagctctggaatagggcgccttcataataggcccgtggtgggacacaacacacggccttgtgcgcccacaattatggagaccacgcacacggggccacaaagagaataggccctcggttctcgccaaaaatgggggagaggttctttaatatggcgtaataaaggggcaccctgggagggagagtgggtgtggccgcacacgacccacttgcacatatgctcgggacgcacaaatgcaacgggcataaatggacacacagggcaacagacacctcggggttgcgccacacacgctcacacggggctcggctacacacaaaggtgaaagggccaaaatacacccaccgtgctggggagatntgagaatatatgagagnggaaaagggcacacaacattgggaaagaataatgggctaatctcctcggggtaataacacacgagaaaagttttgtcacaaaagtgggaaagcccgacacacgggtgttctttctggagagtgccacagctgagaagcacagcacacagagaggtggatttctcgcgcttgtgggaacaaacattcatgcacataagcggcacacccacggagaaacgtggtgtccctggagttcacccacccccctcgttaaagcatattcgccacacgtggcttgtcgatatctttgggagaccacgtgtttctaggcacaaagttgtggtttgaaagaataactttgatataaangaangactgtgggcaatactgtttatacggtggccccattaataataccttanagtttgggataatattagctggacacttcgcgtttaaaataaggtgctaatattatttgccgtgtcattttccatacaaatcagttgatttaaaaaagttcatttctcatactgtgcattaccactaaaaatttgaacaatta

SEQ ID NO: 716651 - DNA, 98 bp, Homo sapiens
gcggccgcctactactactactactgctcgaattcaagcttctaacgatgtacggggacatgtaccatcaataaagtaccctgtgctcaaccaaaaaa

SEQ ID NO: 716652 - DNA, 1828 bp, Homo sapiens
gtcgcatagagtttgcttgcagagttgcacccgagctaggccaaacgcgtggacacatagatcattgcatgtattcgacatctgtgcacaaatgttgagagtatccagattgacccatcgtctccatactctacagtcatagtcatgcatactagtcacggaagaacgagaagtacagacaaacaagctctagacccgtggcaaatatccatgactcagtacaatcgatgcctcacctatacggatttccgcgtcatccatagcaagacagagtccaggcggcaacaaagtacgccttgaaagagtacgctagcatactcatgacctgacgcggtacacagatgatacgaacacacacgtagcaggatcccactccacagcgttcgggacctggcccagcgcagggaagtctgtggggcaaacacgacgagaacacaacgtgaatcaccgcaaggtccacagccaggcgccatgcctaaccaggtagacttgacccctgagagactctagcgtccacccaacacatatgccacaacacacgcccgccaccggacgagacgcaacagtaaccgacgcagctacaaacgggaggaaaccccacccgagcgaaaggcgacaactaatccccacaaccagcctgcaaaacgcatggactgaggcactagaccagccacgcaagaggaaactaaatcaactaccgacacaccacctagccgaactaccatggaagttagaacaagacaagcaaaaggaaccagaagccacgcaacaccgcaccacgtcacctcgcggagactagtgcgactggaaaagacacacagagcaacaagccgagcgctgtcaaccaagtgatcagagaagatcacccgaagtacaggaacgcggactcgccaaagccaggtaccaccgacgagcatgcgcagcgcgcccgaatgccgacacataccacacagctcgcccatccgccaaacacaactgcagcagcactacgcataggctcccaaggagagagaggagagcgatgcgtaccacacaccgtggacgtcccagacgcgagacatatcgtccacaaacgggtacggcaaccgacacaccgcataagccagtggacctaccgaagacgaacgccgcgtccgcgaatagagccgggcccctgtcagcccgcaccacacgcagaagcaaaccacactctgtagtccaaacacccaatgacgagacaagtaaacagtaaccgagcagcgcaaggctctcaacacaaagatgaacccccccgaattccagctggatactccgctgtgacacacgcctcctcacaccagcctgagctaccacaaacgacaccgccaaccctcatctccaacagcaaggaggcacaagcaacaaacagctacacgcacgcgagagacaacacaacaagcaaagcgccgaccccacaccaccaggcgacgaacccaatacgatagccgcctaaagtagatcgataagcaaccgcacacagcagcgtatgcccgacgcacgaagacagctaactacgagagggacgcggacgtagaacaggacacgcaacgatacgtagcacacacacaggaggcgacggccatgccaccatccacgtaaagatcgagcagacacgcaacatacagcacgccaacaacgtcctaactaccaaacttcacagcccgcctgccactcagataactacatcacgaggagagcacaagcactagacaacacgtggagtctagagggcaatcgcaactacaaagcagaacgagctagacgagataacacaccggcacaagccaacagcaagcagaaagacaacacg

SEQ ID NO: 716653 - DNA, 653 bp, Homo sapiens
  misc_feature (146)..(146): n is a, c, g, or t
  misc_feature (148)..(148): n is a, c, g, or t
  misc_feature (154)..(154): n is a, c, g, or t
  misc_feature (156)..(156): n is a, c, g, or t
  misc_feature (160)..(161): n is a, c, g, or t
  misc_feature (166)..(166): n is a, c, g, or t
  misc_feature (170)..(170): n is a, c, g, or t
  misc_feature (186)..(186): n is a, c, g, or t
  misc_feature (188)..(188): n is a, c, g, or t
  misc_feature (198)..(198): n is a, c, g, or t
  misc_feature (205)..(205): n is a, c, g, or t
  misc_feature (212)..(212): n is a, c, g, or t
  misc_feature (241)..(241): n is a, c, g, or t
  misc_feature (243)..(243): n is a, c, g, or t
  misc_feature (246)..(246): n is a, c, g, or t
  misc_feature (255)..(256): n is a, c, g, or t
  misc_feature (269)..(270): n is a, c, g, or t
  misc_feature (272)..(273): n is a, c, g, or t
  misc_feature (279)..(279): n is a, c, g, or t
  misc_feature (283)..(284): n is a, c, g, or t
  misc_feature (286)..(287): n is a, c, g, or t
  misc_feature (291)..(291): n is a, c, g, or t
  misc_feature (311)..(311): n is a, c, g, or t
  misc_feature (317)..(317): n is a, c, g, or t
  misc_feature (332)..(332): n is a, c, g, or t
  misc_feature (334)..(334): n is a, c, g, or t
  misc_feature (336)..(336): n is a, c, g, or t
  misc_feature (338)..(338): n is a, c, g, or t
  misc_feature (345)..(345): n is a, c, g, or t
  misc_feature (353)..(353): n is a, c, g, or t
  misc_feature (364)..(364): n is a, c, g, or t
  misc_feature (379)..(379): n is a, c, g, or t
  misc_feature (389)..(389): n is a, c, g, or t
  misc_feature (403)..(403): n is a, c, g, or t
  misc_feature (407)..(407): n is a, c, g, or t
  misc_feature (421)..(421): n is a, c, g, or t
  misc_feature (425)..(425): n is a, c, g, or t
  misc_feature (471)..(471): n is a, c, g, or t
  misc_feature (511)..(514): n is a, c, g, or t
  misc_feature (519)..(519): n is a, c, g, or t
  misc_feature (522)..(522): n is a, c, g, or t
  misc_feature (542)..(542): n is a, c, g, or t
  misc_feature (548)..(548): n is a, c, g, or t
  misc_feature (552)..(552): n is a, c, g, or t
  misc_feature (554)..(554): n is a, c, g, or t
  misc_feature (558)..(558): n is a, c, g, or t
  misc_feature (560)..(560): n is a, c, g, or t
  misc_feature (565)..(565): n is a, c, g, or t
  misc_feature (567)..(567): n is a, c, g, or t
  misc_feature (588)..(588): n is a, c, g, or t
  misc_feature (598)..(598): n is a, c, g, or t
cgccctaacttttcttgctaatcctggtttatgagctatcccatctaaaatatttaatcctaattcttagtccttgcctgtgagatatgaggtcttacaggagacctcagagctcccagcccttctcctcctgctaacccttctcncnccctcnanaggnnttagnaaanaggtccttgtcattcncncctcattatngaaaatngaataanaaataatcatatcctttcttcccaccctncnccngttatttannatttctgacaaanntnncttganattnntnncttngaaccgactgtctcctctgncttttntttttcagactatcngngncngaatccnatatagtnccagggacctnggtcactgggagagnaaggaagagngagggagcaaaganattngggtatgtaccctntagnacactcttacctcttacttcctagagctttgatttctccggcagcncagaagttcagttctcttgagcccctctctaccccttcannnnctctngtnttccttttccggtccttttnccctanccantncccncnctccntnccctccctccccccccttctntctcctttcnttccccctcatcaccaccacactccccccccctcccccaaccaccccccaccccc

SEQ ID NO: 716654 - DNA, 226 bp, Homo sapiens
caccccagtggcagatgacagagagcatgccatatgtgatcaccagcagaggacgtggtcgttgccactgacccagaggaaagggactgagaacctgatacagtgagtgtgtctgggcaatcaaacaacgggatttggtctgaaaaagcagaaggcacaggagacctcgagctgatcctgatgactggagggagaagagactgtgaaagagccttgcccattctag

SEQ ID NO: 716655 - DNA, 266 bp, Homo sapiens
agcaaagttagaggcacagcacagaagacagacaacattaaaaacatgtacttgcatgtaggacaactcagttagaagagtctagtgaatggctggactctactgtatgatcaagatgctacaaacaccatttggttgccatcaataagaaatttactggttttaaaaaaatccaaaggctggcatagtccagaaaaatttaacaggtttatttataatgattataaagttgaagcgctgatgctattgaaagttctaaaactagg

SEQ ID NO: 716656 - DNA, 378 bp, Homo sapiens
cctacccggccaaattaattttcgagagtaataatttttcaaaagccaattttttttttggattttcgggaagaaaccgcccatatcatgaatagaaagggagaaccataaaggagaaagaacgggatgttttgttatgttcatgtaaacctaaaaaaacagtgtggaggcaggggggatcaaccgaactttagggacttggtgttgcttggaaggcatccaaacctgcattttgcattttttgtagggaatcaaattgccaaagacaaactatttcatcatttattgtaaaaaacacttttccccagacctaccaaaaagtttttgtgatggattgttttccaggtgcaataaaaattactgaggtgcctccattga

SEQ ID NO: 716657 - DNA, 451 bp, Homo sapiens
taatcttaactaattacattggcatggatcttatgtccacaaaagtcacagtctgaggtgctgtgggttaggacttcaatatataaattctgcgcttacacagttcaatccatgacagaatccaaaggtttactctggttataataacagtacaataaaatatcgtttatagcctgccatgcaaggaataggagagctattgtacattcttcccaagactgcattcgatgtaaacatattgtctgtagaaaccatgcccctgcagctcatatagccagaaaatttccttattgtccagccacggcgtgttacacctgtaatcccagcactgtgggaggccgaggtggccagaccacgaaggcaggtgttcgagaccaccctgaccaacatggagaaatccggtctctactaaaaatccaaacattaactggccatgcaggcccttgcctgc

SEQ ID NO: 716658 - DNA, 447 bp, Homo sapiens
gccattatggccggggcacccaggtgattaaaaagctttattgctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaccaacaaccaaaatatcaatccacccaaacaaaaaaaaacaccccacaaaaacccaaataacacacaaccaaacaatcaacaaaaaacaaaaacaaaaccccaaccatcaaccaacacacaccctacaccaaaccacaaacacacccacaacaaaccaaccccacactaacacaccaaaacaaaaccacacatcaacacaaccccaccaaaaacacaacaccacacacacccacaaaaccaaatacaaacaatcacaaaccacacaaccac

SEQ ID NO: 716659 - DNA, 451 bp, Homo sapiens
acaaatcaacatttttaaaaagaaaatgtaaagagatggggtcttgccaggtcttggccaggctggtcttgaactcccggactcaagcaactctcctgacttggcctcccaaagtgttggaattacaggcatgagccactgcagtagccctgattgttttaaatagaagaaggtctttagacaaacttcacccaattgtcaaccagaaaatgttggaagttccctcctaccccgcccgcctttgagttgtccggcctttctggacctaaccaatgtatttcttaaatatatttgattgatgtctcatggctctttaaatgtataaaagcaagttgtgccccaaccccggccaccttgggcacatgttctcaggacctcctgaggactgtgtccacaggccatggtcacttatatttggctcagaataaatcttttaaaataaaaaaaaaaa

SEQ ID NO: 716660 - DNA, 301 bp, Homo sapiens
  misc_feature (56)..(57): n is a, c, g, or t
  misc_feature (247)..(247): n is a, c, g, or t
tcatggctcatctgtatcccacactggaggcaggtggcagatcactgagtaggagnntcagacagctgacacatgtgaaacccgtctctactaaaatacaaaaaataagctgggtgtggtgcgcatgccaatagtcccagctactcaggaggctgagacacaagaaatcacttgagcccggaggcgaaggttgtagggagctgagatggtgccactgcactccaccctggctgacagagtgagactncatctaaagaacaaaacaaaggaaataacgtctgtgagctgtgttgactcatac

SEQ ID NO: 716661 - DNA, 124 bp, Homo sapiens
tgactgctgcttgaatgtttttggaggctgttttttaaggaaggggtttttttaatgtgatcccttcatttgaatattaatggctttttccattaaaaaataaaatattttgggcaatgccgga

SEQ ID NO: 716662 - DNA, 585 bp, Homo sapiens
ccactaagaccttatggcccaaggtgcgcaactgccagtctggcgcggtcgttgtgcacctgtggaggtgcctacaggagacaggacggtaagatctccgccaggcaccatctctccgcactcccccgtgaccatggacccatcgtagatcaatgagactttcaaatacatcaacacggttgtgtcctgccttgtgttcgtgctgtggatcatcgggaactccatacttctgagaattatctacgagaaccaagtgcatgcgaaacggtcccagtatcttgatctgccagcttgtgttctgggagacctgagtgccacaatcagtcattgacatcccgtatcaatgtctacacatctgcatggctagaggactggccattaggagctgagatgtgtaagcgtgatgcctttcatacagaaagactccggtgggaatcactgtgctgagtctattgtgctctgagatattgacagatatctgagctgttgcttcttggagtagaattataggaagttggggttccagagatggatagcacgtagaaattgtttgagtagggaatggtggtttggggttctgggatg

SEQ ID NO: 716663 - DNA, 157 bp, Homo sapiens
cgaggtcttgacgtagaaggagattgcttggcgttggttgggttttgtctggcttgagcttgggcaccttcaggcgattgacagattaggctctttcattccagacttccttgccccagggcttgcttggcccttccccagcttctgttgctggaac

SEQ ID NO: 716664 - DNA, 400 bp, Homo sapiens
ctgctctcctatatctcacatgggcataaaactatcttagatgtcatgatgtaattgcattattgtttcagattttccacccctccctctatggaagcccttttctaggttcctctggtagagtaccaggcatatggcttcctgccacagggatcctgctgttggtcctgtgacagtttggccaacgaaatgttagcagacatgatacaagcagaggctttagaagtaggtgcttgtgtagctggattcacctatgtgtgcgtctttcattactatgagaatcatggtttctaaatgggtgtgacatacggagctcacctcacccatcccacaagtgggacttaaaccaagtttagaagaaatgaacttcatctgacgtacagatccatgagtggccaaa

SEQ ID NO: 716665 - DNA, 869 bp, Homo sapiens
tgtagtgcctcacgcctgtaatcccagcacttgggaggctgaggtgggcggatcacctgaggtcaggagttgagaccagcctgccaacatggtgaaaccccatctctactaaagatacaaaaaatagccaggtgtggtggtgcatgcctttagtcccagctacttgggaggctgaagcaggagaatcactcgggcccgggaggcgggaggttgtagtgagccgagaatgcgccactgcactgctgcctgggagacagggcgagactccactcaaaaagtaaaaataaaaataaacaaatacttttccacaaaatatttacctgccaacaagtaatagaatgaataactataggctttggcacttgtatgttaacagacccttgtaaattgtccaaccaagccttttctgtgccacacatttctcgtgtcagtaggatccgtagtgatgtcccatctgtcgttcctgatgtggctacttgtggcttctatttctgggtcagtctggtatagatctcagcccatgtggtctgttaataccagcccggaaggctggcaccaagggtcatgctggtaactccagcaagtgggagagcaagggagtggaccacctgagtcagggagttgagaccagcggcacatggaaaccggctctactaaaatacgaataactgggcggggggggcgccgacccagactcgggagcgcgcaggaaagagagctgtgggacagccctactgggacaattctctggcacggcaggggacaacgaacagaggggatgagcacaccactagcgagagaggtggcgagaaagagagcaccaaaacagagagagagacacagcggacggaaaggcgaacgcaacacag

SEQ ID NO: 716666 - DNA, 317 bp, Homo sapiens
ggcacgaggtggaggctcgctggtgtccctgcagtgcatgactgccaccttctgaggtttccacactgcctctaataattgtagaatttcttgttgatattttatgtcctttcccctagagtttaacaggcccttttccttatataatgctccatgcacttggagggttagaaaggcatatcaagagtcagtgtagatatttacagtcttaccttcactgagttctagagcccgagttaaagcaatgagctcagccttctgggctgaagtgccctgtggcaatggtttggcttcaatgacagcgttcaaagttacca

SEQ ID NO: 716667 - DNA, 262 bp, Homo sapiens
aaacagtgcccggctcacggtcttataagagttctagattgttaagagaattaaacaaatttgtgtgtgttacaagcccattcattacaagcgtgggggctatttggtattaaactccaaaagagccatacgaaggcactacatgaaataatgcactgagtttgcaatgctatcactgtctttgactgggattttatgtctaaaaagtatgttctaaaattattatatgtacatgggtgaattatgtttcccaggcactgtt

SEQ ID NO: 716668 - DNA, 248 bp, Homo sapiens
gcccctttccatccagtggctgctgtttcccaagacgggctaagcgtttcttatctgaaatgcttgggacaggagtgttacagattttggattttttcagactttggaatatttgcatatatacataatgaggtatcttggtaggtctcatgtctaaacatgaaattcattcatgttttatatataccttatacatgtagcctgaaggtaactctatacagtattttaaataattttgtacatgaaac

SEQ ID NO: 716669 - DNA, 223 bp, Homo sapiens
  misc_feature (180)..(180): n is a, c, g, or t
agccggtctttccttggctttcgccgcgcactccgccgcatggagcagcgccgcgtcaccgacttcttcgcgcgccgcgcccgggcccccgatggcgcaatggtggaccagcgagcgacggacggtgtaaggacgagggcgcacgcaagatggggtggggggcgggggggggtgtggtgnggggagcagggaagcggggggcgcgcggggggtctgggtgtgc

SEQ ID NO: 716670 - DNA, 364 bp, Homo sapiens
tgtatttgaggccagactgttactctgagagtggggatagtccataggcgctgcagtgctgctgcagcagcgtgggtggccacaagccactccctgccagacgcacccttagctgcgacaagcacagatgtccccagacactgccagtgtcccccagggggacaaaatcaacctccttaatagagagaaacactaaagtatttatgggcttaacacacaactgtggccgggaagatggtggctcacgcactgataatcccagacacttctgggaggccgcaggcggggcggctcacgaggtcaggagatccaagatcatcctggaacaaaaatgtatgaaaccccgatctccaccaaaaataca

SEQ ID NO: 716671 - DNA, 255 bp, Homo sapiens
catgtatctaattggagctacagctgcccgcctacaccacagtcacggaaacaacagatccgagccacagtcttagacccacaccacagctcacagcaaagccagatccttaacccactgagcaaggccaggaatccaaacatgcaccctcacagtacactaaacagatacgtctaccactgcagccacgacaggaactccaacactgtgatagttaagggtatacactgtggacgtctcaacggagaagcgaaa

SEQ ID NO: 716672 - DNA, 309 bp, Homo sapiens
  misc_feature (6)..(6): n is a, c, g, or t
  misc_feature (71)..(71): n is a, c, g, or t
  misc_feature (73)..(73): n is a, c, g, or t
gcatgnccgtgccccgtgcgccccgtggcccgccgcgacagtggatcgcagcaccacatcggagccttgcncntctcgccttgacgcctgcctcgaggctgcgcgtggtctgcgcgcgaccacgtacacgcggcagtacatgaccacgatgaccccatgggcaggtataggagcacacggaggagaagacagctagcccgcctcctcgtgatacccagaagcttcttcagggcacgggctccttccagccagcaggggcctacggacaccaccaggctacgacccagagcagggccaggatggcggccc

SEQ ID NO: 716673 - DNA, 346 bp, Homo sapiens
acccgcgtgggccttttcctctgacccgcgatctaatctctgtgctcggtgtaatcggcgacgcgctggctgcgaataacgtgcgtgccaaacagcaacgagagatactcacggctacactggggctttccggtgcctggatgagaatgctggagacgtagcattagtgaaagatgtcactagtctatgcagaacactgatggaaataacaatgaggcatgggctaaggattagaaagcaggcagactattgcgctactgtgcctcgatagcaaacggaagcctgtgactgaggctagaagctgccatcttgccatggccccgaatcatgccgtggtgtctcggat

SEQ ID NO: 716674 - DNA, 100 bp, Homo sapiens
ctcagaatctgtccctgaaggtctgattccaaaaagacagagaaaacagggaaggacggaaagaagggaaggagagaaggaaggaagagtagagggaggt

SEQ ID NO: 716675 - DNA, 1413 bp, Homo sapiens
cgggaatggagtagatgggagacccggtcgatgctggccacgttggggatcaatgcgattggaattaatacgcatactctttgttccactccatctggcacagcctgagaagccttctgaggcgctagtggggcggttggaggagcacaggtcttgcgaacatctggagaggactggagtgagtagaactcacgctgtgacttcattctcctagtggcggagactcactcaattgaatggccagtatgcgagattgatgcgtgagatgataggcaattcatacttcacgccgatcatcctgggagagatcattgagtccagtgctagcgcatgttcatgcagtctgctaggcgttttccatggtactagggacttgaaccactacgcagggcgttcgtggcaagacggttaacagtgcaaattgggatcgtgtggataagccagggaatggcgtaggctaggaatagcgtttcggggtcaggcgcttactcacgcaggcacaaaatacgcacaaaaaaagacttcccaaagaaccttgtcgacgccaaagggccagtgcacgccatgtatgcggatttgtacgctttcacactccccagagatacacgtataccgtaacttaagacggtcgtgttgtgctctagtacagccagacacgaacttttccgcctttgtggttggcgtagcgcgcaatgggcctgaggacggggtaccgggaaaggccccgcgttgtcatagggtggcgagggcagcaaggccagaaggcaagagggaacggatccggggcaaagatttgggggcggttaggtaatttgttccccgttggcacgggaaaacgtccgagaccggattctaggaggaaaggcgctttccgtgtagggtaacccaaataggggttaatacctcgaaagaacttcggttcccaggggggctatgggcgttcccccaggagagggcaaagtaggccacaagggacaaagattggccgaaggaatggcgacacgctgctatagcccttatagacctataggggtccccccaaacggagagacttggggccacgaattagggcatacacggggcggcgcctttggggccgcaagcgtgtgaatttccccataggcgaggtttcggcttttgggcaggcggggggtcacacactccccccaaaattgttttgggctaaagggcgatcttcgacggtggggttctaaaggtagaccccaccgaaccaggcttgggggcggggatttggcccccctttggttgagatcccacaatttggcccgtaggatctcgcgcgcttaccgtgcgcttcaaccccctttgctctatgtgcgttcctcttggtcacgttatgcggccctgccttccacagatttttatctccctccccgcggttgtgccccccaa

SEQ ID NO: 716676 - DNA, 122 bp, Homo sapiens
gagcggtagagggatcgcggtagacacggcactggagtggcagaagattgcagaggagctagggaccagccgcagcgccttccaggtgcctgcagaaaattccagcaggcacaaacaaaagc

SEQ ID NO: 716677 - DNA, 177 bp, Homo sapiens
ttcatatcagagctgtgatcttgagagcctctccttggctttccctgctgagtctcgaggagctggggcatcaaggcggaccatgtgtcaacttatgccatgtttgtacagacccatagaccaacaggagagtttatgtatgaactttgattgaagatgagcccctcccccccccct

SEQ ID NO: 716678 - DNA, 790 bp, Homo sapiens
  misc_feature (334)..(334): n is a, c, g, or t
ggtcaatggactctacgggagcttgggggaacccacccaggccttggtccggccctcgggagccctgggcaacttctccctggagcatggaggcctggctaggtgccctagagcatgtaccgagagctgcgtcctggcagcccctatcgtgtgtcccccacagtcctgcgtccgcgtccgtctgcatgtatgagtcggaaacaggcgatgggggagttattgccatggcgtgacccattcatcatggatctgtgttccagtgcggtctcacgtgtcttcttgggcgtcggtcgtgggccctcatcgcagaatcatggtactccgaccagtcganctttgatttccgtcatggtacggcgaggtgatccggagttctaaccagtagcttcaacggtgaaggccctcgaagcagtcgaggccgtttgggagattgccaaaagtgaccagccgacgcacgcatcgctccgcgcgtacccagtcttgtctggacagacggggttcgtccagagctctaagtttcgtagcaactcttgggatcacacactccttgggagcagggtgggcacgagggggacaccatgggtggttctagggggcacgaaagggctcttgtcccctgacggcgcagaccccgagtgtgttggcgtctgagaggacctcgattctccttgttgtgggagtcgctgataggaccgccctccggcggttccgcttacgcaacaagcttgggaaggaatttcagaacctggccttatacataatcaccctggaatcatttcctcatagcctg

SEQ ID NO: 716679 - DNA, 138 bp, Homo sapiens
gaagtctttgaccgtacaaagaaatgcatacatatcaaaatgtggaatagaaaggaaaacctatttaagatatcaaactatgacacatcataaagaatactattacataaaataaaggtccaggatagtggctcttgc

SEQ ID NO: 716680 - DNA, 383 bp, Homo sapiens
aaggaaatatagaatataaaaaattttatgcttaatttaactcccacttcataactggggtagaaaacatatatacgtaagcataaaaaaagattgataggggccaggttcggtggctcccccctgtaatcccagccctttgggagacccaggtgggtgggttcaaggtgtcgggggatcgaggcccttcctggttccggtgaaaccctgttttttctaaaaatacaaaaaattagccgggcttggttgggggggcctagagtcccagctactcagggggttgaggcaggggaatggtgtgaacccgggggggggggcttgtagtgagttgagattgggcccctgccctccagcctgggcaacagagtggggctccccctcca

SEQ ID NO: 716681 - DNA, 411 bp, Homo sapiens
cggggatgcaagcggatagaaactgcagaaacccagagctgtacccttgacgtgtgactgcccagtgcattgctgagcggcaggggtgatgttccatgtgtgtgtgggtctgttgggctggagatggctttctgtggaaaggatgtggacttcgacggttaccccgacgaagaactgccatgctctgccaggaactgtaaaaaggacaacttgcatatatgtgccaaattctggccaagaagatgcggacagatatggcattggcgacgcttgtgacgaggatgctgacggacatgggatcctgaattagcaggataactgtgtcctgattcataatgtggaccaaaggaacagcgataaagatatctttggggatgcctgtgataactgcctgagtgtcttaaataacga

SEQ ID NO: 716682 - DNA, 745 bp, Homo sapiens
  misc_feature (465)..(465): n is a, c, g, or t
  misc_feature (507)..(507): n is a, c, g, or t
  misc_feature (511)..(511): n is a, c, g, or t
  misc_feature (528)..(528): n is a, c, g, or t
  misc_feature (542)..(542): n is a, c, g, or t
tgatgagggaaccccccctcctgctagacactatcgggggcccccaggggatccacggtcccctctgtagaaggaattcacgtcatctttacccccggagggaccttccctgccctcctgtggggtgctctttgggacactcgattatgaggaaaaggataaaatggatgagctagggctctgggggtctgcctgcacaactctgggagcccaggggccccagcaccctccaggacaggagattctgggatacctgtctgctggagtacaagtgcttcacaagggttactcctccaaacccccagtgtttcactcatgtccccaactcaagggcgtagaaaacagccagatggagaaataaatgttttagcatgcgtcccccccccgtgacctgcacgggcactcaccctgtctcacgggagacacaggtacaacaggtcaccacatggggaattctagcccccnctggggggatgttacaaccacccagctggttattttggcggnctgntagttgtggggggaatngtgtgtgtgcacgntgtgtgtgtgtgtgtgtgtgtgtgtgtgtgttctgtgacctcctgtccccatggtagcgtccccaccctgtccccagatccccctattccctccacaataacagaaacactcccagggactttggggagaggctgaggacaaatacctgctgtcactccagaggacattttttttagcaataaaattgagtgtcaactattta

SEQ ID NO: 716683 - DNA, 464 bp, Homo sapiens
  misc_feature (6)..(6): n is a, c, g, or t
  misc_feature (384)..(384): n is a, c, g, or t
  misc_feature (410)..(410): n is a, c, g, or t
  misc_feature (445)..(445): n is a, c, g, or t
  misc_feature (464)..(464): n is a, c, g, or t
ggttancactaaggatgtacagtcataatattatgctgtcaaatcacctgaaataattcttctctgtgtgtttaagcctgccaatttcatagtgttaggttcatttgtttggttttggttttacgaattgccttatttattttgatttaaccttattttgtaattattttaaaacatttaggccaggagctgtggctcacacctgtaatcccagcattttgggaggccaaggaaggaggatcacttgagcccaggagttcaggaccagcctgggcatcacagggagacccctgtctttacaaaacatttacaaattagctgggtgtggtggtgcgcacctgtaacccaagctacttgggaggctgaggtgagaggatcacttgnagtccaggtatttcaaggcagcagtngagcgtggattgtgctactgcattccagcctgagntacaagtgagaccccttgn

SEQ ID NO: 716684 - DNA, 155 bp, Homo sapiens
aaggagttgccaagatcacaaaaaaggagacagccgaagaatgacacatgaatgtaatagctcacagaataaacctcatgtacctagttacatgtcatgctacgatgtgggggaaagatccaaaaccagataagataaaaagaacaatcggaggg

SEQ ID NO: 716685 - DNA, 427 bp, Homo sapiens
  misc_feature (126)..(126): n is a, c, g, or t
  misc_feature (166)..(166): n is a, c, g, or t
ggcaaacccaacagcacactgtagctatagtccctatgtgattgctttttaatccctgtagcatcctgttccttcagcaggtgaaaaaccaaacgccgttcaactcccatggttctcaccttccantcagcagcactcaaaaacccaaacctccactaacccgcanttcttcaacagacttagtgtatccagccttcactccagctgctctaaaaatgttgcacttatcagcaaccctcccactttcatctgctgaaaggacaaatgcccttcgttccactattatgtcctcacacccaccttctccgcttgcagttgcttacactcatgcattttgtcttgccctgcaattcgttttatgcttattcttattactctactccagtagttcactttgctgcatgccaaaataaattgaaattcccct

SEQ ID NO: 716686 - DNA, 177 bp, Homo sapiens
tgcaggtgatctctagcaggatccccctaccgagcctggtgattagctggtcgtccataggatagaatcttagtttcaactttagaattttgcccacagaaaccctctaaatctcccttgtaatatttgagctgttagttccaaagtagaaacagctcttctggacactagcgaaca

SEQ ID NO: 716687 - DNA, 236 bp, Homo sapiens
caacaacacacagcgggtccttgaaaggccgacctcataaaacaccagccaatctgaaaggatattttcaggtggaaccagaacagcacctagcttccaacttaggaagcttcgtgatttccagatctccgcaaatgacttcattgccaagaagagaagaaaattgcatttaagtggaaattcggacctctaatcccaggcatattcgcttcgctattcaatcgcccaaaccagga

SEQ ID NO: 716688 - DNA, 312 bp, Homo sapiens
gccagtttgagtgtacatgtggagtagcttgggctgatgcccgatctctaaaacgccatgtcagaacacatactggtgaacggccctatgtctgtcctggtatgtagcgaagcctacagtagatgctcgtaacactccgggaaacatatagactaagattccacagtagactgatgtgccttgcgaaaattatgctgtgaaaaagacaccctttcagatttcataacccaatggaactcatagtggcacatgtcttttagcagtcttaactagcaggcatgcagggctgctttcagggctggttcttgttcg

SEQ ID NO: 716689 - DNA, 971 bp, Homo sapiens
gggagcatttcctggcagaaggcgcgcaccgagcgcaggaggcgaggtccagctcccggactatgagctcgcccaccccgtgacgcaaggctctgggccgcactccgcgggtccctggccgggagcttcgacggcgggagttgacccagacggtctcttcgagacgcagccgcgcgggtaccggggggagccccagtgataaccccgcgcctcacaagggccgcaaaaagcttcggggggccggtggcgagcggcccaaagcaccgcgttttgtttcagcccccgggtgaattccaaggcacaagtttcttccccccgaagaaaccccggggggggcgccgccccagggcccagaggccgccgccggacacaaaagaggcgcgcaccagatatcaggtgcccggccgagacagggtgtggcccgtcgtggccatcgggatcgcagggcgcccaggtaggggccaccaaagcggggaccacaccaacggggggagattacgcgcaacgcccgggccgcgccattcacagaggcacacccaaagggaagaacacccagcggtgtacggcggaacaaacgcgcgtgggacgccgcagcagctgagcagttgcgaccccagcagtgtggatcgcccatataaacggctgaggaagaagggacacccccaaaaccgccgtggggggtgccccctgtgaagatggggtggaacaacggggcgggccacaacaaacgaaacgatggcggcgcgacacggaactctatcaccacaaggcaggggcacctatggggggggctcccacaggacacgcgaaacaggaggctgcgcggcatacatctacaagagcacccacgagcgggctcgcaaggggattctcacaacagcagggggacgccagaagcggggcggtgccctccatggctggcaacgaggcgacggccctggcacggaaccaagctcaccggacactcggga

SEQ ID NO: 716690 - DNA, 335 bp, Homo sapiens
cacacgcttggctaattttgtattttaggttgagatggggtctcgccctgttggccaggctggtctcgaactcctgaactcaacgatctggctacctcaggctcccaaagtactgggattacaggcatcagccaccatgcccggcccatgccagcctctcttctacgcatcttgtatttatcatcttatttaatcctcatgacaaccttatgaggtaggcacatactattattattcccatttaacagatggggaaattgaggcacggagaagctaagtaacttactcaagatcacagaactctaagtggtagaacaagaaggcaaacacagcag

SEQ ID NO: 716691 - DNA, 774 bp, Homo sapiens
aatctgccaaaattccagatcttttctgtcgccaggtgtcccaagggcttctgctgagtacccccccaagcccctgggcgtctacagaccggcgcaccagtgtgtcgcggatcgggaacagcctgttggtcttagtcgttgtcctggagaatgatgttcttgtaaatcgccgttatggtataacacgggcttatggtcccgtgtgtttccccctctgttttaaaccacggaaatcaaaggggtgtcagcgtcccttttctccaattccgaagttgcgtaccccgggtatcgccacgttattagacccaaggcagacaccacttcccgttggaccactttattgcgcctagtgtgaccaaccacttgcgttgaatgctggtgggtccctatccccttgaccactagcagcaagtgttctgaataagtgtttatgctatgtgaccaaaacgcccccgattcctagggcccaaagggtctactttatgtatataccctggaaaccccacgccaattgggctccttttttttttttatggtgcttgaagttaaccagccccatcctctgcaagtcccatctatgttgttcttaggccattctatctttgctccaaattgttgaaggatggtgattttttcatggtttttgtatttgagtcttatgcacgttctacatgatagaggccatgccttattggtagccccggttttctgggaaagttgatattttaggaattgtatttcagatcttaaattaaatttgtttctaaatttcca

SEQ ID NO: 716692 - DNA, 179 bp, Homo sapiens
cgccggtacctttctccctagcagcataagctgttcactttcttattcatatctagtggagtagcacttgatttttcttcaagaacttttcctttgcattcacaacttggcctactgtttgccttaagaggcctattttagctttcagcatgccttcctcacccgtctaggagcgtaat

SEQ ID NO: 716693 - DNA, 664 bp, Homo sapiens
agaagagcaataatgcatgcgcataggttctgaaaaataatgttagcagcatatagtgggttgtaacctgggactgatacaacccatgtgcaatgcaaagtctgactcatcaggccaggatagatctacacccgaagccaatactctttgattttcatctcggggtctagggagtatgagtccatattttcaaattggggactttaaagaaggtgatttagacaatatgacataaatttcccatgttaaacatggcttgcttttcagaatgctgagaaataattatgcaggcatcaagctcctgtggaaaggctgatcattctccatgctctcatcggcattcaatgactgcttagcctggtcaattagaaaatatgggcatactattcgtgtagcgtaagctcccttggaacattcgagtatgtttagcgacaacatctaaattgtttccagcaatggacagtatagtccttcatttcaacaggtatagcgaagtactgacattatatggtggctggtctttgtgtagttcagtcatcgcttctttctttgtactcaaagtcatcgctgtaaaggcctacattgtatgacgtcatgtgcgtatctgaccctagctgtctaaaccagtagcgcattcgtcagctcgttacgaattcggcacgag

SEQ ID NO: 716694 - DNA, 859 bp, Homo sapiens
  misc_feature (299)..(299): n is a, c, g, or t
  misc_feature (356)..(356): n is a, c, g, or t
  misc_feature (360)..(360): n is a, c, g, or t
  misc_feature (377)..(377): n is a, c, g, or t
  misc_feature (391)..(391): n is a, c, g, or t
  misc_feature (582)..(582): n is a, c, g, or t
  misc_feature (619)..(619): n is a, c, g, or t
  misc_feature (626)..(626): n is a, c, g, or t
  misc_feature (632)..(632): n is a, c, g, or t
  misc_feature (695)..(695): n is a, c, g, or t
  misc_feature (701)..(701): n is a, c, g, or t
  misc_feature (745)..(745): n is a, c, g, or t
  misc_feature (759)..(759): n is a, c, g, or t
  misc_feature (771)..(771): n is a, c, g, or t
  misc_feature (818)..(818): n is a, c, g, or t
tctcccccaccccctcctcccctcccccattccccccctccacgctcccacaccatcttcccccccccaccttctctccacaatcacaatcccaatccaaccaccctctctcctcttccccctcctcctcctcctccctctcttctcccattcacctcataccctccactcctacaactctcctaacccaactcctcactcccaaacacccctcaattcttcatctcattttcatgcctctctcattaccaaacctcccttacaactctataacaactcttccaactttcaccattccnatttcaaccacctcacaacccccttcacccaaaatcacctaacctactactcctccnacanccacctctctcactttnaccaacaccttcanaatcctcccacatccttatcacacaaaacacttcttctcctcctcactccatttctcccaccagcctccagccttcatccctaagtcaacaccaggagagcttctcccaaactccccgttcctgcgtagtccgctttctcttgctgccacattctaaaggcttgatattttccaaatggatcctgttgggnaagaataaaattagcttgagcaacctggctaagatanaggggcnctgggngactttgaagaccagtcctgtttgcagggaagccccacttgaaggaagaagtctaacagtgangtaggngtgacttgaactagattgcatgcttcctcctttgctcttgggangaccagctttgcantgacagcttgantgggttctctgcagccctcagattatttttcctctggctccttggangtagtcagttagcatcattagtacatctttggagggtgggg

SEQ ID NO: 716695 - DNA, 126 bp, Homo sapiens
cattacacatattaaattctatttactatttgttgaatttatttattccagtcagtatatgtaaaataaacatactcttcttcctcccctgaagatgcttggtggcctgaagatttgctttgctgg

SEQ ID NO: 716696 - DNA, 138 bp, Homo sapiens
aggatcgccaggtcatgtatacaagcacagcagtgtctgtagaggagcataatttaaacaagtgctactatcatctacaaaataatagtggtaaagtgtagtatatattttttccttttatgtcagcaatattttaaa

SEQ ID NO: 716697 - DNA, 1495 bp, Homo sapiens
ggccagcaacctctggttttggaccagtttccattttataaggcatttggagcatcagcattacatcaggcagtcatgcgcagtcatgctgtcaacatcacacacaatcacacagctcagtgctttgtccttcagtcagttattcaagcacacattcaacaggcaacaccacacatttcacagtctttcctgtgtcattgcacacacatcaaccgtcaatgcattgctatgcattattagcgattccatagcaagatcaggttttacacctcgctgtctcttccaacactattggttcatcacactctccaccaccgtatctcttgacaaagttctgctcgcataacagacacactctctgtacctgtggcctataacaaccgttcacagacacgaccgaatgaaccaaacgttatggattcctctctcgcactgttgactagcgcgtactatttcgcaaactctgtcttcggtttacactcggtacacgacattttccaaatcagacacacctcacagacacaaattcttaatctcgcaaaacacccatttcacacgtcaatgtgtgcaaacacttgccacattctggtagttctcttaaacacaccattttcatcctctcattcctgttcacatcccttctggcaaacggcacatatcgggtcctctccaacaggtcatcaaacctcggcctaattgtctgaagtgggaatccaacatatccactgcgcaaaccacctttgctctgggtcttcacatatcccacacacatggctcgtttcggctgggcactactttgagcacctggagggcacttccaggtccttcacacattccacacgtatttttctgtaccccacattacgcgcctcttccactgtcggaccgtgggactggttatccatcttcactaagctcgctccttacctaagtttgtggacaaattgttcactccttatttcagttgcacaccacaccaacaaacccagcgcttctccgctgacacctctgtcggcagcccattaccctgtccctgatgccgttgccacaccctcggcaccttacgacaaccaattaacgtgtgtggctggctgaacactgcccctaacaccacaaagacgcaaacacaacacacaccggtgctcggacagcacgcccgccacacccaacacacactacgaaaacagacctgcgagcggcgcgacacgccggcgaacaaccacggagtacccacgtcgacccaccagagaccccacggcaccgcagacgcggaggctctgcacgccaaaaagcaaggcgtgacgcacagcgcgatgatgagacacacccacggactcgccgcagcatgagaacaacccagaccacgaggcataacaacaagcacccagcaatagcctgagcgagacagccaacgccagaccccgccaccgaccaagccagacgcccgacacaccgcgggaggagccgacgccagcaaacgaccacgacgtgcgcc

SEQ ID NO: 716698 - DNA, 362 bp, Homo sapiens
cacattctttgtgtgtgtgattcacaagtactgattttctctcgttctttaaacagaggagtgtgcctccctagtcctcacctgtctcttctgccagttcttggactgcctcttcatgctccctgacacgtgtgagacagtgtgcatcaacctgtgctgcccctctcacaggtactactctgcccccagctcccatccccaccccgcactcaggaccacacactctctgcaagaacaaagagccaaatgagaagtgtaattccctgaatgagttcccaagctccctgtctgttcaacccagctgtgtggtcttcactcattgtccatctgtgtgaggagtgggtggaattcctggtcgacgc

SEQ ID NO: 716699 - DNA, 761 bp, Homo sapiens
gagcgggggggctggtgccaagcggccctgcagtgaggcggcgtgcggcgttcagtcccttgttccccgccgccgccgtcgctgacccagcccgtcaggcgctcctgaccgtcgcgttcctccggtcccaggtccccggtccctcgacctacaagactcccggcccttgttcctgcatgctccgtcgatcgctgggcgcggaccgcacgctcgtcgtcaatgttcatcgaggagtgccaccggtgccgagaggatatcctggaccttgcgaggtcgatgtgggagcctgatcaggcaggaataacacaacaactcaggagtcgaacaagattaccggaggcggctagtagtgcaaccgcccgtctgtactgtgctctaggctacatgcgaccaattaatccactgaactatgctaaggcaaaattggagcgcagaagaagttccactatttccatgaacattactgggggcccacgagttcatcctggggaaaaatcacaaaataagtaaatggtggtcgtatcggtacaacaaagttggagttccgtgaaatttgaggagatctacaaggcacaactacttcgcagaaatgcggacattccgccaaagaatgataccccctggaaggcttgagacttccaaaagggacacggatcctgggcctaccaagcttattggccaacaaaaaaaatccctcgcgtggcgcgggcaacataaagaagcaaatttgaaccaagcaagacttggaccccatagaacaa

SEQ ID NO: 716700 - DNA, 166 bp, Homo sapiens
gatccgggtctcgactattgtgctgttcagagtatgttcaagccactgttcgtggtcatattccgtgtcagctgggagttttgtactactcaagtgagttttagctttattggggagggggtgatctaaaacactctttacgccggcttctattgacttggcttat

SEQ ID NO: 716701 - DNA, 1720 bp, Homo sapiens
cctcattgactccatcctgcgggagagtgaacctgcccccggctccgtcacagaccctcacggacgccaggggccacacggacaccgagggccggcctccctcccccccgacaccaacataccaacacctgcaaaagtgccatcagacatagacatgacctggaacaagaatgagactcaagaagacacacttggatgcactaatggacaacccaacacatgagcaaaaaccaagcacgcaccactgcatgagcacacgccagcggcaatatacagccgaagagacaaacaagatgccacacagaaagagaacaatcgaacaggcccccctacgagtgacacagaagaccacagaaccactacgcagagcacgcgagcaagcacgcatcgcaacaagcacaagacctcatggacccacagaatacatcccacagcaacgaccaacacaaagttccatcacgcacaaagcgaaaaaccaaccacccaagcagacacaaaccacagaagagacaagcaagcacacacaagaacgcgcaacggcactacacacggacacagcaagcccatgagcagccacaatacaacccacaacggccacccacagcctagacacccaacgacgacgacaacacacacagcgcaccccagctgtgcaacaccacagcacacagccaacaccagaatcccacagacaccgagaacgccatgcaaacacgacgacatgacagaacacacgcgggcatccctaaccgcacatacaccgcacacaggacgagcaccggcgcccatagtccgcaccaggacgaggcaacgaccacgaaacgcacagaacaccaccgcacggccaggacacaaggcagagctaccggaaaagcgcgcctaccgccacaaacaggcatcaaaaagcaggaacaccacccacacataggaccagtcccactacccacgcggacacgcaagcgcgaacggcgcgcctacgcgcacccaccagagccacacgcacgccagcagccccacccacacctcccacaacagtcagaaacacacgaccagtacgcgcaacaccatgcgaacaacacgacaagacgacaccaaacactaccacgcaagcacaacaaagacagcaaacacaggagaacagcgacacaccaacagcacaaccaagagccacacaacagaccagcagaaccctcaaacgacaaaaacagagagaagagcaaccagaacccacaatgagcaagaaagcaaagagccaaccgaaacaggcagcacacagaaactgaagcacagaccaagcacaacagcacgaaagaaagaatgagacaacagcagcaggcgacacaacgagagacacgcagccagagcagccgaatcagcacgagccgacagagacaccagacacagagaaaacaaacggagcagaaaggcaccgcagcagcgcgacaccaccagacagacaagacaccaccccgcgacgcacacgcggagcacacaagaacagccacagaacacgcgccaccaagcacaccacgcgaagaacccgaccaacgagcgcgcgcagcaccacgcccacgacactacagaagcgcacccgagagcaggcgaaacgagagcagagaaagcccaacgacgaacaaccgccaggcgcacaagagacagacagcagagcagcaaacaacgccgacggaagcaagcgacaacaaacgagacacaaccggct

SEQ ID NO: 716702 - DNA, 382 bp, Homo sapiens
  misc_feature (239)..(240): n is a, c, g, or t
agcagcatggcacttaacagagagttctctttcattgtgatcactaccgtgacacttactttgtgcctatcaggactttttgcaatattgcgctctgtcggctttccaatcttcagggatatcatcgagctagaccattccctactatggatttattttttttcctttcaaacacagtaaggaaacaatctattacttttttccttaaaaggagaatttatagcactgtaatacagctnnaaaatatttttagaatgatgtaaatagttaaccttcagtagtctattaaggcattaatacttctctgacatgcgcgtttgagggtggaggggtcctgaaggtgcttcatcgtctgtgattactgcttgggatgtgttctttg

SEQ ID NO: 716703 - DNA, 134 bp, Homo sapiens
acttgttgttgagtgaagtcggagattgcggcgcggcgctgctgctcattgagttgtgctggagccagcctcgtgtgtacttgtgcgcagatggtgcttgcacagaagtctggctgtttcggcctacgtgctgg

SEQ ID NO: 716704 - DNA, 545 bp, Homo sapiens
  misc_feature (78)..(78): n is a, c, g, or t
  misc_feature (186)..(186): n is a, c, g, or t
aaggagggcaatgaccaaatgttaacggccagacaaaaccagcagctctttgtgggaatggtccccaccaatgttcangacagccgtttgtgacatccccccttgtggcctcaaaatggcagtccccttcattggcaatagcccacccatccaggagcttttcaagggcattttggagcagttcantgccatgttcccccggaaggccttcctcccttggtacacaggggagggcatggacaaaatggagttccccgaggttgaaagcaacatgaacgcccttgtttttgagaatcaccagtaccaggatgcccccccaaaaaaggaggaggatttcggtgaggaggccaaaaaggaggcctaaggcaaagcccccatcccctcagggttttcagttcccttacccgttttaatcaaaggcccctttcctttcccccaaaatttgggtttgcggcctctattttgttttttgtttttttttttgggggggggtttaaaacagggcctggcccaaagtaggggcccaaaaaaaacttgtttgttga

SEQ ID NO: 716705 - DNA, 352 bp, Homo sapiens
  misc_feature (62)..(62): n is a, c, g, or t
  misc_feature (75)..(76): n is a, c, g, or t
  misc_feature (80)..(80): n is a, c, g, or t
  misc_feature (87)..(87): n is a, c, g, or t
  misc_feature (93)..(93): n is a, c, g, or t
  misc_feature (98)..(99): n is a, c, g, or t
  misc_feature (107)..(107): n is a, c, g, or t
  misc_feature (115)..(116): n is a, c, g, or t
  misc_feature (118)..(118): n is a, c, g, or t
  misc_feature (135)..(135): n is a, c, g, or t
  misc_feature (161)..(161): n is a, c, g, or t
  misc_feature (169)..(170): n is a, c, g, or t
  misc_feature (174)..(174): n is a, c, g, or t
  misc_feature (176)..(176): n is a, c, g, or t
  misc_feature (182)..(182): n is a, c, g, or t
  misc_feature (188)..(188): n is a, c, g, or t
  misc_feature (199)..(199): n is a, c, g, or t
  misc_feature (209)..(211): n is a, c, g, or t
  misc_feature (234)..(234): n is a, c, g, or t
ttttcaaatagctttttgtttgttgggaagttggggttttggggggagggggagtattagtncgttgcatgaaanngctncctttanaatganggaanngctttttnttttgtcnngngattttttttttgaagngaaatttacctttttgggcaagtagnactattanncccntnttcagngttttncttgggctgtntcccattccnnnccctcatttaatttttaataaanctgttcccttgtttttttggggagcatggtaattcctggaatagtataaatgtgttgaatggtttttgaaaaaatgaattaagattccaataaccccccattgcaggaaaccaatgta

SEQ ID NO: 716706 - DNA, 253 bp, Homo sapiens
  misc_feature (32)..(32): n is a, c, g, or t
  misc_feature (57)..(57): n is a, c, g, or t
  misc_feature (59)..(59): n is a, c, g, or t
  misc_feature (66)..(66): n is a, c, g, or t
  misc_feature (68)..(69): n is a, c, g, or t
  misc_feature (98)..(98): n is a, c, g, or t
  misc_feature (109)..(109): n is a, c, g, or t
  misc_feature (200)..(202): n is a, c, g, or t
  misc_feature (229)..(229): n is a, c, g, or t
  misc_feature (231)..(231): n is a, c, g, or t
  misc_feature (233)..(233): n is a, c, g, or t
gaagacttaaagaatctgctcaaatgatttantttctgagtctcttcacattaactntnatatgantnncaaaaaattattacctgcttatatccccngagtatctgtntcatataaagagatgctgcatgttcactgtgaagtattgctgaattaaattgaaaatgtcagataaaactgatacatgatgtagttataannntgctgttatgaagaaaaaaggaatgcntncncctcggtggcctttgataaa

SEQ ID NO: 716707 - DNA, 870 bp, Homo sapiens
gcaggccgcgcatgcagcctccgtgtgagtcccgggacagcgctggtagggagtcagtaaggagcccagcgatagtgccaacacctaagagacctcgggggccgaccaaaggtgaagctaaaatacaagggtgctgccaagacccggaataaccgacctactaactcctaggaatggaaaccaagggtgcatgacccaaaaaactggagaaggaggaagaggagggcatctcgcaggagtcctcgggaggaggatgcatgtgacccatgctgtgcctgcctgctcctcactggaggagcagcttccttctgggactggacagcttttgcttccgctccccatcccgcgctcccgcgcctcgttcccccaggggcccaaacgatcagtcgacgcggccgtcgtgggtccggcgtcgccacgctgtcgttccaaccttggtgctccgttctacctccagggtgtcagcctgggtgaccaggccggtgcgcgggcgtccggattgggcttcttcgaagttgggggaggcgccacgcgagttacccgcctgtggaccggtcagggttccggccgatggaatccggcgccgggcccaacctcgggtcattagccacaggttttgccccgtccgttgtacccctgtgcttaacgtgttccccgcagtttatgcctgcgcaatcttttgtgccatgcgatgtcttgttgccgcgacttccccgtagggtgggttgagggcactcggggccttctgggcgctttgggactaggggggtcgcccgtctctgcttgcttcagtgttcccctcttggattacccatcgtggtgtggctggatgggtccccctgacgtgaccagggtccatacccccggcta

SEQ ID NO: 716708 - DNA, 155 bp, Homo sapiens
ggaaggtcttcttttcctccttcttccctttagcacctctgctaacttttgctccaggttctttcttagcagatgtttttcttggtttgggttcaggtttggtggagcaggtttcgctgacaatccagcggcggcgcagagttcccagtccgttg

SEQ ID NO: 716709 - DNA, 536 bp, Homo sapiens
gagtgcagaggtgctctatctctgcctgcgatgcagcgctcctcagcggtagtaggggccggagctctgatacagagagctccagcagtgaggaggaggaagagaagacgtctaagtctgcagtacacgaagaagccacagagggtagcaggaggtgcagccccttccaagccagcctctggaaagaaaggaaaggctgagagcagcaacagctcttcttctgatgactccagtgaggaagaggaagagaagctcaagggcaagggctctccaagaccacaagcccccaaggccaatggcacctctgcacgtgactgcccagaatggaaaagcagctaagaacagtgaggaggaggacgaagaaaagaaccaggcggcagtggtagtttccaaatcaggttcattaaagacgcggaagcagaatgaggctgccaaggaggcagagactcctcaggccaagaagataaagcttcagacccctatcacatttccacaacggaagaaaggacgaacaaacgggcatcatccccattccg

SEQ ID NO: 716710 - DNA, 755 bp, Homo sapiens
agctagcatgaaggctcagcttcccgcagaaagccctgagcctagtaagctgtttcgcggggggcgtattaatggccacgttgtctcctggacctgctgactgactacctggctgacatagatgaggccctggcagccttgacacgtgacgctccagttcccactgcaagagttcatcctggccatgggcttcttcctggtcctggtgatggagcagatcacactggacttacaaggagcagtcagggccgtcacctctggaggaaacaagggctctgctgggaacagtgaatggtgggccgcagcattggcatgatgggccaggggtcccacaggacgagtggagccaccagcaaacccactcagcacttgcgtgcctgtgtactggtgtactccctggaccctcacactccgatagtacgaggggcatggcggtagaggctgcagacgagaccgggactcgggccatggagctgtgcctggcatatagcatgcatccacaaggagcatcctggcatgtcaagcctgtccctgcggcatgttgcagagccaccattaggggcacaggtggtggctggacatgtgggatccttctatcgtcatgcatgacacctctaggcatcgggctgggctgccgctcatggcaggagatcggcagagacctctgaaacagaaggacccagactgtgctacagggcatggcagaagaaaacattactctatatcaccattctggaaatcaggcccaggagctg

SEQ ID NO: 716711 - DNA, 287 bp, Homo sapiens
tgctgggattacaggtgtgagccactgtgcctggccgggattcaccattttaaatgccataaagaacatttgtggttcatgggaagaggtcaaaatatcaacattaacaagagttaagttgattctagccctcacggatgactttgagaggtttaagacttcagtagaggaagtaaactacacgtgcagtggaaatagcaagagagtctccgtcgaactagttcgacggggactctcctttataaatcatcagctggcacatgctatagatttttcctttgggattc

SEQ ID NO: 716712 - DNA, 1265 bp, Homo sapiens
  misc_feature (2)..(2): n is a, c, g, or t
  misc_feature (44)..(44): n is a, c, g, or t
  misc_feature (68)..(68): n is a, c, g, or t
  misc_feature (72)..(72): n is a, c, g, or t
  misc_feature (90)..(90): n is a, c, g, or t
  misc_feature (105)..(105): n is a, c, g, or t
  misc_feature (230)..(231): n is a, c, g, or t
  misc_feature (235)..(235): n is a, c, g, or t
  misc_feature (281)..(282): n is a, c, g, or t
  misc_feature (284)..(284): n is a, c, g, or t
  misc_feature (336)..(336): n is a, c, g, or t
  misc_feature (357)..(357): n is a, c, g, or t
  misc_feature (360)..(360): n is a, c, g, or t
  misc_feature (385)..(386): n is a, c, g, or t
  misc_feature (388)..(388): n is a, c, g, or t
  misc_feature (413)..(413): n is a, c, g, or t
  misc_feature (459)..(459): n is a, c, g, or t
  misc_feature (461)..(461): n is a, c, g, or t
  misc_feature (508)..(508): n is a, c, g, or t
  misc_feature (802)..(802): n is a, c, g, or t
  misc_feature (868)..(868): n is a, c, g, or t
  misc_feature (954)..(954): n is a, c, g, or t
  misc_feature (994)..(994): n is a, c, g, or t
  misc_feature (1106)..(1106): n is a, c, g, or t
  misc_feature (1187)..(1187): n is a, c, g, or t
  misc_feature (1256)..(1256): n is a, c, g, or t
cngggagaggatagtatcgttgtgaagaagtatgagcagtcttntgggtaacagcatggatacatagnatanaaagtagatgcgatatcnatcacgctgcgacgncgacgccctcgcaccgcctgccattgtctgcgcggcggccacgcagcacttacacactaactcggtcggacatcatcacgactaccaaagacaacaagatgtatagatccaagacacaaaagaannatanagtatcgtgatatgcggggtagagataagtagcgtgcgcgcagctnnanctacatcggcccgcacagtagtcagtacacgcgcgtcgtgtcggcatggagnggcgaaggacgagaggagagnagnagcaggagaagataagaatagagannangatatatatgttataatgatgtgtnatataggttgtacatatcatttatttcctcttttactcgttatatncnctaccaccgttcaattacctcctcttcaacaagccaaacaccgccancaataaccggcttcgtatggaggcagaggtagattgcactcaatcaataaatatgataaacgacagaaaaactagtaattagagagaagatgattagggtgtgtgtgatgatagtggatggcgggggtggccggtaggcaggtcgtccagtacacatcaactcgtacatcctcacgactacaaatctaaactaatcaaacttcctttatatagagatgttatccattagtagtgtgtcacataacaagatacagtgtgcatatagatggagaacgaggcggtgttggacgcgcntactgatatagtaaggagatgtaagagtacgaactggggcgagtcagctacagagtatacagatgntcagacacatatagtaatataggagccgcaatatagatcatctcgcgcacacgcggcgtagcgcgtgctggcgtgacgccgcgggnctagacggatgtcagtagtgacgtgccgcgaacacatggnactgattacacatacgtgtcgcagaccgtcgggtcgagcgagtgcacctcttcgagtaccagaatagatgagtgcaaccgatagggtacagcaacttcacacgcagcgtgcntgtcacgtaccgcggagtcgtaacgcaaaggtgacggcaagagtaagtgcgcataatgtaagcgcaaccgtagaataaccnacagtacgcacagtcacggatcagcagcgagacagactgatatcatatgtgagttataagttatcatanactacacag

SEQ ID NO: 716713 - DNA, 175 bp, Homo sapiens
  misc_feature (18)..(18): n is a, c, g, or t
  misc_feature (63)..(63): n is a, c, g, or t
  misc_feature (117)..(117): n is a, c, g, or t
  misc_feature (121)..(121): n is a, c, g, or t
  misc_feature (130)..(130): n is a, c, g, or t
aagctctctgtggaagcnctgaacagtctgacgggcgagttcaaagggaagtactaccctctnaagagcatgacggagaaggagcagcagcagctcatcagatgaccacttcctgtncganaagcccgtntccccgctgctgctggcctcaggcatggcccgaaactggcccgac

SEQ ID NO: 716714 - DNA, 450 bp, Homo sapiens
  misc_feature (321)..(321): n is a, c, g, or t
  misc_feature (333)..(333): n is a, c, g, or t
  misc_feature (387)..(387): n is a, c, g, or t
  misc_feature (410)..(410): n is a, c, g, or t
  misc_feature (428)..(428): n is a, c, g, or t
  misc_feature (444)..(444): n is a, c, g, or t
gatgacaagttctaagtagaaaccaaaaccatgaaatttatcaagataaaaatgaacagaaggagcaaaagaaaaacaggtaaaaattttctatggctttctcagcaagatttatttacctcttgctacctataacaaactaaaattcaaactcttatgaagtaagattgatggcccaaacaaacttatattgagctagggagaaatatttgttaagatattgtgacaaagaatattaaatgagttacctcattatttatacagtgatacatgtattattgaaacacttcaagtacttaagggttagtccagtatttagcntgagtcctgggncccaaagcttacagtcctagttgataactgggaggtgggtatttttccggtttnaaatcccggggccggtttttgtnttaaattggaaggtcttncctccccgggggccangggccc

SEQ ID NO: 716715 - DNA, 108 bp, Homo sapiens
cctgctactactcggcagcgtccaccctgctctggcaggccttttgggagtgcgtggtggtggcctgggtgtacggagctgaccgcttcatggacgacattgcctgta

SEQ ID NO: 716716 - DNA, 734 bp, Homo sapiens
tgctgttacggtctggaatttttgggatggcggcgctggcagtaatgaggcgtgctggcggtcgggtctgtcttctgtgtgtgcctttgatgccatgtgtcggtgtgctgccgtgtaccgcggagctgaggagcggggcccggccaggtctggagactttgcgcccgggggcaccggggctgctgcgcggtcggcacacattccacctggcgcggcttccctcggcggccctgggctccgctcatcctgctggcggtcggcgccgtctcaggggcgggaagaggaggcggtagacgcgaccacgagaagatgtcgggccaaacgctcacggatcggatcgccgccgctcagtacagcgttacaggctctgctgtagcaagagcggtctgcaaagccactactcatgaagtaatgggccccaagaaaaaagcacctggactatttgatccaggctaccaaacgagaccaaatgttaatattcctcagatggccgacaatctcttttgagactgggcaacaaaacaagtagcttgggtgagtagtgtataagggctttaggtgacaacacatcatctcattggtgcattggaaaattgagcagattaattcaaatattttggcttctaggaaatacactattcaaatctcagcaattttttggacaaaaagtggatcccatgggttatgatattgtctaacctttcataaggcgctatagtagatatttgaatgac

SEQ ID NO: 716717 - DNA, 221 bp, Homo sapiens
cacgagcgccccaaggagctgagactaagggtgcgtgccaccatgcctggctagagtttaagtgaaatattatcatagcacgagatggagtccagctctgtagcaccaggctgtagtgccgtggcgcaatctgcgctcactgctcgctccacctcccgctttcacgccacactactgcctaagcctgcctgagcagctgcgaccacaggcgcccaccacca

SEQ ID NO: 716718 - DNA, 145 bp, Homo sapiens
ggggcccccccccccttttaaaatttttttccgggtttttttccccccccccccccgggtttcaaggggggggggggggggccccccccttttttttttaaaaaacgggttcaaaaaaaattttttttttttttttttcggggga

SEQ ID NO: 716719 - DNA, 179 bp, Homo sapiens
  misc_feature (40)..(40): n is a, c, g, or t
gggggaggccgtagagtcccgtttagatatgggccccaanacaatgggggtctcttcaccccccacatgaaaaacaaaaaaccctcattcacagggggaaacaccctcaggttcaaacacctatcccccattttcctcctatccctcaacccggacatcattacggggttttcctttta

SEQ ID NO: 716720 - DNA, 256 bp, Homo sapiens
cccccccctttgggggggttggggggggggttttttagggccggaaaataaaaccctttttggttaaccgggggaaccccctttccccttaaaaaaacaaaaaaataagtgggggcgggggggggggccctttttttcccccccctcgggggggttggggggggaaaagggggttccccccgggggggggctttccgtttttttaaaaaggcccccccccgtcccccgggggggaaaaaagggggccccctttcca

SEQ ID NO: 716721 - DNA, 766 bp, Homo sapiens
gttgctgaagtacgactccccagagtatgatgtccctcgtttgggagcttactgtggagagatgagttgctgatggctatccccaggagtggctcaggtctgctatatgatgctatattccctaccaggggactgtcttgatagactgtatgcaaatctttgaaagtcgatgcctatggagacctctggtctgtgcgcatggactttaactttatagaggggaccagaaactacgagaacaggtatccaacataagatttatccagcgagatgatactgaaaggattttacattctgaacacaactattcaacctaccagagacctacctgttggcctgcctagtagattctttgaagctaagtgtcccagatataccagtgtgtgaaacaggatttaaacgatggggacctcttcatgtcctaccggagtatgttccaggatgtaagagatgctgttgactgggttcattacaagggctccttaaggaaaagacagtgaaaatcttgagaagtatgtagtcaaagatggagaactgctttgcttctgagccggactgcacggccgtgggtccgtctttctttgctacccacagtgctataaatatacagatacaaatcctgacttaccgtgttgacttccacatggcccaaggccatggggacgtcccatcgaccatggggagtcctacctttgcccttgggtccttgggggtgcccgggaaccctccttttggacaaggccccggcgtggggccacgggggtcc

SEQ ID NO: 716722 - DNA, 116 bp, Homo sapiens
tcgtgatgagatctggccaggcacagagaacgagaagaagctgaagagcagctgtccaagagttaggctgacctagagtggcagagccaggagtaccaggagactgcctcgccaat

SEQ ID NO: 716723 - DNA, 522 bp, Homo sapiens
tttttttttttggaaacaaaaattttattttaataaaaaattttggtttgtattttttactttcccaggggaacccatttgggacaccccgtgtgccccccccaaaagtgtggcccagtctcgctgtgggggcagggaaaaaaggaaggggtagtaaaaataaaaaaacacccggtttttctccctcaggtgctgtggggggttgtgaaaaaaccacccctcttttgtgtggtgccctctccttctgtgggtgtctccgagagaagagagaaaaccaaatataaatatctctcgagcgccgtgtgtgggtattctctccaacacaccatatgtgcccccccgcgaggtgtgtggagaggggaactcttaagaaaatgtagaacaaaaggggagacacaagagggcaaaaaaaaatatgtgttgtgctctcaaaaaaatatattagaaaccccagggggcgtgtgggggctgtgaagagagaaaatatctcaaaataatataataatatcccggtttataaaa

SEQ ID NO: 716724 - DNA, 166 bp, Homo sapiens
ggtcctctcatagcagctcgttaccttctcgctgctggtctcccgtcggccacctagggccagcatccacacgacagcttgttctctgggtcctgcctttcttcactatctttgccttgcacccattccacgtcaggctaccttgcactccgagtccccgctgtga

SEQ ID NO: 716725 - DNA, 229 bp, Homo sapiens
ccttctacgtctcatcactgctttcattacatgatacctgtgcttgaaggacaggaatggactcctgcctggcctttgagggcttccgtcctcattcttatcagtctcattctatctaatagccttcaaattcactctcttcttcaagccagtacatttttatagtcactttgcaccctccccttctatgaaagtcactgtaacatagggctcccagtgatgagacgta

SEQ ID NO: 716726 - DNA, 458 bp, Homo sapiens
  misc_feature (43)..(43): n is a, c, g, or t
  misc_feature (117)..(117): n is a, c, g, or t
  misc_feature (185)..(185): n is a, c, g, or t
  misc_feature (188)..(188): n is a, c, g, or t
gttaacctcctttgccctgccctgtaatttaaaaaagaaaatnacaaaagttgttaaaaataaatggaaattcctttggaatgcctgaaatgccagtgaatgttaatcaagtcagantctttcctttggcctcagttgtgtttgtatttcctttcttaattccccaaatcttggctgggcaacgngtntcacgcctgtaatcccagcactttgggaggctgaggcaggtggttcactggaggttgagttcgagaccagcctgggccacatggtgaaaccctgtctctactaaagatataaaaattagctggatgtggtggtgcacacctgtgatcccagctacttgggaggctgaggtgggagaattgcttgaacctggaaggcagaagttgcagtgagctgagatcacaccactgcactccagcctgggtgacagagagactctgtctcaaaaaaaa

SEQ ID NO: 716727 - DNA, 417 bp, Homo sapiens
attgttgccgggtccaaatgatcaaagtgtttccagaaagggatgcatgtaaatatcatctgctgaggttttgaagactagctctaacgggtgagaggagtgacttgaatctttcaatttaaaagtaaaatgccagccaggcatggtggctcacgcctgtaatcccagcactctgggaggccgaggtgtgtggatcacctgaggtcagcagttcgaaaccagcctggccaacacggtgaaaccccatctctactaaaaatacaaaattagccaggcgtggtggtgcgtgcctgtaatcccagctacttgggaggctgaggcaggaggatcacttgaacctgggaggtggaggttgcagtgagcggagatcgcgccactgtactccagcctgggcaacaagagtgaaactccgtctca

SEQ ID NO: 716728 - DNA, 158 bp, Homo sapiens
gtcaatccttctttccttcaagaacccttattacacatctccattcctatattccacttggatttcctataggcaaagagacaccatacatgtgtatggaatcaaatgtatatagtctaaacacactgcagctatgggaaaacttcattccttgatat

SEQ ID NO: 716729 - DNA, 276 bp, Homo sapiens
  misc_feature (16)..(16): n is a, c, g, or t
  misc_feature (106)..(106): n is a, c, g, or t
  misc_feature (113)..(113): n is a, c, g, or t
  misc_feature (121)..(121): n is a, c, g, or t
  misc_feature (128)..(128): n is a, c, g, or t
  misc_feature (185)..(185): n is a, c, g, or t
  misc_feature (229)..(229): n is a, c, g, or t
  misc_feature (259)..(259): n is a, c, g, or t
ctgatagcagcatgtnccaatgaccagactgtgcgtgtatgggtcgtagcaacaaaggaatgcaaggctgagctccgagagcatgaccatgtggtagaatgcattnctgggcnccagaaangcatatnctccatctctgaagcaacaggatctgagactaaaaaaagtggtaaacctgggccatncttgctgtctggatcagagacaagactattaagatgtgggatgnagtactggcatgtccttatgaccccgtggnatgataactgggtacgt

SEQ ID NO: 716730 - DNA, 257 bp, Homo sapiens
cgaaggactctgtgggctccattgcccgccagtctgacccgcgtgtaccctctggtggcctgcggattgaactccagccaacctacaggtccccaggaaactgtggaactcgtcgctgtcacgctggtggcctctgaatcttccagaccgccaccgctaccgaccatgtgacctcagatgcccgcccgctctctctagtctcactgtgcgcagtagtgcgcgtacgttccgtaaaatcctagcctgcccctgcggtc

SEQ ID NO: 716731 - DNA, 797 bp, Homo sapiens
tgttctccctttgacgaatacacaaagggccctaccagcgcgcatgcacttttcacaacgtgcgtgaaacatgggagttctaattctattaaggcgagaaagcccaaagtgtcacctaggagacaatctgctcgagaaaatcgtctgaataagcaaaacgggagagcaaaccgaaaaatcgtgacctctcgatcgtcccaatacgcttagacaacgagtagaaccggcctgaccgaattgagtattttccgcaactaccaccaacgcttgaaaaactgccactcaataaaattgctatgtcagtgagacatgagtcgcgtgacgacatcgaatccaaaacaacgttatccatagcaaagttccaatcgctaattgaagcggtcatttgtggaactaaacaaacggtggcagccgtaagcagttagtccaccggtcgcttggaacccggcgcacacgagggtgtgctgcgcacagctaccataagatgcaggcgatggggatcctttgcgcagcaatccgatgcaaacattatgcgccaacaactgtctcttttaagttgacagtaagactccttccacccgatttatccctcgtcacccacccattaatctgtgcccatgttgaacgcaacgcccaaccaagctaaacaaaaaaggatcaaccatgagcatggaactacaacgcttgacaaagacgagcattgtctgtgtcgatcacagacggcgattccggtgcagatctccaagagtgaacaggtgccggtgagagaccgggtctaatacggtaggggggggaaa

SEQ ID NO: 716732 - DNA, 222 bp, Homo sapiens
ctctcgacggctccctgccgctgcttctcacccgccaggacgcctttcctcacgtttccgctacgttttccttcccctgcacttttgaccctccttttacgtggttggtgctctccttgggtgttcactgcctttgtacccccccgtccctcccgtccgcggccggggtcccgcgctcgccttcgtcctcctggtcctcgctgtttcctgtgtgcccttgtt

SEQ ID NO: 716733 - DNA, 475 bp, Homo sapiens
attcaatagaaagtatcagactatttgaaactgggctgttttcttggggctatatcaaacagtgacatagtccttgccctgacatagctccacatttggtggggaatatctacaattaactgtgggaattaagcaaacaatattgtccgaaagacaatgaggaaagtacaggatgctatggagtcttcctcgcaggaaggacactgcatccaaggttctgttttcaaagctggctgggtgttgtaaacagggagtgatgtctatgcttaaacttgaataataaagtaagtgttagccgggtcacaggttgagataggaagactgggagggtattctcagtttaagacctagtgtgggtccagacactaaggcaagaaaaaatttagttctatagttccttgaaaaatgggaggtttagtttgtttggagcaactcttacgaacaaggtgtctatccccactggggaccccacaaa

SEQ ID NO: 716734 - DNA, 241 bp, Homo sapiens
caaatccttgaaaatcaggatagcacattttgctaacgactatgacagtggtcagttcttatgagagaatctgatatgattttccctttatttcccaatgtcaaatcatgttacaaaattgtacccagaaattgagtttcagaagattgaggtttacctttgtgtggtttttaaaatatgttataagttgtgaagattatagcatttttgaagtatggatattaaaaacaatatgttgtga

SEQ ID NO: 716735 - DNA, 277 bp, Homo sapiens
agcagagattgtgccactgcactccagcctggtgacagagtgagattccgactcaaaaaaaaaaaaaaaaaaaagctgaaaagaaagaggtaattagcaagtttttgtgaggatatggagagattggaaccctcacacatggctggttggaatgtaaaatcgttcactaactttggaaaatggtctggcagttcctcacatgtttaaacatagagttatatgatccagcaatttcccttctagatatgtaaccaagagaaataaaagcatattccac

SEQ ID NO: 716736 - DNA, 461 bp, Homo sapiens
caatagcactgaatctagtaaattacttggggcagtatggccatttcatgagactgattcttcccacccatgagcatggaatatttttccattggtatgtgtcctctcttatttctttgagcagtggctggtagttctccttgaagaggttcttcacacccatcattagctgtattcctaggtattttattctcttggtaacaatggtgaatgggagttcattcatgattgggctctcttgtctattatgggtgtataggaattgaagaaataggtctatggctggtgtataagaatgcttgtgatttttgcacattgattttgtatcctcagactttgctgaacttgcttatcagcttaaggagtttttgggctgtgacaatggtgttttctagatatagaatcacgttttctgcaaagagagacaatttgatttatctcttgctattgaaacttctaaa

SEQ ID NO: 716737 - DNA, 286 bp, Homo sapiens
  misc_feature (84)..(84): n is a, c, g, or t
aagaatgcctgggacaaggagccagtgctggttgtgtcctttgtggtcgggggcctcgctgtaattttgcccccattaggcccntatttcaagtattcggtcatgatcaacaaggccacgccctacaactacccagtgcccgtccgtgatgatgggaaaatgcccgaggtgcccagccacccccaggaccctcagggccccagcttggagtggttgaagaaactgtgagcacctccactgacaaagggggcccctcccacggttcccaataaaaatgtgaaaacca

SEQ ID NO: 716738 - DNA, 1109 bp, Homo sapiens
taccagagcaaccttagccaaaccatttacccaaataaagtataggcgatagaaaatgaaacctgggcgcaatagatatatgtaccgctagagggcaaaggatgacaaacattatagaccgaaggcataatatagcaaggactaaccccgtgataccgttctgcagtaatgaattaactagaagatgaactttgcaaggtagagcgcaaagctaagaccccgcgaaaccagacgaggctacctaagaacagctaaaagagcacacccgtctatgtagcaaaatagtgggaagatttataggtagaggcgacaaacctaccgagcctggtgatagctggtggtccaagatagaatcttagttcaacgtttaaatttgcccacagaaccctctaagatccccttgtaaatttaactggttagtccaaagaggaacagctctttggacactaggaaaaaacctggtagagagagtaaaaaatttaacacccatagtaggcctaaaagcaggcagcaattaagaaagcgttcaagcgtcaaaacccatgtaccgtaagaaagatcccaaacatataactgaactcctcacacccaagtgggaccaagtctatcaccgctatagaagaactaatgtgagtataagtaacatggagaacattctcctccgcataagcctgggtcagattgaaacgagggaactgacaattaacagccaatatctacaatcaaccaaaagtcatgattacctcaatgtgaacccaaacggggagctcatagggaaggtgacaacgttcaggaatcggaatttaacccgctggtttccaaaagttactttagattcaccagatcaggggacgctggccagggaacatgttaaggggggaaccaacgggcaggtgccatacaacgtgccttaaaagggccagagaaagaggcccaagggacaaggggcatcatacacaacagaagaagagccgcaaagggggcgaaacacagagagaccacggcgcaccatatatgacacaaacacaccagggcacaaacacgatatagggggggcgacacccaaagaaacaaaacatatataacaaaacacaactgcgcggtgacaa

SEQ ID NO: 716739 - DNA, 107 bp, Homo sapiens
aggagaacggggctgaggaggaagaagaagaaactgccgaggatggagagagagacccctcccctgggagcctggagctgcaggatcccaggggaggggtctctctc

SEQ ID NO: 716740 - DNA, 284 bp, Homo sapiens
  misc_feature (126)..(126): n is a, c, g, or t
ctttcatagctgaggtttatgtttcattttactgccttttgctacaagcactgggaacagttgctattaagtatttatgatattttggtaaacaccatcctaaaatggaagtgaataatatatatnctctaagccaaagcattgaaaaaaaatcttcagggaaaaaaatatcagtttcttctaacatttggttctgggattttaaatttctctttaaagatcatgttgtttagaaacacaaaatgagatttattgtatttgtttttagtagcacgtaggctttt

SEQ ID NO: 716741 - DNA, 217 bp, Homo sapiens
cggccgctgtgtcgtatgtggtgtgagcattgaagctctctcacactccaactctatctgttcttccttatatttttaatggaaaggacagtgaagtaccttaaaggagggatcagtattaacacagtaatcactatgaataatcatactttctatagtaattctctccgtctagccagttacaatcttcagacatgtgtattttataattactcta

SEQ ID NO: 716742 - DNA, 1001 bp, Homo sapiens
ctcagttcactgcaatctctgcctctcaggttcaagccattctcctgcctcagcctccccagtagccgggattacaggcacccgccaccacacccggctaattttgtatttttagtagagacggggtttcaccatgttggccaggctggtctcgaactcctgaccttaggcgatccaccttcctcggctcccacagtgctgggattacaagtgtgaagcactgtgcccggccagtcatccatgatttcaatggggtccaaaggcctctttttctttgttaagtatttccctggtctgaaatttcttttcttcttctttgttctttcttttaggaacaccagacgcttgtgcgcatatattcacccccagggcgtgagagttgcaaggggggcaccaagatcttcgtgccacacatgggaaggcatatcgccctcccagggatacaccgccatttctcctgccttcaaagcacatccacagagtcacgctggcggatacaacagggcacccagtgcccaccaaacagcaccggggcaaaattctccattaacagggcgaatcaacaaagcactaacacagagaggggggtcacaacacgagggttacaacacacggagacaggggtcctaagaagaatctccatagacaccctcgagagacaaccacccaggccaacagggaccaccccacaaagggccgtgggagaattacacagggcggatggcagccaaatgcccccccggggcatctggtgggcatgcgacaaagtcccaccattacaagagcgccacactccgcccccacgtctcccagtcagcgacaccacctataccaaggagaaaggggagaattggtcggaacaacaagtcaaacgatcaaccagctgataatttcccccagacaacaacgacagagcagaacaagagcagacagacgaaagaacaacaccgccaccgaccccacatcaagacgagggcagcaacaaacaagcaacacgctaa

SEQ ID NO: 716743 - DNA, 108 bp, Homo sapiens
gagaaagtccttgccattctaaaagccaccccacttctctaaggagaatggcccaatcttcccaagtccacacaggagggaaacattgtttgcgtaaatacgcaatgc

SEQ ID NO: 716744 - DNA, 503 bp, Homo sapiens
tcataggttcgcaggtgtaggttcctgacgatttgtggatctcctcgagtgcagactgtggaagtatgcttttcaagataacgagggcatgcattgtccatgggaggaggaggagggcctggttgagctgcacagcttccactgtcctccgggccaccgtctccggcttcagtgggggaaagaggttgggaaacctgaacacaggaagagacacagtgggtttctcctggagaggcatgtgcttatctggaagtctttatgaggctgacatgtctgggtcaccctttggcttttcctgtctgagagattcgaggcctgcttggaatactccctctaccccacaaccatccaggtgccacattccctcactcccccaggcacacaggggtctcttcttgagtcaaggacttctagcccacccactggggacccactctcccaagccctccaagggctcccagtgccctagggcttggcctttccatggccctgcgaacctatga

SEQ ID NO: 716745 - DNA, 358 bp, Homo sapiens
gatctgcatgtctagcaaggttccaggtacttttaatgttgctggttctggctcatactttgagaagcaagttcctagagtcagagggtatttcctctatgttatttgttaccaaaaacccttacaactatgaacaggtttaactaggcataaatgaagataacaggtgggaaaataattgccgatatttggaaaatccaacaaaaatttaaataatgtctcaaagaaatgagagaggccaggcgtggtggctcatgtctgtaatcccagcactttgggtggccaagatgggcagatcactccaactcaacagagttggagaccactctggccaacatagcaaaaccccatctctact

SEQ ID NO: 716746 - DNA, 150 bp, Homo sapiens
agtgcaccagctctcccatctggcgcagcttttgtgctagctcctgccctctctgtggatgttcctttcagcctccgtcacaagatgtgagctccttcctggccttcagagtttcaagctacataatcattttctcatagtctgtctctc

SEQ ID NO: 716747 - DNA, 798 bp, Homo sapiens
  misc_feature (527)..(527): n is a, c, g, or t
tgcggtggctcatgcgtgtaatcccatcactttgggaggccgagtcaggcagatcacctgaagtcaggagttcgagaccagcctggccaacatggcgaaaccctgtctctactaaaaatacaaaaattagtcaggcttggtggcgggcacctgtgatctcagctactcgggaggctgaggtaggagaatcgcttgaaccctggaggcagaggttgcagtgagccgagattgcgccattgcactccagcctgggcgacagagcgagacttcgtctcaaaataaataaataaataataaataaataaataaactcctttaatctgaatatggtagtgaaaggcaagatcccatgtctcagaaagttgatattgagggatattgactataagaaacgaacaacttagtacaggtgaataagcagcaaaacagcttggagtcaattcctgactattcagtggcattatccaggtagatttctggagacaagtgactgtcctccatacctttctttgtgccctgtgaactgncacgaacatctgccagtagtatttatggggaccggagaaaacgcggatgttcacccagggtgaaacgtggtgtgggctgccttatcttgtttaatttgcccgcaaacgcttccttgaaagggggtaattatgagttggcactttattaacaggatcccatggttccttttgcagggaaataactgcttaggatcccacagtcggggccaattgaccccggtcatttaatacgagcccaccttcttccacaaaaggcgcgcctccccctttg

SEQ ID NO: 716748 - DNA, 441 bp, Homo sapiens
gtgctgagcgtcgaccttctgctctcaaagcgatgtaccaaccagacagagacccattgagggcacctaaggaaccctgagaggaaatggtgttctttcagatcagtggcgatttcctgagcattcacgtgttctaggccgggtgctagtcactgatgagagatacaggcctcatccctgtgagcctggattccaaggctttcaggaacctttgaccaggaagtaacaggaagttctgaggggccctggggctttagactcattttgaaatgtcctttgtggcaccagaagtggttgtgtagaggaagtgtctctaggctgcggtgtgcatgggtgcgtgtgcaatgccggcaaattcacagaggtctcctctatagatgcaagggtgctgcattgaggccagcaaggttgatggctgtggggtcgccgctgctggtttcg

SEQ ID NO: 716749 - DNA, 871 bp, Homo sapiens
  misc_feature (5)..(5): n is a, c, g, or t
  misc_feature (14)..(14): n is a, c, g, or t
  misc_feature (27)..(27): n is a, c, g, or t
  misc_feature (148)..(148): n is a, c, g, or t
  misc_feature (391)..(391): n is a, c, g, or t
  misc_feature (393)..(393): n is a, c, g, or t
  misc_feature (871)..(871): n is a, c, g, or t
ggggngggactttnggggggaaaactnaaggagaagaactggaaaggaaggagaggaaagaagaggagtgggaaaggggtgaaagcaaagaaggaggggagaatgagtgataaaggaaaagggagggaatagaatagggaacggagangaaggggagaagaaagaagaggaagaaagaaggcgaggggagagaaaaagagagagggggggtgaagggggggaagaggggaaaggaaaaagaagcgaagagagaagagaaaaggagggcgggcgaggggagggagagagggagggggcggagagagggagggagagcggaggagaggggggggggcgggggcgagagagggggagggggggggggggagggggcgggggccgaggggggggngntggaaggagggagagggaggaagaagagatgtccgaagaggaagggaggggggggagggagaaagaaggagaagaaaaagagagggagagggaaaaggagaagagagaaaaggaaagagaggagaggaaaaggaagtagagagaggaagcgagaagcaaaacgaaagaaggaggagaaggaagggaggggaaagagagggagagaagaagaggggagacgacgagaaggaagggaggcgggggggggaggagaggggagggaggaggcgggcgaggaaacgaaggggggggagggaagagggaggggcaagaaggagagaggaagaggaagaagagaaggagagggggagaaggggaggcgggaagggggagaggggaggggggaaggggaggaggggggggagcgagaaagaggaagcgaggaaggggaggggagagagcagacaagggaggggggggagagggaggaggggagagn

SEQ ID NO: 716750 - DNA, 158 bp, Homo sapiens
ggatacctttcctcacaggtttctactacaagagcacataatcgagaccgcaaacatatcatacacaacgcctgcagccctatctattactctcatcgctacctccatgacaggcgccttggaactggatattctcttaaccctaaggtcaaccctgt

SEQ ID NO: 716751 - DNA, 839 bp, Homo sapiens
gcttctccggcgtctccgacgacagacgccgccgctatgcgactacgattccctcctatctgctggctgtcctaagcggcaactcctcccccagcgccagcgacatcatgatgatcttggtcgatgtgggtatcaagtgcgtcgaggagcgggctccgcatcgtcatcggtgacctgaagtggtaaatgaacatggacgacgatttttgcccacgtgtatatcggctgaagtctatgtccagtagatgcctcgcctgcgcctggggacatgccgaccgtctctggcatggcccaaggactactggcagtcccctggctgtgtgggtctcctgtcccctggctgagaactctaggtacctacaaaatgaacatgagggaaggagaagcatccctctcctgaagattctggatggtatgcatctggctactcacgttgtgtggagctgtccgtgggtccatgcgcatcggcagtgggctgctggcagaggattcccaactggggttcccatgaccccaggctcctgcaggaccttgctgggccagatccgtgtgggtaggcgggccatcccaaacaggtgatgaccccaccaaaggagagaggtactgttgcaggccggatgcagcgtgactgccacagacagtattgccggggtctccaaacccagtacccacctggccgtgggggtcacttccccacaacttatggggccgaggaagcaccccctccagggcattgatgggcccacctcctggtatgagactcctatgtgtcccccaatgggggatcccccctgtaaaagggaatccatggggcaatgtccctccggattgggttccag

SEQ ID NO: 716752 - DNA, 334 bp, Homo sapiens
  misc_feature (254)..(254): n is a, c, g, or t
cagagtatctagaggatcccttctttgctggagcagaaacgggaaactaatacattgtggatgctgttaactaaaccatacatggcaggattccatagcctcatgcactagcacagtgccttacgtagtaaggtaagccttggtgtatttttgggagagaaggaaaaattggaggaaagaaagaaagggaataaagtagctcgtatggagcatggttgtagtttgtctagtttcgtggattgaagcaaaagctntgaagttgagctatggaaaactttgaaaggcccaccccaggcaacaagaaacccagggttaccgaagctacgaaatatcg

SEQ ID NO: 716753 - DNA, 356 bp, Homo sapiens
  misc_feature (268)..(268): n is a, c, g, or t
gcgtcgacgtccgttccagcaggtcacggacggagaatagccaagggaaaagagctgtcaaacagccttgtggctattgggtcatttttcgactggtggtcacgggtggttggagtcggtgggcaagcgttctaacatgagggctcaggcctgtcggatattttcatccggcggcaagacggtcaggagaatgcatgaatttccacacccgcaaatgggtcaaacccgaagacctcaatcccaatggcacgctgttcggcggcactgnctgcgcatggatcgacgaggaagcggcgatctacgccatcgtccagctgggcaatcagcgcgtggtaaccaagtacatctcggaaatc

SEQ ID NO: 716754 - DNA, 628 bp, Homo sapiens
gagcgggggtcagtcgggacagaggagactagatggcgctgcgggcgatgcgggggatgtcaacggggccgcacccgagtctagccgtgcccaccggttgggccggtcggtgggagctcatggagtaggcgctggactcgatcagtcggaactacgctctcccaatctcgtctcgacatatgagacagtatctgggagtcagattggtccacatagtgatcttagatcatgttaatgtttcccaggtatgcgtgaaactgtcgatttgagcttacctggatggcaggaaagagaaggtgggcaagttctggaagtgagatggttccaaggctagtagttgaggtatttgaagggacttcagggtatagatgctaacgaaaacgtcctgtgacgttatactgtgggatattctccgtagacatcgcggtgtctagaggatatgcttgggtcgggtattcagatggctcgggaaaacccattgagcaggaggtcctgttgtactggccgaagacttccttgatatcatgggtcagccaatcaacccgtcaatgtcgaaatctacccaggaggaaatgattcggacttggcaattccggccatcgaatgggatgaacagtattgctagggg

SEQ ID NO: 716755 - DNA, 434 bp, Homo sapiens
  misc_feature (1)..(1): n is a, c, g, or t
  misc_feature (8)..(8): n is a, c, g, or t
  misc_feature (100)..(100): n is a, c, g, or t
  misc_feature (134)..(134): n is a, c, g, or t
  misc_feature (221)..(221): n is a, c, g, or t
  misc_feature (227)..(227): n is a, c, g, or t
  misc_feature (261)..(261): n is a, c, g, or t
  misc_feature (329)..(329): n is a, c, g, or t
  misc_feature (432)..(432): n is a, c, g, or t
ntgcggcngaccggtggcggcatccaagcgccccagcagacccccatcatgggcagccagagctccaaggctccccggggcgacgtgaccgccgaggagnagcaggcgcttcccccgcgaaggccaacgcagtnagaatggcacgtgaaaagcaatggagacttatccccaagggtgaaggggagtcgcccctgtgaacggaacagatgaggcagccgggncactgngactgcatcgagccagcaccccctagccagggtnctgaggcaagggggaggtcccccaaggagacccccaagaagaagaagaaattctctttcaagaagccntttcaaattgagcggctgtccttcaagagaaatcggaaggagggtgggggtgattcttctgcctcctcaccacagaggaagagcagaacagggggaatcgttnct

SEQ ID NO: 716756 - DNA, 170 bp, Homo sapiens
ctgatttctgtacccgtatttttccactcgcactcatatacttaggtaccttttgaccccatggaaaaaaaatatctaactgttcagaactaccaataacatggaagaagagaaatttatttttttttttttggaaaatgaatttgtcccccatcaaagtgaattctaaa

SEQ ID NO: 716757 - DNA, 736 bp, Homo sapiens
aaaaacaccggtgggactaaatttacaaacatttataaacgacctcattttaaaacaaaactagggcaaattcaaaggggggtcactgatatcccataagggaccacactacaagactatacaaacaatgtaacttaaaacgcaaaaacaacaaaaaatcctatgcagatagacaatacacagatcaaaacactaaagctactctacaacactcttacatatatcacacttaaattcccataaccttagaagtctataatcatattcctaaccagtcaccatttttaaaaaatccaacattaaccacttattccataactaaccacaaccctgaactaaaagacactcatatactagacacatcttaaaacaataatctcatctaacatacaatagttacaatatacatataaacaatcgtatatactaaacttcaaattaatatacaaataattagaacatccatagaaaattcaaaaacaagacatacactcatcatataaccaataaatccaaatcatattccctagaacacccacacaatctcaaaaaaacaaacaaagccaaccaactttaacaaatctactacttaaaacagcctatattacacaccaatccttcaccaaactgtaatacaacacactccttatattatatgcgcaataacagctctatatcattgcctactacgaactttatcctacatcttactctcactactataaccctctccacg

SEQ ID NO: 716758 - DNA, 170 bp, Homo sapiens
  misc_feature (8)..(8): n is a, c, g, or t
  misc_feature (29)..(29): n is a, c, g, or t
  misc_feature (45)..(45): n is a, c, g, or t
  misc_feature (56)..(56): n is a, c, g, or t
ttcacttnattaaacagcgcaaaatcttnctaatgttccagtacnaaactttgagnaggaactgttatggggctatagggctccatttttgagtttggttccgtaccctgttactaccacagttggtctgttttatccttacaaactaatactgcagatggagtttataa

SEQ ID NO: 716759 - DNA, 893 bp, Homo sapiens
gactcacagggctgtctttgtttaggctggtgataggggaggtcccgaagccaagccacccttgtgcaggggacattagaaaataagatctacctgtccatctagggcatccgtctcttgtgagcctggaccatgggcaacatcatggagggcaagtccgtggaagagctgagcagcaccgagtgccatcagtggtataagaaatttatgacggagtgcccatctggccagctcaccctctacgaattccgccagttctttggtctcaagaacctgagcccctcagccagccagtatgtggaacagatgttcgagacctttgacttcaacaaggatggctacattgacttcatggagtacgtggcagccctcagcctggtcctcaagggcaaagtggaacagaagttgcgctggtatttcaagctctacgacgtcgacggcaacgggtgcatagacagggacgagctgctcaccatcatccgggccatccgaaccattaatccctggagcgactcatccatgagtgccgaggaattcacagataccgtgtttgccaagatcgacatcaacggggatggggaactgtccctggaggagttcatggaaggtgtgcagaaggaccagatgctcctggacacgctgacccgaagcctggaacttgaccggcatcgtgcgcagactccagaacggcgaacacgaggaggcaggcaccggcgactggcagcggagctgggggttgaagcatcaccctgtgggttctgactgctgagggctggccccgtgcggtgctggtggtgggtgggctggcctgtcttaacttcattaactccttgaaaaaaaaaacacaaacataacctctcgacaatctcctcgggaccccacaaaccaccacg

SEQ ID NO: 716760 - DNA, 153 bp, Homo sapiens
gctgtaagtttatgcaatgcaaaagaatcctctccaatttaggtgagttgcctgaccacgtcctcgaccaaatcggcctctaaagcgtaattcggttgctgacccagccccagcatcggctttattgtcggcaccaggtggcacagcactcag

SEQ ID NO: 716761 - DNA, 188 bp, Homo sapiens
ccccctcccaggaggggccggggagagtggcagtttgcatggcgaaccccccccttcctttttgctgccccttcacttttttggtgccccttttccagtctctttttaccccccctcctggtttgtcctgatccccttttttggatcaggttttttggttggacatataaattatactttcctttcca

SEQ ID NO: 716762 - DNA, 359 bp, Homo sapiens
ccaaaatataagatctgagggtaggacatgtctcattgcccttacagctcttagcgtaggtcaagtaagcattgtttaaaaaaaaaaagggggcagccgggtgcgggggctcacaccggtaatcccagcacttggggaggccgaggcaggcagatcatctgaggtcaggagttcgagaccagcctgactaacagggtgaaaccccgtctctactaaaaatacaaaaattagccgggtatagtggagggcacctgtaatcccagctactcaggaggctaaggctggagaatctctggaaccaggaggcggaggtggtagtgagccgagatcgcaacacggcacttcaggctgggcaagag

SEQ ID NO: 716763 - DNA, 986 bp, Homo sapiens
tgtggtggcagggcgaatgtagtcccagactactcaggaggctgaggcaggagaatggcatgaacccaagaggcggagcttgcagtgagccgagatcgcatcactgcactccagcctgggcaacagagcgagactctgtctcaaaaaaaaaaggctgggctactatgggaggctgaggcaggagacattgcccgaaccccagagggagtaaggtatgcagatgagtcgagcatatgtgccacatgtactccagcctagcgtgacagagccacaaattccatctcaaaaaaaaaaacaaacgctacaccaaaatcttaacacaacttacaacatacaacatcaaacacaacacaaaacaaaaatacagaaccacataagacacctaaaaacaaataacatacaacaactacactcgaaaatatgtaaaccaccaattattataataaatcaaagtgaacacaatgacaaaacccatagagaaaaccacatgtcataatcacacataattatctcctatttaacaaccatactatatataaacaaccctagtacacaccacacacaaacgttataaaaaaaacaaatcaaaaaaaaaacaactacatcacaccccaaaaaaacacacttcttcacaacaaacacacaatcacacaaaaatacacaactaaaaaaaacacaccacccacacataaaaaaaaaacaaaaaacaaaccacccataaaaaactcacaaaacatcaataccaccaccaaatcatcaaaccaataatacaaacaaaaaacatcaaaccacatatacgcaaaaaccaagaatacatataatccagaaacaaatcgaacacctcaaacttccaccgaacacaccactacacccataaactccacaaacaaaccatctctcttattattctcacatatcacaacactcatcaacaaccacaactcaatagcccatactttatcatctacctataactaccaccacac

SEQ ID NO: 716764 - DNA, 699 bp, Homo sapiens
  misc_feature (5)..(5): n is a, c, g, or t
  misc_feature (68)..(68): n is a, c, g, or t
  misc_feature (72)..(72): n is a, c, g, or t
  misc_feature (87)..(87): n is a, c, g, or t
  misc_feature (92)..(92): n is a, c, g, or t
aagcnctggcagtatgtgacaagaaggtgctggctgctgtctccaggctctgagtgaccacacatctncctngaaaggcccctgctnaagcncaacatggtcaccccaggcccatgcttgcactcagaagttttctcatgaggagattgccatggcgaccgtcacagcgttgcgccgcacagtgccccccgctgtcactgggatcaccttcctgtttggaggccagagtgaggaggaggcgtccatcaacctcaatgccattaacaagtgccccctgctgaagccctgggccctgaccttttcctacggccgagccctgcaggcctttgcccttaaggcctggggcgggaaaaaggagaaccttaaggctgcgcaggaggagtatgtcaaacgagccctggcccacagccttgcctgtcaaggaaagtaccctccgagcggtcaggctgggggtgctgccaacgagtccctttttgtctctaaccacgcctattaaacggaggtgttcccagggtgcccccaacacttcaggccctgccccctccccctttttaaaaggaggccccctcctcgggggtccagggtgggttgcccgcgctcttttttccctcgtgacagtggtgtgtggggttgtctgtgaatgctaagtccctccccccttccggccccctgcccaataaacagcttttttagggggga

SEQ ID NO: 716765 - DNA, 288 bp, Homo sapiens
ccatcctctcccctaccctaccaacacatcccctttccgccgtcagcgggggcaccaataatcacagctgagacgcatggttaaatccagattgaagtaatttgttatattgtgagaacattcacattgcatttcaatcaatgtcacacttaattgaggagtagaaggctttgcattctttgtttgtttacgattccttcaagagtaattaacataataattaagatatttatattcttgttaaatttcaaaaacaaattcttcttttattaaagatgagataaattc

SEQ ID NO: 716766 - DNA, 379 bp, Homo sapiens
cagtagagagggaaaatcttaagccagaggaactccaaaaatgagtgtttggagcgcttcagttcacctttaaaggccaggacgggccccacgtggctggcggcctcgttccagtgggggcacgtccttgggggtttttaatgtttgcagctcaagggcgggcccttttttaaaaataaaaatgggggttatttttatttttttttgtaaagtgatttttggtcttctgttgccattcggggggatcctgttttgccctgtggccaatgtgagatcggggggttctcctaatgttttcccggggcttggggattggacccggggccagctcccgtaatgcattgcctgtaccaatgtaataaaaagcctctttttttta

SEQ ID NO: 716767 - DNA, 124 bp, Homo sapiens
gagccttaacctcacctcccctaaaccagttcactgggacagggcagaacaggcagagcaggctgggggatcgggactggtggcaacaagaaattcttatcgtcgttgctttaaagtagatatt

SEQ ID NO: 716768 - DNA, 206 bp, Homo sapiens
  misc_feature (46)..(46): n is a, c, g, or t
  misc_feature (78)..(78): n is a, c, g, or t
  misc_feature (90)..(90): n is a, c, g, or t
  misc_feature (102)..(102): n is a, c, g, or t
  misc_feature (106)..(106): n is a, c, g, or t
  misc_feature (130)..(130): n is a, c, g, or t
  misc_feature (153)..(153): n is a, c, g, or t
  misc_feature (178)..(179): n is a, c, g, or t
  misc_feature (193)..(193): n is a, c, g, or t
  misc_feature (199)..(199): n is a, c, g, or t
cggcacgaggcagctggctgagaaacgagagcacgagaaagaagtncttcagaaggcaatagaagagaacaacaactntcagtaaaatgngcagaagagaanactncacccacaaaatcggaagctaatnaaagagaaccgagaggcacaaanggctgccaaacttggaacgtttgcnnagagaaggataagnacattnaagaagt

SEQ ID NO: 716769 - DNA, 251 bp, Homo sapiens
aaaaacccccccttggccaaaaaagggttgcccccgggggggtttttttttttcccctttttggtaggggtttttcccccccccttcccccaaaaaaccctttccctttccccggttttttttttttgggggcccccaacccccccccccccgggttttttcttttccccgggatttttttggcggtcccccttttttttttttccccccccccccccttttaatttaaccccccccccctcccttttgga

SEQ ID NO: 716770 - DNA, 128 bp, Homo sapiens
cacgccaccggagaaggtctctttccataaacaaaccaccagcaagaatgatcatcatcagttggtgacctgtgcccacctgcccacacctgtcagccaccaagggaccccttctccggtggcgtggt

SEQ ID NO: 716771 - DNA, 142 bp, Homo sapiens
ggtcggtaccacttcaaactcaatgtatctgaagtggctcttcatcacgcctcccagaaaccattccctgcaatgagtccggaggagaggaggagagtctgtgtgaggagctagagaccgcaacggggtcagatgtgtgcac

SEQ ID NO: 716772 - DNA, 430 bp, Homo sapiens
atttcacacacacactttcaagagctataagctatcacttactgaatttcaaaggggtctgatttatttataattgattatgttagtgagggtaggttaactgctattaaaattatatcaaaaatatcaccagtttagtgcaccgtaattcacgcaaccatcttaaggcgatgttctttgtcttagcagctgtccttgtagtagtgactaaggtatgcaagctcctgtcgctctgccttcccctaggtcatttgagttctctctgaggcagatgggcaaagtgcatggaggatctcacgtaggaagttttgtgggagataactgtgtgtcatgcattacttccacccacatcccaatggctaaaatgcatgtgcatggctctatctaactgcaagggagcctggaaaatgtagtctacctgggtactaaa

SEQ ID NO: 716773 - DNA, 411 bp, Homo sapiens
  misc_feature (34)..(34): n is a, c, g, or t
  misc_feature (37)..(37): n is a, c, g, or t
  misc_feature (46)..(46): n is a, c, g, or t
  misc_feature (49)..(55): n is a, c, g, or t
cacacacacccccacccccccccacttaaggctnggnacgaggccnggnnnnnnntccgccactcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagctccggcgccccctccgccacccccgccagtgtcggcgcccgcggccgaggccgctcctctc

SEQ ID NO: 716774 - DNA, 186 bp, Homo sapiens
acgcgcggtgtattctcctcctccaagcatgtccaccattgtgtcatggtgctcgggacacagtcacctgatgcggggaccacggccactccacctcgtgcttgcgctgtcagtgggcagcactgtgctgtggcctgcactgagtgtccctgtcgggctagtcggggactgtcgggctagtcgggg

SEQ ID NO: 716775 - DNA, 117 bp, Homo sapiens
ctaggggtcaatcagagctgcagctggtggcctacaccacagccatagcaatgtgggatctgagccacatctgtgacctacaccacgggttacagcaatgctggatccctggagtgt

SEQ ID NO: 716776 - DNA, 183 bp, Homo sapiens
gattgatcaaagccgccacggtgcaacaagctagcggtttacttgtgacctctgcctcatctttcttcttttgcagcttcagactctgcgcattcgcttcttcctccatttggctctcatggcgcagaggtttccaaaagaaatggcgctaaggccgagagaaagcgcggcgttggatgcagt

SEQ ID NO: 716777 - DNA, 700 bp, Homo sapiens
aaaaccccctttttttttacctaggtgaaaacgcctttgttatgtgaaaaattcagttaaccgtaacacatggcccggggttccttttacttgttcccagaagaggggcaaaaccaatttagaatttgttagagttgtccctattaaacaagaaagattttggttataaagtgttcttgctttcacagcaccatcccagggtgttaggcgacaagagggggaattttctctgcctccaggcaattggtgccaagtcagttgaggggataaatataagatagatcgttttcttcatcaaagagtactggcatatgtcccaacatagctgcctcagccaaatggtactcaggtttcaaatgggtgccgaactttgtggtagcatgtcagtcatcaggtgtttggcaacgtgatgtaggcctcaatattgtcaggtccgttatctctttggggtccaggaatggcaagaccagcaagttgttctccaatgctagctgtgatctctgcaaacaagtgtcacttgtgctttatcttaaccgccagaacatcccttctgtagctcaggagtgcgcccctccgccccatttgctcgcagtatcctagaatttttgagctctccctccagttccctaggagttccatgtctttccatgttccctcccatgcctagttggagtgcagagttaaggttatgaatatgaca

SEQ ID NO: 716778 - DNA, 1001 bp, Homo sapiens
  misc_feature (22)..(22): n is a, c, g, or t
  misc_feature (34)..(34): n is a, c, g, or t
  misc_feature (46)..(46): n is a, c, g, or t
  misc_feature (55)..(55): n is a, c, g, or t
  misc_feature (69)..(69): n is a, c, g, or t
  misc_feature (83)..(83): n is a, c, g, or t
  misc_feature (94)..(94): n is a, c, g, or t
  misc_feature (107)..(107): n is a, c, g, or t
  misc_feature (126)..(126): n is a, c, g, or t
  misc_feature (129)..(129): n is a, c, g, or t
  misc_feature (176)..(176): n is a, c, g, or t
  misc_feature (191)..(191): n is a, c, g, or t
  misc_feature (204)..(204): n is a, c, g, or t
  misc_feature (212)..(212): n is a, c, g, or t
  misc_feature (246)..(246): n is a, c, g, or t
  misc_feature (281)..(281): n is a, c, g, or t
  misc_feature (304)..(304): n is a, c, g, or t
  misc_feature (309)..(309): n is a, c, g, or t
  misc_feature (318)..(318): n is a, c, g, or t
  misc_feature (323)..(323): n is a, c, g, or t
  misc_feature (330)..(330): n is a, c, g, or t
  misc_feature (333)..(333): n is a, c, g, or t
  misc_feature (456)..(456): n is a, c, g, or t
  misc_feature (465)..(465): n is a, c, g, or t
  misc_feature (480)..(480): n is a, c, g, or t
  misc_feature (482)..(482): n is a, c, g, or t
  misc_feature (490)..(490): n is a, c, g, or t
  misc_feature (580)..(580): n is a, c, g, or t
  misc_feature (896)..(896): n is a, c, g, or t
gtgcgtccaacccagccccccncctcggtccctnaccccagctcgntgccccatnaccgcctctccctngctcccaagggtgnaggtgggcgcnaggcccgcccccntaacatgttcccttgcctnagngctgcccctggtctcccacaacagccacccagaggcacccccatgangtttttttctggttnactcccaaacccnagtgtccnaggctccagtcctaggagaacagtccctgggtcngcagccaggaggcggtccataagaatggggacagngggctctgccagggtgccgcacntgtcnagaaacacntgttntgttccnccncctcatgcatttccagcctttcaaccctccccgactctgcggctcccctcagcccccttgcaagttcatggcctgtccctcccagacccctgctccactggcccttcgaccagtcctcccttntgttttttntttccccgtccttcntntctctctntctctttttttctctctctttgtgtgtgtgtgtgtgtgtgtgtgtgtgtgtgtgtgtgtgtcttgtgcttcctcagacctttctcgcttntgagcttggtggcctgttccctccatctctccgaacctgttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgaccccatcaaccgccagagtcccagacaccggttttcctagaagcccctcacccccactggcccactggtggntaggtctccccttatccttttggtccagcgcaaggaggggctgcttttgaggtcggtggctgtctttccattaaagaaaccccgtgcaacgtgaaaaaaaaaaaa

SEQ ID NO: 716779 - DNA, 541 bp, Homo sapiens
  misc_feature (469)..(469): n is a, c, g, or t
  misc_feature (482)..(482): n is a, c, g, or t
  misc_feature (510)..(510): n is a, c, g, or t
  misc_feature (518)..(518): n is a, c, g, or t
  misc_feature (522)..(523): n is a, c, g, or t
tggcattttaaaggagcttgtttaagtttttcttttgttgtataccattcggcttttaaaaataaattcacacttgtttcaaaggctgaacatacagccggaagaacaatatctaccttagagcttgtagcatgttaggtagtgtcctctaaaatttcatgtccactctgtacctcaaaatttgaacttatttgtaaataggttatttgcagatgtaattggtttaagattgagatgagatcatactggatgagggtgggtcccaaacccaatgacatgttcttataagaggaggagaggacacacatagtcactaagaagagggctacgggaagatggtggctgagattggtgtgatgcagttatacaatccaacgaatgccaagggtctccatgagcccccagaagctaggaagaggccaggtacggtggctcgcacctaatcccagcactttgggaggccgaggtnagaggatggttgngcccaggggctcaagaccagcctgggcnagaaggtnagtnntcgtctctacaaaaaaaa

SEQ ID NO: 716780 - DNA, 976 bp, Homo sapiens
  misc_feature (22)..(22): n is a, c, g, or t
  misc_feature (34)..(34): n is a, c, g, or t
  misc_feature (46)..(46): n is a, c, g, or t
  misc_feature (55)..(55): n is a, c, g, or t
  misc_feature (69)..(69): n is a, c, g, or t
  misc_feature (83)..(83): n is a, c, g, or t
  misc_feature (94)..(94): n is a, c, g, or t
  misc_feature (107)..(107): n is a, c, g, or t
  misc_feature (126)..(126): n is a, c, g, or t
  misc_feature (129)..(129): n is a, c, g, or t
  misc_feature (176)..(176): n is a, c, g, or t
  misc_feature (191)..(191): n is a, c, g, or t
  misc_feature (204)..(204): n is a, c, g, or t
  misc_feature (212)..(212): n is a, c, g, or t
  misc_feature (246)..(246): n is a, c, g, or t
  misc_feature (281)..(281): n is a, c, g, or t
  misc_feature (304)..(304): n is a, c, g, or t
  misc_feature (309)..(309): n is a, c, g, or t
  misc_feature (318)..(318): n is a, c, g, or t
  misc_feature (323)..(323): n is a, c, g, or t
  misc_feature (330)..(330): n is a, c, g, or t
  misc_feature (333)..(333): n is a, c, g, or t
  misc_feature (456)..(456): n is a, c, g, or t
  misc_feature (465)..(465): n is a, c, g, or t
  misc_feature (480)..(480): n is a, c, g, or t
  misc_feature (482)..(482): n is a, c, g, or t
  misc_feature (490)..(490): n is a, c, g, or t
  misc_feature (580)..(580): n is a, c, g, or t
  misc_feature (871)..(871): n is a, c, g, or t
gtgcgtccaacccagccccccncctcggtccctnaccccagctcgntgccccatnaccgcctctccctngctcccaagggtgnaggtgggcgcnaggcccgcccccntaacatgttcccttgcctnagngctgcccctggtctcccacaacagccacccagaggcacccccatgangtttttttctggttnactcccaaacccnagtgtccnaggctccagtcctaggagaacagtccctgggtcngcagccaggaggcggtccataagaatggggacagngggctctgccagggtgccgcacntgtcnagaaacacntgttntgttccnccncctcatgcatttccagcctttcaaccctccccgactctgcggctcccctcagcccccttgcaagttcatggcctgtccctcccagacccctgctccactggcccttcgaccagtcctcccttntgttttttntttccccgtccttcntntctctctntctctttttttctctctctttgtgtgtgtgtgtgtgtgtgtgtgtgtgtgtgtgtgtgtgtcttgtgcttcctcagacctttctcgcttntgagcttggtggcctgttccctccatctctccgaacctgttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccggttttcctagaagcccctcacccccactggcccactggtggntaggtctccccttatccttttggtccagcgcaaggaggggctgcttttgaggtcggtggctgtctttccattaaagaaaccccgtgcaacgtgaaaaaaaaaaaa

SEQ ID NO: 716781 - DNA, 390 bp, Homo sapiens
  misc_feature (78)..(78): n is a, c, g, or t
  misc_feature (220)..(220): n is a, c, g, or t
  misc_feature (226)..(226): n is a, c, g, or t
  misc_feature (229)..(229): n is a, c, g, or t
  misc_feature (285)..(285): n is a, c, g, or t
ccctttttaaaatcccaaaccaaccttttgctttggcctgaggctggaatggttttttggtttggccggccctggcanccccaggcccctggcccaaaaaaaaaacccccaggagggggttcccccagcctgccctgctcaggccttgcccccaaacctgtactgtcccggaggaggttgggaggtggaggcccagcatcccgcgcagatgaccccccanacaccngcnaaatccagacaccggttttcctagaagcccctcacccccactggcccactggtggntaggtctccccttatccttttggtccagcgcaaggaggggctgcttttgaggtcggtggctgtctttccattaaagaaaccccgtgcaacgtgaaaaaaaaaaaa

SEQ ID NO: 716782 - DNA, 355 bp, Homo sapiens
  misc_feature (250)..(250): n is a, c, g, or t
gggggggggggggggggggtctgctccaccttgcttagtggcgtctcatttcgacgttgcgtcttatcacacttgcttgctgagggatgttgtgtcgctgcacagccctgccaaccagaaggttccactcctgtagctgcccactgtatgccgagaggttgaggtgaggcagcatccgccaatgcccatcaccccaagtccgacaccggttttcctagaagcccctcacccccactggcccactggtggntaggtctccccttatccttttggtccagcgcaaggaggggctgcttttgaggtcggtggctgtctttccattaaagaaaccccgtgcaacgtgaaaaaaaaaaaa

SEQ ID NO: 716783 - DNA, 138 bp, Homo sapiens
  misc_feature (30)..(30): n is a, c, g, or t
  misc_feature (46)..(46): n is a, c, g, or t
ggtggaggttgcagtgagccgagaccactnctttacactccagccnggacaacaagagcaagactctctcaaaaaaaaaaagtccgtgatgaaattttaagaaattcttgattaaaataatattattgtataaatgtt

SEQ ID NO: 716784 - DNA, 628 bp, Homo sapiens
gagtaactcacttgatgatcttgccaccttgcttcaatgagccaaatgccgtcttgaatttaagaaaaaatgggctgtctcactgccagctccgcctcctggggtcacaccattctcctgcctcagcctcctgagtagctgggactacaggtgtccgccaccacgcccggctaatttttttattcttagtagagatggagtttcaccgtgttaagcaggatggtctcaatctcctgatttcatgatccgctggcctcggcctcccaaagtgctgggattacaggcgtgagccaccacacccagcctattttctacattttctacaagaaattagtattctgtgttgacattttatttataaattacattactgtatttataaattacattacaggctgggattacaggtgtgagccacgatgcccagcccagatttaaattattgagtaaaagagcactgatttttttaaaaaataaagatgacctctccccaactgctgaggtttgggatgtagaccagggactaataagtaaactgaaggaacagtacaagaaggaacgaaaggggaagaaaggggtgaagactgaaccaataacgtttcatctggaggggcagtcattatatggg

SEQ ID NO: 716785 - DNA, 137 bp, Homo sapiens
ggaccggggcagggaagagggcagctgcgtatttaatttagctctggtttatgacctgacaaaaagccaaaaatatcattctttccaggagtggggaaaagtgagtgatgcctcccaagttctaggtggcttcacaa

SEQ ID NO: 716786 - DNA, 847 bp, Homo sapiens
gagttctatttggtgatcatggacgctgtgtttatttccctccgatggtcctcccctgcttgttgctgtgtgtgaatgtagcaacacctggggtctacgcacttttgtattagccccgctcggcgccccctaagtatacctcggttcgcgggcccacgcgtctttttgctggccgtgactcacccaagagcgtttgtactccatggaagtccctcttggagggccccctccttattggggctccgggaggccccaccgttggggaccacccttcactagggtcacaaaataactttcccccagaaaatttatgtagacagaaaatcacgtgcgtttatgatttaaaactcgctcgcgcctcacacatcattgtttcactcaaccccccctagttggctgatacacaccggttgcttcaaccctctctcctgtgtaggtaactaccattggggcgcaacaatattttaacacaacaagcccactcttctgtctctcctgctccctcacgaactcaattgctacttatatatcccatgcccataaaatatttggcagaactcgacgccctatataccccctcgtgccaccaccccttttgcaccccaaccccccctaatattccccaggcgcgcaccattttcgaaataatgacgccccctggtacataacccctctatgatgatgtttcctcatccctcgcaccctccgatatctcagtactctccttcccacgtcgctatctataagacgccacctcgaaaagaggttccgatatactattccccctaaagttttttgggcattctcccacccccctacccccccttcccccccccaacataacaaa

SEQ ID NO: 716787 - DNA, 294 bp, Homo sapiens
gcaagctaacatatacctgcattatgtctaacaccctggaacagaaggtggccacatttacctaactgtcatttcatcccccaatggtgactcttcccagagtagcatggggcatgaagatgagggctggaccacagtgggcattgtcatcatggtggtggtctgctgtgtggtgggcacttcttggatcggggtcatggttattaaccaccatgagacggcacacctgcacgactatagtatcacaaacagagaggagctcaatctggctgcagacattcccagttacttgtc

SEQ ID NO: 716788 - DNA, 663 bp, Homo sapiens
gaagggatagctggtattgactggagagtgggcagagggtgcatggattggccatgggctctcacaagcctgggcagccccaagtctcttgctctgagcagatacctaatctgggaggagagaggtgaatgggaggagagacaagatgaggggaagccatctttggactaccaggctcctctcccatcatcagcgtggtgaccacctcgcactgtctcctcccagtcacagggaatccttcagctacctctcttcctccatcatcactgcctttcgggcgaacacactggcacccacagtatactgctcaaccacagaatggcttactctactctgcaacccggacatgtcacagatgcctgctatcctgaagtgactatgatcttacgtccatccgctacagaggacagcctcatagaaccatgccgtaggcccttgcagccatttttcctgcgcagaggatcacccaggcacccaccgtatactccctgtccatccatggccctgctgtaaaccgacattctatcgccctaatcctcatccttttccataagcgctaaccctgggccatactcccaacccgcgcatgttcttcccagcgtggcctacggggcttggcccacctcattgtctatcattggtctctcctggccgatggggccg

SEQ ID NO: 716789 - DNA, 280 bp, Homo sapiens
taatgaataacgaaatcccatcataacactttgaacccatctacttagaggacacaagcagcaacaacatgaagaaacgtacgtaaccactatgtcactgatgaacctgcgacgatgttccacactgtgcaaagcccaattaaccactccgacaacatcgccacaaccgctaagtacgctaacccgttaagcacccgcgctttgtcacgtcgccgtaccgacgtagcccacgttgagaacattgctataatgggcatacccagagagagcctgacagcta

SEQ ID NO: 716790 - DNA, 434 bp, Homo sapiens
agttaacagcgtcagggtatcctcttgtctgtggcccatgatcatgtacaagtctctctcacccgaaaagaaatgaaaacagcaatcacctttggataaccctagatctgccactgacacatctgcatttcacaatttttacctgcttgaaagtgtggatcacaccccctcttcattttctcatttccaaatttctcatttgtctctgagtccactgaaatctgtctgctcccaccacccactaaagctattactgccaaggtcatcagtgtcattactgtgctaaagttatgagcaatttcagccctcttggcagtatttggctcgtgtgattgctccctacttaaaactctatttttccatggctgtcacaacactaagtgttgtttaaagtgagtgaaagagagagaagtttaatttttcaccaattccac

SEQ ID NO: 716791 - DNA, 583 bp, Homo sapiens
gatggaagttcagaaaaacaatcccaaggagaaattgacttttcttttgtgtatctggcccatcctcgagcagtaatggattttcctggcgtaaacaagcaaatatatgcctagggcttctgtatgtaatgtactgttgacttgctgcaaagataatgtgtgtcgtctttgggtagagacatttttaccaaatgattgtttgctatacggaggtgactgcagccattggactgaatcaattaatttaacaaataacttcaagagaaatgcttccagtaaagaacgagttcaaaatgctttagaagtaaatctgagacattttcgtagaggtcggaggagatcacttgctcttgtagcacatacgggatatctaccacatcagcaggatcctcatcatgttcacaggaacactccactgcatgccaatgcactttgccactttcatattgcagccagcatcaacccagccacagacattccacttcttccatctattacatctctgagtctaaatgaaaatgaagagaagaccggaccttttgttgtacactggctaaacaataaagaactgcattttactttg

SEQ ID NO: 716792 - DNA, 525 bp, Homo sapiens
  misc_feature (5)..(5): n is a, c, g, or t
  misc_feature (19)..(19): n is a, c, g, or t
  misc_feature (22)..(22): n is a, c, g, or t
  misc_feature (523)..(525): n is a, c, g, or t
catcntgaccaccctgatncangaaacgggcaccctgatcccactctcctaaaccctcccctttggagatttccaaatttttttgggagcaaaaattgggcccaaaaaatccaaaaaaccccttccctctttaagaaaggttggtgttttttgtgaaaaacaccttttttccgggggcccctcggggccgcccaaaaaaaacccccctttgaaaaaaacctcgcccttttcgggggggggaggtttttttttttcccaagaggcgccccccttataaaaagtgttttttcttcaaaaaaaaaggccccccccccccgcgggttccccccccccaaaaaaaaaacccccccccccccaatatttttgggggcgaaagaaaaaaatttttttttttgggggggggagaacaacaaaaaaaccccccgcatcttaataattttggggggggccccacaaaaaaaagagaggggggggcccccccccccccccgcccccccccccccctcttttttggggggggggnnn

SEQ ID NO: 716793 - DNA, 1222 bp, Homo sapiens
  misc_feature (771)..(771): n is a, c, g, or t
gatggaagttcagaaaaacaatcccaaggagaaattgacttttcttttgtgtatctggcccatcctcgagcagtaatggattttcctggcgtaaacaagcaaatatatgcctagggcttctgtatgtaatgtactgttgacttgctgcaaagataatgtgtgtcgtctttgggtagagacatttttaccaaatgattgtttgctatacggaggtgactgcagccattggactgaatcaattaatttaacaaataacttcaagagaaatgcttccagtaaagaacgagttcaaaatgctttagaagtaaatctgagacattttcgtagaggtcggaggagatcacttgctcttgtagcacatacgggatatctaccacatcagcaggatcctcatcatgttcacaggaacactccactgcatgccaatgcactttgccactttcatattgcagccagcatcaacccagccacagacattccacttcttccatctattacatctctgagtctaaatgaaaatgaagagaagaccggaccttttgttgtacactggctaaacaataaagaactgcattttactttgtccatggaagtttttttacagcaacttagaaaaagttttgaacaaccatcttctgaggccagtgtagaagattctaatcaggcagatgtaaaatctgatgaagaaactgatgatggtgttgatgatctgaaaataaatcccgaaaagaaggaattaggctgtgataaaatggtaccaaactcaagttntacatcattatcgtcagctgccattgatcatcagattgaagtacttctgtctgaatggagtaaaaatgcagatatgctatttagtattcatcccatggatggttctttgctagtttggcatgtggattggctggatgaataccagcctggtatgtttcgtcaagtacaggtgtcctttgtttccagaattccagtagctttccccacaggtgatgcaaactctctctgtaaaagcataatgatgtatgcctgtaccaagaatgttgacttggctattcagcaggggaaacaaaaaccttctggcctcacccgttccacatcaatgcttatttcttctggtcacaataaatcatctaatagtttaaaattaagtatttttacgcctaatgttatgatgatatcaaaacatgctgatggttctctgaatcagtggctggtcagttttgccgag

SEQ ID NO: 716794 - DNA, 107 bp, Homo sapiens
  misc_feature (60)..(60): n is a, c, g, or t
agcacagcattctaaactattcacccatgggttcctgggtgcccctttccccccactttnagggctcaccaggcactgccagggagggtaagggctggctccagata

SEQ ID NO: 716795 - DNA, 160 bp, Homo sapiens
tacacaaaatataatcacctaggatagaagaaaagaaaaaaaaaaattcagaattacattcttaacatctattacatctctgagtctaaatgaaaatgaagagaagaccggaccttttgttgtacactggctaaacaataaagaactgcattttactttg

SEQ ID NO: 716796 - DNA, 932 bp, Homo sapiens
cggacgcgtgggctcagccctttcatctgtctctggatatgcatcgtggccctaatcaatgtaaatcagtctgggcatgactttctggctgctcattggaatcatgattgattatattttttcaataactcatcaaaggaccttaggttttaatcaaagacttcagaatcttctgtggggccaagttaaatcattgccagcctggagggaagtctccagtggcataccacagggctctgtcacgtcaaatacttctagaatttagataaagacgtcaatgcataaatattgcatctactgattacccaaagctgagcagaacaggtagatacaacagatggcggaatcgaggtcatcatggtcacctcaaggggagggattaatgccccaacatcagtgagctctggctcaacccacataactgtaaaacctcatgtatagaaattgattgcacttggccaaagatctttttcagggtgacagattcttccagaaggatggtgtagctgtgacaaaagtgaatacacagttgcctacatgggtggacacacgggaccccacggcacaggccagagacagtccagatgaggtggctggcacatcctgggggcatgtgggaagccaccaaaggacacagagctgtgaatccctggagaaggcttgggaaggatgtagcatgatcttgggactcagagcgctagaattgcttctgggcctccaggaggtgtgggcagaagcatccctgcagggaggaagattctctctccattacagattcggccctaccgactgggatttcctcagtaaaacttcgttccttcacagttcattggaaaactcgttacgtttaaattccagccaaaattgtgcataacttattagaccggggtttaaaaacacaaaaaaaaaaaagggggcattggcacacatct

SEQ ID NO: 716797 - DNA, 249 bp, Homo sapiens
  misc_feature (2)..(2): n is a, c, g, or t
  misc_feature (19)..(19): n is a, c, g, or t
  misc_feature (49)..(49): n is a, c, g, or t
  misc_feature (52)..(52): n is a, c, g, or t
  misc_feature (56)..(56): n is a, c, g, or t
  misc_feature (64)..(64): n is a, c, g, or t
  misc_feature (68)..(68): n is a, c, g, or t
  misc_feature (71)..(71): n is a, c, g, or t
  misc_feature (86)..(86): n is a, c, g, or t
  misc_feature (89)..(89): n is a, c, g, or t
  misc_feature (101)..(101): n is a, c, g, or t
  misc_feature (113)..(113): n is a, c, g, or t
  misc_feature (127)..(127): n is a, c, g, or t
  misc_feature (131)..(131): n is a, c, g, or t
  misc_feature (135)..(135): n is a, c, g, or t
  misc_feature (149)..(150): n is a, c, g, or t
  misc_feature (153)..(153): n is a, c, g, or t
  misc_feature (158)..(158): n is a, c, g, or t
  misc_feature (180)..(180): n is a, c, g, or t
  misc_feature (188)..(188): n is a, c, g, or t
  misc_feature (195)..(195): n is a, c, g, or t
  misc_feature (209)..(210): n is a, c, g, or t
  misc_feature (222)..(222): n is a, c, g, or t
  misc_feature (236)..(236): n is a, c, g, or t
  misc_feature (238)..(238): n is a, c, g, or t
  misc_feature (247)..(247): n is a, c, g, or t
cncagggccaagttccaanttctcctcggccgccagaagatcccacatnctncatnagaagttngggnttncaccaagttccaatnctngattgaattttnaagacattggtnggcttgaaaagctngctncatncccatgatcggctnnttngggtncaagtaacatccccaatcgttngccctctnggacaanttggcggggccctnncacttcattgangggttccaattttntngcccccctntt

SEQ ID NO: 716798 - DNA, 401 bp, Homo sapiens
tcgaccgctgcacccaccctactttgggaccaagtttaaacacccagagggcaaaacaaaaaggggcgcaaactaacaggaagtcagccccaccgcaagccggactacaactaactcgtgctctccacgctcaggcgtggaagccaaggctgtgccaggcctggccaggccaagcaggatgacagcaaacgcattctgaacgtgtagcaatcaggtcccctgtaatgtgcttggagagtgtggacaagggccgagatgacgagctatgagctgtgcaagagaatgggcgaagcagaagggcacaaacagaagtactggagggagaggccgggctctcaggaagcagcaggcacgtgccaggtggaagccagctgcaggcagacgaggaaggaggcccttac

SEQ ID NO: 716799 - DNA, 421 bp, Homo sapiens
gatgaacaaataaagaaaatgtggtatatccatacaatggaatattattttgctgtaaaaagtacttataaattctaagtggaaagaaggcagatagtaaaggggacatgtgggggattcgcatttatatgaacatcccggaatgaggtgaatttagagacagaaagaagattactggttgcctagggctgaagaaggggacctgttgagggaaaatggggagaagctcctaacatgtactaatgggcatggggtttctttttggaatgatgaaaatttctaaaattgattgtgatgttgattgcagaactctgtaaatatgctaaaaagcattaaattttacactttgaattgcatgtcaattgtatgtcaagtgaattgtatggtatatgaattacctctcaatacaagctgttattta

SEQ ID NO: 716800 - DNA, 163 bp, Homo sapiens
ggcgagcgacttagtcgtccgtgagaaaaaagaggcgaggctttcccgagatcgtctcagcgatggcgcttcggtcgcagttttgggggttctcggtttacaggaaccctcggtacaaggttcgcagccctctcaaccagctccgagccggcagcaaaaccta

SEQ ID NO: 716801 - DNA, 413 bp, Homo sapiens
ttaaaaaagacaagttctcatcatccaatggtcatgctaataaaatatcattaatggcttatttccgttacagctacttattaaaccagattttttttcttttaattttttcgagatggagtctcactctgttgcccagcgggtattacagtagcgctgtctcagctcactacagcctctgtctccctaggttctagtgattttcctgcctcagtctccctagtagctctgactactggtgcacaccaccacacccggctgattattgtattttctagtactgaccgggtttctccatgttggccaggctggtctcgaactcctgacctctagtgatccatcttgcctcgcttcccacggttactgggattttagatcttagcctacgtgtctagccgaaactggtttattga

SEQ ID NO: 716802 - DNA, 406 bp, Homo sapiens
  misc_feature (76)..(76): n is a, c, g, or t
cagtcaaggtcaagagcctgtggtccagcatgcctggcctgggcgggctacctctgagaacggctgaaatggtgcncagtccatcagcagtgatggaatttgctggaggactaggccagagcaagcctcactgccactgtgcctttggggcacccttggggttggacatacaccccctttagattcctctgtttcttctacctggataattcttggccatgttctctcttctttaggttcaggtcagctgtgccccttcgcgcccctcgtgttggttccacagcccttttccttggccgtggcttgtagattctgttttcgatctcctttgagtgccccctttgtgagcatcagaggggcctttcctatgttctgtcgggatcggtggataaccgtcgttcaatcc

SEQ ID NO: 716803 - DNA, 232 bp, Homo sapiens
acgagcagtggtgggcaggagtatactgaacgagccccatggctgccgatagatgggctggtggtgccgatggatggcctccttgcatgaagtatgtgcagaagggctatgatagacaatccaatttgctaccttggtcccaaataccgatagaaaatggctgtaagctcttgtcatggggtaaaggtcaaggtgtgctcatggtgccagggacgctccggaactctgtcac

SEQ ID NO: 716804 - DNA, 391 bp, Homo sapiens
  misc_feature (287)..(287): n is a, c, g, or t
  misc_feature (291)..(291): n is a, c, g, or t
  misc_feature (322)..(322): n is a, c, g, or t
  misc_feature (340)..(340): n is a, c, g, or t
tactgaagtcttaaccccccaggacctcagtgtgtaagtatttggagaaagggcctttaaagatgtagttaaattaaaatgaagacattagggtgggccctaatccaatctgactggtgtccttgtaagaagaggagatgaggacacatgcagaggcatgaccacatgaggacacagggagaaggtggccatccgcaaatcaaggagtgaggcctcgggaggaaccagcactaccaacaccctgatcctggacttccagtctccagaaccatgagatgatgaaagtntgtntttaagctgcccagtctgtgatattgttttncaaccctaaatagatgantacataccccaatgaaaaaagcatgattctcttgcccagttttctgcacct

SEQ ID NO: 716805 - DNA, 874 bp, Homo sapiens
cgcgcgggtggctgagcagcggcctggtgcgctcgcttagctgggctgacggaatcagactggactgtggactgcccccggtagtggaagcctgaagcaggagttgtttgtttgctgagtggtgctgcctgcagccgcctgcgagcctccggacagacgccagagcgatggagggcgctacgcgacttggcaagatgacccagttcctgcctgccaaccttctggccctctttgcccccctgtgacccctattccatacctgccatccctggagaaactgccacagtgaaaatacatccaacaagtcagaccttaatttgtgcgcatttgctgcctgtacattcgagagtttgagtgaccctcgagatgcccctcctccaactcgtgcttgaaacccgagaggagcgcatggagagtgaaaagcacgggaaaagatttgagcggcgacagcaagaagtggagacagagcttaaaatgtgggaccctcacaatgatcccaattgctcagggggatgccttcaagactctcttcgtggcgagagtgaattatgacacaacagaatccaagctccggagagagttgaggtgtacggacctatcaaagagaatacgcatggtctacagtaagcggtcaggaaatgcccccgttggcctaattgccgtttcaatcggaggtactgacgccacgagctgatgcacatgcagctccgccttacgaagccacgcaggattggcacagaagcactagactgcgtcagtgagggcgtcctttgttggaccgtttggcagtagggaggcacagaactcggtgaaggtgccatggaagtgcccaggcggcgctaagtatggaggtgcctccggactggtatccatg

SEQ ID NO: 716806 - DNA, 146 bp, Homo sapiens
agatctaccctggtcacatgagacaacactatgtgaattttcacatatacatagaaaacgtttagaatggtattaattcaagaccaagctcctaatgtctttccaagttagccgactgtgcggtgtctgcttagctgcactgaccc

SEQ ID NO: 716807 - DNA, 252 bp, Homo sapiens
tccacctcagcctcccaagtagcggagactataggcatgtgccaccatgcctggctaattttttattttttgtagggatgagttctcactgtgttgcctggactggtctcgaaatcctgaccttaagtaatgcttctgccttgggctcccaaaatgctgtaattacaggcgtgagccatcattcccagcccaggagtcttcatcttaagaagaaagctgcccaacgagaagcggcgaagggggatcctctag

SEQ ID NO: 716808 - DNA, 130 bp, Homo sapiens
ggcggtcctgcacacgcgtacgtcaaactaaatactaccgtatggagccagatcccggtggacgaagttgttgcgcaacaacttcgtccatagcgatttagtgatgtagtgtgggctctcggcgtgtgca

SEQ ID NO: 716809 - DNA, 339 bp, Homo sapiens
  misc_feature (149)..(149): n is a, c, g, or t
  misc_feature (289)..(289): n is a, c, g, or t
  misc_feature (298)..(298): n is a, c, g, or t
gccaagctaactttgggagacatttagtttatagtttaaatgataatagctcttctccaaagctcaaccacatttgtaaagctgatgagagaccgccagggtaagaggatgggaggagcctgatttctgctaaggtgtagacataaatnattacctgccattattctggaggtcacaagacatggaacttccccaattactcctgcaaatcacatcactattgtagaacccacgatcagccttttcggatgtcttttcaggtttttgcttgtctgatgactgatggctncacccaganctgccaaccactcccgggggcccattccagaagtgggtcag

SEQ ID NO: 716810 - DNA, 164 bp, Homo sapiens
agggagaatagaagtcccaagactaagattctcaaaatggtatattacccagaactctttgtcttggtcagtcaagaaccatttccaaacaaggacatggagcgaagcttcctaagggaagacttcctgtcccaaaaggaagtgaaccgcaagatgacgatgag

SEQ ID NO: 716811 - DNA, 142 bp, Homo sapiens
cagcgcaaagcgcgctcagaagctggcacgcgcacagaatcgcagacctcagacgagccgctggcgcaagacggaaaagctgactcgaaggcggagagaccggacatccacgaaatgaggaacccccccggaaggaacacgc

SEQ ID NO: 716812 - DNA, 171 bp, Homo sapiens
tagtgactcaggtctaccacaagtactccctgataaagtgggaattaccactgccgtctacagggatgacctgaagaatatttgctagagaccgatgtgtcctcagctatatcagagaaaacagggtgcatacggtctagattcaaacgagttcggatttcaactactgaa

SEQ ID NO: 716813 - DNA, 106 bp, Homo sapiens
caaattgctgctctgtatgacagctttactagtaaatccttaaaagaacacgtgttccttcctctgtagtcaacagacaagacatgaaagccaccatcactcagca

SEQ ID NO: 716814 - DNA, 125 bp, Homo sapiens
tcccttcttctgccaatgacgaagatctgagctaggatgcatgtcttgtgtgaggagacatgagaggcagaagcaggaagccagaagaggaagtgcagaagcagtgaagcaggcagaagcaggaa

SEQ ID NO: 716815 - DNA, 1163 bp, Homo sapiens
ttttctgttttcttgtcgttcttttctttcttcttctgctgtttcgttcttcttttcttcggtttatgccgtttgtttcttgtttgttctgtttgtttctgttgtttcgtgttgttttctcttttttcttctgtcggtcctggttgtgctttgctttcttcggtttcttgccttgtgttttcttctgctttctgtgttgtgtttttctctgtctgtctttgttgggtcgggaggggcgggcgtgataggggaaccgaggaggaagaagcaattaactatcatcgcggctattctcgtgtgtccgcggagttttctgtgtccgcccgttgggtgtgcgcgcctgtgcggcctgagagcttccaaaggtgtcgtggccggacccctccatagctagaggtttatagaaccgtttttccacccgagacccaatttccggcccattactttccagaattgtggggtcattgttcagaaactggagcacccacgaaatggtgaacgatgtccacagtgccctggccagagctgtcttgcgattttcctgccctaccatcgcgctgcccatgctcctccaggctcctgccctctcccaggagtaccgggtaccagtactggcctctgaaaccgtgctgaacttggcttttgccccagctcattcttggaatccccgaaccggccttaagtcttctccccctggccctcgagcccctcttggctgacggggctatcctggaccaaggtcgtgcccatgtttttagtggcccagtgcccaggtggcttcagccagcttcctacgatccagccgaagatagccagaagctttggaggctgccctcgagaacctccatgaagcccagaactattttgccaaggttgactgccaagagcgcatcagggacctcgtttacttcccggcccagactctacccataccctggggaagaccccggagaggaacccggtgtgcgattagctcttccggccagctgcatccggagctgccctctcatggggtaccccttgataaacccatctttagagaggacatccctgctgggctgctgtgccgagtataagattttggacttgttcatgtcccctctctcccctataaatgatgtatttgtgaccccctatcttgtccataaaccgccttcctgatt

SEQ ID NO: 716816 - DNA, 1532 bp, Homo sapiens
  misc_feature (1531)..(1532): n is a, c, g, or t
ctgatcaggatgatcatcaaactcaaactacgccctattcgggcgcactgtcgagcgagtatcccaatgaatctcatatgaagtcagcctagccatcattctactatcaacgattactaattaatgtggctcctttaacctctccaaccttatctacaacatcaatgaacgaccatcgtgattactccatgaccatcattgacccttagccataatatgattgatctccacagtatgcagatgacgcgaaatcgatacctcactcttactgtacctttgccagaatggggagtccgagacatagatcttcaggcgtatgccacatcatcgcaatacgcccgcatgggcccccttacgcccctattcttgcgataggccgaagtacacaaacattgattataactaagacaccactcaccctaacgtacgaatctatcctatggaacaaatatagttgatgcatctctctcccgttgaatatctaaacaactataatttcggtcaatccgaaggaacctctactttctagaccttccactgtttcttaatgaattcgaagcagtattacccccgatttcccggctaacgaacaaaattccatacgatcatcctgattgcaagcaacacctttctctaaagctaatttcatctcccttaggcattttacctttattattgattaatcggtctcccaataccctcatttaacggaaatcttcccaagcaatttcccccccgttcaataaccgttaataaacattacattcggtcttcaacaaatactaccattcacaactaatacataggatattcaaatcacaagaactaaaacaaacgtaactcacaccaaataaaaacaattccgaagaagcgagtacagacagaaggaacatatccagacacagcacaagaagggccaagaataactaggggacagatcaccgcgcaacaaattcgtggagtgtaagcatacgtcgagcccgacaaatacgatccgccagccactgaatataagacagacgaagcagaccagaacgaacgcaagcagacaagcaaaaaagagagcagagcaagcagaaagaaacaagaaaagagaagccgacaagcaagagacacttgcagaaaaagacgaggacacaaagaacacaggagagggggcgacgacacaagaagggacgacagacaccccacacagcacgaacaagcaagacgtcgcgcacagggaggaagacaacacaaacagacagaggcgcaacgctacgtggacacaatcaacgcgacaaagtagacggcaagaaagcaagatgagggaagcggcgacgagtagacaataaacaccacaagctagcgcttgtcaaccgagaggagcagcacgaggagaaagagagacagagaaacaacgaaagggacgaccgagagagcgggagagagaacgaacaagccacgcagaggatgagaagggcgagaaggatgcggacgtcagcaaaagtggaaacaagcagagagagacatacggaagcaccacacagcnn

SEQ ID NO: 716817 - DNA, 182 bp, Homo sapiens
  misc_feature (130)..(130): n is a, c, g, or t
  misc_feature (146)..(146): n is a, c, g, or t
  misc_feature (164)..(164): n is a, c, g, or t
tggccagtttcttgaaaaacgctatctaccaaaactcaaacaaggagaaatataatctgggtgggcctacatcaattaaaagaaatggaatccataattaatactcttccaaaacggaaagcacaagacntcaagatgttttcacntggtgaattctaccaaanaatttaaggaaaaaaaaa

SEQ ID NO: 716818 - DNA, 326 bp, Homo sapiens
gcacgtggccagagtggccctggcagattccctgggtatgctctgtgcacaggagcgattatagtgaccgcagtttgtgcgaggctgtgaaagtaaaggcgtgggaggtgggagatgattgtatatgtgttggtttcgtccagggttcctagctcataactcacatgaccatggttacagtcttacgttgtcatgttggggtagctcaggcctcaaaaaacagcctttcgtctctctgaccttctcctgtcctcttttcagctgcccaaggcaggactctaatctgattgtgggttgtaggatcctcattccagagtgggtcctaa

SEQ ID NO: 716819 - DNA, 537 bp, Homo sapiens
cgcccacaagggactccagcatagacgagagagagaccctgtctcaaaaaaagaaaacaagccaggtgcagtggctcatgcctgtaatcccagcactttgggaagccaaggcaggtggatcacctgaggtcaggagtttgagaacagcctaggcaacatggcaaaaccctgtctctactaaaaatacaaaaattagctgggcgtgttggcacacgcctgtagtcccagctacttgggaggccgaggcaggagaattgcttgaacctgggaggcagaggttgcagtaaaccgagacagtgccactgcactccagcctgggtgacagagtgaaactccgtctcaaaataaataaataaataaattagctgggcatggtggtgcacgtctgtaatcctagctactcaggaggctgaggtggaagaattgctggaatctgggaggcggaggttgcagtgagctgcgatcacaccactgcactccggcttgggcaacagagtgaaactctgtctcaaaaaaaaaaaggggttaaatatgtgt

SEQ ID NO: 716820 - DNA, 360 bp, Homo sapiens
gtagaaagaaaaaatatagaggtaacccttaaaaatccagtttagggtggggcacgggtggctcaatgcgtgtggtcccagcactttggggaggccgaggtgggcagatccaccctgaggtcaggagttcaagaccagcctggccaacatggtgaaactcccgtctctgctggaatatgcaagagttagctgggcgtggtggtgggcatcatgatggtgcatacctgtaatctaagctactcgggaggctgaggcagggagaattgcttgagcccgggaggcagaggttgtagtgagcggagatcatgccactgcactccagcctgggcaacggagcaagcctccgtctcagaaaaaaaa

SEQ ID NO: 716821 - DNA, 1839 bp, Homo sapiens
gtagaagagatcatttctggaggcttcagcaaatggaataatgcatatataatgagagattgaacgaaatccagtccaaacgtggtccgagattctataaatccaggtagggaactcactcttcttatcttctctggacctaattgggcataggtggctttagtgagaccacagaccaggcccgtctctcctgtaggctttctacattcaatgtgcaactctatttcacaagactaaaagcctatggagcagttgcggcagttctagggggcgggctcaggagagtccatagatcagccgtaacatggaacgtagaatctatgtactgcctctgaatggacttacccacctcctctctctatgctctgatagcttgcctctgggcctctaccatgtcccaaggtggtctttcatccttgacaggctggtaaagtgatggacacctccagctacctgcagtcagagtctagtaaaaccaggagctggtttctcatgggcttcgtcacgataccaggatacggaggggagccaagagacatacataccagcccaggtaacggggcatggctggattagacatacataagtgcccaggcaaacatcagatagagattccttctgaccttgcagcaagggccctaaggagcgccgaggcagggccagaaaggacctagagtggaacagggcacattgaaagcgaaacctgaactaaaaatacacaaggaaacggaaaggcaaaaggagggatcgagacacatcgcaccaccaaccagagagggaacgcacatggagacgtaggaaaacacacgaggagcagagacacacacaaccagcgcccaacaaagcagacaagacgagagataatcgcaacgccacgcaccaccgcggcaccgaagagcgagggagagagagaggcatagcgagcatcggcagcggcatctccggagaagaaggcggaggagagaggagcggcgaggagagcggcggagggagaggagagagggaggaggaggagggcgcggagagggagggaggagagaagggaagcggggggagagggagaagaagagcgggaagagcgcgaagggcagcaagacgaagaagaacgagagagcgagagcagaaaagagagagaagataagaggagaagagagggagggaggacagggagacgaggatgacgaaggcagggaagagcgagagggagagagagcagaaaagagacggagaagcgaggagagcagcaggagaagaggaagacaagaggaagcggaacgaggagagagacagagcgaggagaggaagagcgaagcaaacaggcaagagagacaagagggcaggaaacagaacaagggaagggaaaagaacagagggacgcgagagagcaagcgcggaaggagagagagaagagagagacacgaacaagaagagaagaagacggagacagaagacggaaagaaaacaggaagcaggagaagagaaacgaggagaaagaaaagaaagagagagagaagagcgaggaggagaagacagaagagagacaggaaaaagaagaagaagacaagcaaagagaaggaaggaagaagagagcgagagagaaagacagcgggacagcagcgcgagcgaaaggagaacgaagagagaagcaaataaacgaaaaccacgacagcaaagaaagaggaggagagaaaacaagcaaagaacgcacgaaggagaaagccggacaagcaggagaagaggtgaaagagtcaaagagcaggacgaggagagaagagagacaaagcagcaaagagcgaaagaagcgcgcagcacggcaagaggcagaagagagacgaagaa

SEQ ID NO: 716822 - DNA, 102 bp, Homo sapiens
tcctcgacgccgaggtcccgctccacatcgcggatgtcgatcagcttgcgggagccctgggcttccatccttgcgccggagttcccggaagttgagactggc

SEQ ID NO: 716823 - DNA, 498 bp, Homo sapiens
  misc_feature (1)..(1): n is a, c, g, or t
  misc_feature (4)..(4): n is a, c, g, or t
  misc_feature (9)..(10): n is a, c, g, or t
  misc_feature (14)..(14): n is a, c, g, or t
  misc_feature (20)..(20): n is a, c, g, or t
  misc_feature (22)..(22): n is a, c, g, or t
  misc_feature (24)..(24): n is a, c, g, or t
  misc_feature (26)..(26): n is a, c, g, or t
  misc_feature (30)..(30): n is a, c, g, or t
  misc_feature (35)..(35): n is a, c, g, or t
  misc_feature (39)..(39): n is a, c, g, or t
  misc_feature (41)..(41): n is a, c, g, or t
  misc_feature (48)..(48): n is a, c, g, or t
  misc_feature (51)..(51): n is a, c, g, or t
  misc_feature (59)..(59): n is a, c, g, or t
  misc_feature (104)..(104): n is a, c, g, or t
  misc_feature (125)..(125): n is a, c, g, or t
  misc_feature (127)..(127): n is a, c, g, or t
  misc_feature (134)..(134): n is a, c, g, or t
  misc_feature (139)..(139): n is a, c, g, or t
  misc_feature (142)..(142): n is a, c, g, or t
  misc_feature (177)..(177): n is a, c, g, or t
  misc_feature (186)..(186): n is a, c, g, or t
  misc_feature (189)..(189): n is a, c, g, or t
  misc_feature (195)..(195): n is a, c, g, or t
  misc_feature (198)..(198): n is a, c, g, or t
  misc_feature (210)..(211): n is a, c, g, or t
  misc_feature (214)..(214): n is a, c, g, or t
  misc_feature (216)..(216): n is a, c, g, or t
  misc_feature (222)..(222): n is a, c, g, or t
  misc_feature (224)..(224): n is a, c, g, or t
  misc_feature (226)..(226): n is a, c, g, or t
  misc_feature (232)..(232): n is a, c, g, or t
  misc_feature (236)..(236): n is a, c, g, or t
  misc_feature (238)..(238): n is a, c, g, or t
  misc_feature (240)..(240): n is a, c, g, or t
  misc_feature (262)..(262): n is a, c, g, or t
  misc_feature (264)..(264): n is a, c, g, or t
  misc_feature (279)..(279): n is a, c, g, or t
  misc_feature (293)..(293): n is a, c, g, or t
  misc_feature (312)..(312): n is a, c, g, or t
  misc_feature (332)..(332): n is a, c, g, or t
  misc_feature (335)..(335): n is a, c, g, or t
  misc_feature (341)..(341): n is a, c, g, or t
  misc_feature (350)..(350): n is a, c, g, or t
  misc_feature (353)..(353): n is a, c, g, or t
  misc_feature (362)..(363): n is a, c, g, or t
  misc_feature (366)..(366): n is a, c, g, or t
  misc_feature (373)..(373): n is a, c, g, or t
  misc_feature (387)..(387): n is a, c, g, or t
  misc_feature (409)..(410): n is a, c, g, or t
  misc_feature (412)..(412): n is a, c, g, or t
  misc_feature (423)..(423): n is a, c, g, or t
  misc_feature (434)..(434): n is a, c, g, or t
  misc_feature (449)..(449): n is a, c, g, or t
ncancaagnncccnggcttnantnanaaanccganaccncngggaaanaanaccccccncccgggcccccccggccaaaaccacttttttgagtaaggggcccncccccaggccccccaggccancnccccccnccccnaancccgaaaagcggaggggcgggcaggccaggccgcncaggtccanaangcaggnggnccgcggggcacnnaananaggganananaccaanaacncngnctggcccccaggaccccggaanantttggagccaaaacngggggggttgccanaaaaaaaaaaaagcgggcnccccgggaaaaaaaacgggncanttttgnaaaaggggnaanaaccaaaanngtnaggggcnggggggctgaaggnacggacccccagcaacccccannanccccaaaaaancccccaacccnccgtatcggaaaaantcacccacgtcccgccccaaagcccccaaaaaaccaaccccaacaatgg

SEQ ID NO: 716824 - DNA, 911 bp, Homo sapiens
agcgggctatttgaaagacagcgctccgggtagctagagcctgaaggtcggcgtgcgtcacgctgttagccctcgttgggtcttctgctccctcgacttgtcttctcgggcttctcgccccggtcgtgggtcgggtccttcagtgagtcgagaatgactaaggatctagaagatcgccaacagtgattttcaaaaagtcccattgataagtagggtaagcaagaagcccaagttacatacatgctactcctatcaaactttagaacgaagactatgcatctgcctgagcgactcgaagcaggatggaacacttccaacagaacaatagaaaagcttagcatagacggattggctgtcgcagatgcatcactacaatgctggggttaaacaaagtgctcttctgggacttaaagaccttttgtctcaatacccatttatagattgatgcggcaccttgcaagacatattgaagtgaagtgacgtagctgtcgtaggagcagataaagatgctaatggtacgattatgcagcagttcaacttctgtcaattcctggcgccccagaagatacgagctgaacaagatttctccattttttcctttggtaagtgcccatctctctagtgccatgactcacattactggaaggaattcaggaggactctttaacagttgtgggacattctgctggaacagtacgcagctctaattactggccgtagcagcatatttgcttaagaatttcgtggaactttatttgctcataagcagctggtcccaaggactgataaatagagacagattccccaggcctggataccttctggaatcctaacgggagactcacttctcaggaagggagggcggaagtcttttgaggaacccgtaatccttcgggcttggcatgggtccg

SEQ ID NO: 716825 - DNA, 576 bp, Homo sapiens
  misc_feature (2)..(2): n is a, c, g, or t
anatagtccacgggttggctatagtccacggttggctggtcaggatttcgagaccagcccagccaacatgacaaaagccccgtctccactaaaaacataaaaattagccgggtgtggtagtggacacctgtaatctcagctacttgggaggctgaggcaggagaatagcttgaaccccggaggcggaggttgcagtgagctgagatcatgccactgcatttcatcttgggtgacagagcaagactcttgtctcaaaaaaaaaagggccgggcatggtggctcacacctgtaatcctaacactttgggaggccaaggcggttgaattgcttgaggtcaggagttcaagaccagcctggccaacatggtgaagccctggctctactaaaaatacaaaaattagccaggcatggtggcatgcgcctgtagtcccagctacttgggaggctgaggcaggagaatggcttgaacttgggaggtgtaggttgcagtgagctgagatcaggccactggactccatcctgggtgatggagcaagattccatcttcaaataaattaaataagttaaatgatgttg

SEQ ID NO: 716826 - DNA, 1234 bp, Homo sapiens
  misc_feature (3)..(3): n is a, c, g, or t
acncgcattcttctttattgtggtcgctcgtgttgattttgcttctctgcttgctctcggcctgtgtgtcggttgtggggcggctgggtgcgtgcttctgtctcctgttagtgccgcgggttgcttgctgtcgtctgtgtggcttgtggggtgggcccgtcttgtccgaacggcgcggttgtgcgcccccgctgggtgtttgggtctcttgtcctgtggcgtgtgttttattcgttccggtgggttgtctttgttttggggtgtcgtggtggttgttgttggcgttcgatttgcgttgagtagtgcccgtgtccccccggtctttcttctgacgtcacgggttggccggacaatccgagatttttcaaccctcgtcgcgctgcgagttctggccgcgtgcaacctccggccaatctttcggccatttcctgctttgggacctgcccgcccccgttttttgggtagctcctgtcggcgcacaccgaccctgggctcccagattcgtccgaagtagtcccccgacgtggagcacaccggcacacgcctggtccaattggtacctgcaggcctcctacaccgtacctctctctggcttctatttcgaccccgatgattgggcttctggaaggcctgagccactttttccccgaattggccgaggagaagcccgagggctacgagcgtttcctgaagatgccaaacccgcgtggcggccgcgcttttttgcccaggaccatcccagagagcccacgcttgaaagatatgaagttgggggttaaaacaccccaagacacgcccatatgaaaagcttcgccctatggcccttggagaaaaagcttgagacccaggccctttttggattttccatgccctgggttctgcccgcaccggagcccccacttctctgtgaacttcctggagaactcaccttcctagatgaggaagtgaaagcttatcagaagatgggtgacccaccctgagccacaccctccccacggctgggtggccccgaggctgggctgggcgagtattcttctttcgaaaaggctcacacttctcacaagcaccgagctaaagagcctcttctgaagcccacagcgaactttctgaaagggccccttgccaagtaataagggcttctgcctaagcctctccctcccaacccataggcagcttttttaactatcctcaccagccccttggacccaatggaaattaagctttttgatcccca

SEQ ID NO: 716827 - DNA, 425 bp, Homo sapiens
ttatcgattgaagctcaaaacggtacttattggccgggcatggtggctcacgcctgtaatcccagcactttgggaggctgagatgggtggatcacctgaagtcaggaggtcgagacgagcctggccagacatggtgaaaccccatctctactaaaatacaaaaattagccaggtgtggtggcatgcacctgtaatcctagctactcgggaagctgaggcagcacaactgtttgaacccacgaggtggaggctgtagtgagctgagatcacgccactgcactccagcctgagcaacagagcgagagcccgtctccgaaaaaaacagcagtacttactcaaacgggtctataattcaacgtcggaaactaaagattctttaaagaggtgcttatatctatttcccttgtccaaaatggccggggatc

SEQ ID NO: 716828 - DNA, 161 bp, Homo sapiens
tcaagtactattagtctgggcatgtgggatatgcgtgcactcgcagcactttgggaggcgaggtgggatcgcctgaggtcggaagttcgagaccggcctggccagtatggtgaagccatgtctctactaaaaatacaaaattggccagacaaagggaaaca

SEQ ID NO: 716829 - DNA, 789 bp, Homo sapiens
gcatcgagggaaaccttatgttagaactgcttgctatggagtagaagcaggaggtgtttcaacctagtcacagaggcagatcctagacccctactactgtccagcactctgtcaaccctcttatacatctgcggggctgaaaataatctcgagtgctaatctggcatccttcagccttatcggtgagggctcccctgtgtgtgcccaaatcttcgcccgcgagtacatcaaagacggtgtacgccacccatagtgcggtaggtagacaatacagctaatcaactgcacgcattaacagtcgcactcggacgacggagcaacccttaaagtcaacttcccctccccatgtcctggcactttggccacaaataggttatatcacctcgagcggacatggacaaccctgtgccgatcgaagcactggaccgacgcgcgtactaactcgctgacatattgtatgatggcctaacgaaacggaactgacgaggcctctcctaggcgactaggagtcgcccaaggaaaaggctttcgcgctgaattgcaaacccggacgtaagcttcaccagcaagccacccagtaacccactgtaagtgagcccaccaaggatggtttggagccccccttttctcacggtcatcgcttcacgagatgtggccagcatccctttactgaatcgtcgggatacccacacggctgagatttccttcgcacatatctaggagcgctccgttcgggcaaccgatcaaatggtctggccgccacgatcgggcaattctttcccaccacac

SEQ ID NO: 716830 - DNA, 310 bp, Homo sapiens
cctgctgagtacaggagtcttagctgtttcacagagtccctcttgtcagcctcccacagcgctgaggttacaggtaatcttcagctgtttcacagcgtgaccagattctccaaacacaatttaattttatttacatatacagtgctccattgtcactggggacaggcgctttgtgggtgtttttggggggggaatatttggccgattcaacaacaggagataaatgtctgagggtcctgtgttgccaccccaggcacctgctttgaccagggatggagagtcccatgcccaggaccaaaggggatggaca

SEQ ID NO: 716831 - DNA, 92 bp, Homo sapiens
gcctgcaccgacaatgcccagaactccagaacttcacctatcacgtatccccaacaacacagacggcgaaaacaaaacaaacttaaacctag

SEQ ID NO: 716832 - DNA, 519 bp, Homo sapiens
tagcagttctggttctcaaactcctgaatctgagaactctcgagatttccatgcgacagaatcccaaacagttctgaatgtctccaagggagaagcaaagccaactcgggcagatgccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggtgggtctgtcaagagctaacagctaacatagtgaaattagaaaaagatacaaaataacttacagaagtagcttgagaatgattagttatgaccaagcgtagtatagcgcg

SEQ ID NO: 716833 - DNA, 152 bp, Homo sapiens
tcaaagatcacatgttaatgagatatttaatgacctcgtcagacagataaatagggaaaacaccagtgggaaaaggaggaggccttaaaaaggaatcatgtcttctgtctctaggcccatagtcagcagcagctctttagccagattacagg

SEQ ID NO: 716834 - DNA, 295 bp, Homo sapiens
  misc_feature (20)..(20): n is a, c, g, or t
  misc_feature (90)..(90): n is a, c, g, or t
  misc_feature (124)..(125): n is a, c, g, or t
  misc_feature (144)..(145): n is a, c, g, or t
  misc_feature (158)..(158): n is a, c, g, or t
ggccaagacctgcctgaagnccggattcttccccacttggcctccttcaaccccgccttcttccttcctcctgggtgggactgccccccncctcctggtgaggctagatagatgccctgtatcnncaagcccaatatgggacannccagcaccgagtnccgggacctccgtggaccacctggcaaggcgaccccctgacccctgagttcatcaagcccaccatggacctggccagccccgaggcagcccccgctgcccccactgccctgcccagcttcagcaccttcatggacgg

SEQ ID NO: 716835 - DNA, 1047 bp, Homo sapiens
  misc_feature (13)..(13): n is a, c, g, or t
  misc_feature (98)..(98): n is a, c, g, or t
  misc_feature (100)..(100): n is a, c, g, or t
  misc_feature (113)..(113): n is a, c, g, or t
  misc_feature (160)..(160): n is a, c, g, or t
  misc_feature (182)..(182): n is a, c, g, or t
  misc_feature (192)..(192): n is a, c, g, or t
  misc_feature (196)..(196): n is a, c, g, or t
  misc_feature (238)..(238): n is a, c, g, or t
  misc_feature (262)..(262): n is a, c, g, or t
  misc_feature (307)..(307): n is a, c, g, or t
  misc_feature (314)..(314): n is a, c, g, or t
  misc_feature (318)..(318): n is a, c, g, or t
  misc_feature (369)..(369): n is a, c, g, or t
  misc_feature (376)..(376): n is a, c, g, or t
  misc_feature (403)..(403): n is a, c, g, or t
  misc_feature (426)..(426): n is a, c, g, or t
  misc_feature (429)..(429): n is a, c, g, or t
  misc_feature (501)..(501): n is a, c, g, or t
  misc_feature (505)..(505): n is a, c, g, or t
  misc_feature (509)..(509): n is a, c, g, or t
  misc_feature (520)..(520): n is a, c, g, or t
  misc_feature (523)..(523): n is a, c, g, or t
  misc_feature (535)..(535): n is a, c, g, or t
  misc_feature (546)..(546): n is a, c, g, or t
  misc_feature (568)..(568): n is a, c, g, or t
  misc_feature (584)..(584): n is a, c, g, or t
  misc_feature (586)..(586): n is a, c, g, or t
  misc_feature (588)..(588): n is a, c, g, or t
  misc_feature (667)..(667): n is a, c, g, or t
  misc_feature (672)..(672): n is a, c, g, or t
  misc_feature (681)..(681): n is a, c, g, or t
  misc_feature (692)..(692): n is a, c, g, or t
  misc_feature (694)..(694): n is a, c, g, or t
  misc_feature (697)..(697): n is a, c, g, or t
  misc_feature (712)..(712): n is a, c, g, or t
  misc_feature (732)..(732): n is a, c, g, or t
  misc_feature (737)..(737): n is a, c, g, or t
  misc_feature (743)..(743): n is a, c, g, or t
  misc_feature (773)..(773): n is a, c, g, or t
  misc_feature (786)..(786): n is a, c, g, or t
  misc_feature (790)..(790): n is a, c, g, or t
  misc_feature (795)..(796): n is a, c, g, or t
  misc_feature (801)..(801): n is a, c, g, or t
  misc_feature (813)..(813): n is a, c, g, or t
  misc_feature (843)..(843): n is a, c, g, or t
  misc_feature (852)..(852): n is a, c, g, or t
  misc_feature (860)..(860): n is a, c, g, or t
  misc_feature (878)..(878): n is a, c, g, or t
  misc_feature (894)..(894): n is a, c, g, or t
  misc_feature (926)..(926): n is a, c, g, or t
  misc_feature (936)..(936): n is a, c, g, or t
  misc_feature (986)..(986): n is a, c, g, or t
  misc_feature (1042)..(1042): n is a, c, g, or t
acagcggcaatgnagtaaagcccgcttttccatggagcgggcagaattgggacacgcctcctccagtcagtcgggcacagggcgcagggaggccagcncngcgaaggcaaggnatgcgcctaggtctgtgtctctgcctgccttcgtgtaagccgtccgnttccgcgcgggcggccagccangcatccttcngacngcaggtgttctacagtgtgtgtgtcggggggcgcccccttgncggagggggagggaagctctcttnaggcctgcaatcaatcttcagaaaccttttgtttcaagcaaacgntttgcgnagcnttgcctggaaggaggttcgtcccttacgcctgcacacagcaatgcgcctgntctctcnatccagcagcacttgggaggaagcggnctccccacgcagccctcgcaagntcnttccaccctcaactgggggctccaactttccaacctccgcccgaaagtccaagcggtcatccctccagggcngagngacntgtagggtccnagntgggcaacacgncctcgcgctcntgcagccagcaagcttattctnccccttctcttcctgngntncaactgcctctgggccctttttccaacagggaactgcttttcaaatggcaggggttctgtaatgtcctaattctgaacncggcntggtggtangggaaaaaagngntanctttgaaaatcccgntccctttcctaaaaaaatantttgntcttgnttgctttaattttcaaaacctgagccgcgncttaagaccgggnaggngtccnngcagngtacccagcaangggtaatgggaacccctgggcggaaaacantcatcttgnaaatctgnatggagcccaattgccanttgcagcctggggagnttgcctgggccctgccgctaaatgcccaaagnaaatgtttgnggtgggtgtgacaatcaactttcaaaaccggcaaaaaacctcgggccagnccaagcctcgccaaatcccgcagcaccccaatcgaaaaatgggagagaaagctgantttgt

SEQ ID NO: 716836 - DNA, 144 bp, Homo sapiens
ataaggggacggctggcgccggcacagttggcctgccgcccttggcggcgctgatgctggatgcgcagcgtcagtccgccatcgcgatcgcgcttgagcgcgggcagatcgccgaatcgatcacgtagcgctggatggggttgg

SEQ ID NO: 716837 - DNA, 827 bp, Homo sapiens
  misc_feature (488)..(488): n is a, c, g, or t
gaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccaaagataccaacagagcttctgaaacagatacccatagcatgggagagaaaaacagctcacagtctgaggaagatgatattgaaagaaggaaagaagttgaaagcatcttgaagaaaaatcagatgggatatgggatgggtcaagtcggccggaaaatattccccccaaggagttcctctttaaacacccgaagcgcacggcaccctcagcatgaggaacacgagcgtcactgaagaacgggggcatattctctgcagaatttctgaaagtttcccttccatctctgctgtctctcatttgctggccatcggattggggatctatantgaaggcgtctgacaaacctccacagcacctttgtgatgaagaactggagtctgactgtggtgcgttagtggattacttctgagggttgggaaaaataagtcagtgaagagctgtagattcctgggggtggcacgtcacttgtgtttatttgtgctgtaaatgctgggtccttaatttagtaaataaaagaattgactaaaattcttgttgttctattattaacttagggatcataagctgttggaatggttaggtactgggaattggggcaattccttgcttgaataaattggaataaactaaacaagcagggggggtgtaaaattgtgcaaggggta

SEQ ID NO: 716838 - DNA, 962 bp, Homo sapiens
  misc_feature (689)..(689): n is a, c, g, or t
gagacgtgccggctctcgcatgggcttgttgtcccgggtttcatatatctctccgaagtcagtttcccacactctggcctcgcctgtgtgctataacgacgtctagttcctagccatctgcagatcattgagtcgtccattgacggaccacgcgaaacatgggaatgggatgagcaggcatttaggcgtgtaaagcccatgtatctattgagcattggtatcctcattttatgggaccacaagccaattactgggctcatagaaaatacggaggagattgctacacatgtggaaccagaggcatacaagattttagcccactgcgataaacccagtcctttgagttcctgctgcattgagtaagtaccacttaatgggggtcttgtctgtgcctatgattgcccacattaaaatgccaaacaaatgtgctttcattattacactattctatgctttgacatattaccgtgtagaaggcggactcgcagtgggtcgttaaacttaccctttgccgtgctagatttctactattctcatctctaagcgataatgactattgtacgcactggctcaggtgatccgtaatttggtgtccaaacgaacattgcagacttcttgcgttctcaacaagcgctaatcctgtcgctacgtggttattactggggtggtgtactacgtcgtccgttgtnggtgtggccttcggatgggtgatcgttcgtaactcgtgtgcgctttgttcctcggtgttcagggcgcatctgatcctggcgcagacggggtattcgaaggaggggcgaccttggttccttcctaccttactggagtaggatccttgggctacttcgggacccgtccccttggtttctccctggttgggatccctaacaatcgggtttctcagctggccgttttatgcctcttctgtggtctcttttcttctgggtaactctcacgcgccgaag

SEQ ID NO: 716839 - DNA, 723 bp, Homo sapiens
agcggtgaggtgtagtcgcggcaaccaggagcaggtgcacccaccactagaatttgaacatcctaagaacaggtattttgtctctgctttgctgatgtatcctcagcaaccggaactgcctgacatctgatcctttctgtgagacaccaggctgttgaggaagaatctatggcaacattgtatctattaatatacagcttctgtatttatcaggcccagttctggtgatgatttcacttttgacagaagctgtccctcaaaagcaaacatgcaatagaagaaacagatctcaatggagtctcactctgtcacccaggatggagtacagtggcgtgatctcggctcactgcaagctccgcctcctgggttcatgccattctcctgccttagcctcccgagtagctgggactacaggcgcctgccaccacgcccggctaattttgtatttttagtagagacagggtttcaccgcattagccaggatggtctcgatctcctgacctcgtgatccgcccgcctcagcctcccaaagtgctgggattacaggcgtgagtcactgtgcccagccaagtttagtatttttgtagagacagagtttcaccatgttggccaggctggtcttgcactcatggcctcaagtgatccacctgcctcggctccgaaattgctgggattacaggcgtaagccactgtgcctggccttaaatgggtaaattcatatgg

SEQ ID NO: 716840 - DNA, 178 bp, Homo sapiens
gactgtcgaataggtgaaagaagaagtagacatcgtggtccacctcccgtcttggggtcagtcgcccgtcgagcatgattatcgtagtgaggagtcctcctacctcgtcgcaggatctccacagaaggagaagcttctctcgcagcgcggagcagttccacattagtgcgggtagcga

SEQ ID NO: 716841 - DNA, 1002 bp, Homo sapiens
tgcaggggcccacgcctgtaatcccagcactttgcaaggcagaggcaggcggatcacctgaggtcaggggttcgagaccagcctgaccaacaaaacgaaaccccatctctactaaaaatacaaaaattagccaggtgtggtttcaggtgcctgtaatcccagctacttgggaggctgaggcaggagaatctcttgaacctgggaggcagaggttgcaatgagccaagatcacgccactgcgctccagcctgagccaacagagtgagactccaactcaaaaaaaaaaaaaaaaagagttaggggaggtaaccggtaaggtatctatatgtgggcagagaccgtggcacattttccattatttaaactctaagggtaaacaggtccattaggcaaataagggactaatattggagaccgggtttacaattcgggcgtacaccttcaatattatactaacaatattccctccccataaccccttctctttgttccccctgtgaacagagctcggcaacatagtgtctcggggggcccacattattcttacaccaacaaaacaccctatacagcgcccaactgtggacctttgtgaccctggggtctgcgacaccccttctacccagagcacccgtctttctacaccggcagcacaactcttcggggcggccccaacagcgaccgggcggactatacagcccccccaatcacacaccacgggccgcaccacacacgctgcctactcccccaattcttgtgtacttcctcccctctctctgcttatcctacatatcacaacgatcattctctatacgcggcgcccacaaactttgcgggcgacgactccgcgccatttcttacccgtcggggctcccccaacgggttaaaaaaaagtcgctcctttctcaaccccaaccagggggcgcaaccacttactccgccactttcctcacaatttcaccaagagcgcttcccccactgatacaggggctctaacacctcctg

SEQ ID NO: 716842 - DNA, 280 bp, Homo sapiens
  misc_feature (165)..(165): n is a, c, g, or t
cggcagcaggtcgtcccaactacatggagtgggctttggcacatgcctgcacgtgacagacttgtcctgacagcagccacagctggagctacacagcgccaagactcccgctgggcctgcagggaaaagtctccgacactcccgggcagcggccattatcaccangaagtttttaccccttcaacagcaaaccggggtcctccctcccaggacacaggagtcaaggcccagtgacctgcggaagaacgcaggggacacgctgcctcaggaggacctgccg

SEQ ID NO: 716843 - DNA, 240 bp, Homo sapiens
  misc_feature (142)..(142): n is a, c, g, or t
aacttctcagcacaattcgaagtaactcacatcattgtcttgcgtctttgtgtggagaagaagttgttgttgtggtcccgttagagaattacccgcactgcccccgcacaaaggcggtcccgggcttaacccggcgacctcnctttggtacaagggcaaacagcacgcccagcaaacacggccacagtagggctcccctgagaatccatgtacaactccagctaggccttcaatctgtca

SEQ ID NO: 716844 - DNA, 656 bp, Homo sapiens
ccgtcgcatgccgccacccggaggctcttgtcaggatgtgtgaagctgttcatcggacaaccgttccccgggaggctacagagcaaggatgattcgctcactcttcgagcacgctcatgggaaggtgctggaatgtgacatcacttacatatattacggcttttgtgcacatatacacgacaagacggcagctgtaaggatgccactacgcaaccgtgtcaccacttacaagcttcatggggtgcaacagtcaacgtggaagccagcaagaatacgagcaaagcttcaaccaagttacacgttgggttaacatcagccccacttgtaccaacccaagtagcttctgagaccaagttttgaggagtatgagtccggtcatcgaatgtgacatcgtgtaaatgattactgtccttcgatatcagcatggatgccgggacagaggcatgcagttggtaggccatcagggtgcctttggactacactacaggagttctcataggactaagatagaactgcatgtgcagttgtccacaagccggcttcggactgaccctggtatgggagaccacgagtgactgctatcggtgtgggaaacgcaagggcactggtccaaagagtgcccagtagatcgtacgcggtcgtgtggcagactttgc

SEQ ID NO: 716845 - DNA, 369 bp, Homo sapiens
attgcccccgctgatataaaccccttccttctttaactcagtgtctgaggagttttgtctgtggctcgtcctgctacaccaccatgtcatacatgtcccaagatatgtgcaacccatcccccactgcaaagtgcagggctattacaagcactctcattgggaggaaatatcccttcaaatagcagactcccagttattgccccaggaggataaggtgcaagtgactttaactgatggaatttgagattcaagatttaccttaagctatccaacctcgtacctggtttcaggctgataagtggagttaaatggaagtcctccaaactctggtcttgcaattagtatggatcaaaggaggtgatgactaac

SEQ ID NO: 716846 - DNA, 116 bp, Homo sapiens
atgctagtgagactcgaatcaccagaagctgcgacagttttcatgtgccccaagctagggaaatatatagaaacatgatggctagctaattacaacggtgaagacgtcactgctca

SEQ ID NO: 716847 - DNA, 299 bp, Homo sapiens
gacagagtgagaccctgtctcaaaaaaaaaaaaaaaaaatttccttggttgaatttaccccccttggaggggaaaaaacctaaccatttttttaaaaaaattttattaattttggttaaaaaaattttagggtttggtttaagccattaaactttaaccattaccattaaaatttttaaaatttttaaaaccctttttttttttcaaccctggaaccacccattgggggaaccttttaaagccaccctgcggccttccagcttggcccctgccggtgttttaaaaccgtgggaatggga

SEQ ID NO: 716848 - DNA, 119 bp, Homo sapiens
  misc_feature (5)..(5): n is a, c, g, or t
gcaantttctacacaattgatgtgagggaagttaggttaggagccacctttttctcttctaagttaaaagaattgttggtatagtgatggaatggcccattagagagggagaaatgatg

SEQ ID NO: 716849 - DNA, 375 bp, Homo sapiens
cggagactggaagggaccgaggcaaggttacaagaaaacaaccacatagaagtaggcaaaggacatgaacagacacttctcaaaagaagacattcacgcagccaacaagaactgaaaaaaagctcaacatcactgatcattagagaaatgcaaccccaaaccacaatgagataccatcttacccagtcagaatggcaattagttaaaaagtcaagaaacaacagatgctggcgagggtgaggagaaaaaggaatgcttttactctgttggtgggaatgtaaattagttcaaccattgtggaagacactgtggcgattcctcaaagatctagaagtaatcccattactgagtatatatacccaaaggaatataaat

SEQ ID NO: 716850 - DNA, 412 bp, Homo sapiens
aagaagagtggtactctgtacagtcgaatgaacctactgtgacccacaatgatcaaccaaagtccatagttaacagttagggttcacgactagatgtacgtgcatacgaccatctttgacatatgtctaatgacagtgtagtgctacttattatagtactgtacgtaatagttccattgccctaaaaaccctgtgctctgattatacacccctctcgcccctgtgaacccataataatggtctaatcttgcaacagtcaccatggttttggccttcactagatttcatgcagtcgtaatcatatactgtgcagcctttccagggtgtgtgcacttagtaactatgcatgtcaggttcctccatgtctcttcaggggcctgatagctcatttgatcctagtgctaatatttca

SEQ ID NO: 716851 - DNA, 132 bp, Homo sapiens
gggccccgaatttttctggttggcctgggaaaggtgggggggggtttttattcccttccggtttggtttgggatggccgggatttttccaaaaaatttaaagaggggccggggccttttttttggggattga

SEQ ID NO: 716852 - DNA, 972 bp, Homo sapiens
gtgaacgctgtggtgtcgacgatatcgctgggaatacgggtcggaaacacactggcgtacgcttagcggcagtctcagcggtttgcccactcctgtctagtccgcaacagttcccagaaaataacgaaactagctagacaatgcacgtatcgtaataccttacagacaaccgactactctaaagtgacacgagtatcagcaagtatgaaaattgtcgagcgagccctgtctagttcaaggtggtaacacagggtacgagtgatacctcttggactagggttcgcatagttgggcagtctagaaccctacctctaaggagccaaccagcacaattgtataggtgatagaaagcgggctagctcgataccgtactatcatattcgaagctcgatagccacccctctaacgtacttgcgctagggctcacaacgatacgcccttagcggcattagtagggtaaggcagaattcggatcacattgacacgagactccctatccattattgcatacgcagatactacaccagtaagatatcacaatcgcgtgtgtatactaaacacgggccactgccagtcgtcacaagaccctgtgtaagacgctggctagacttagccataacacctcgccaaccgcgaacggtgctcaaaacaggcagaagtgctagtccccaccagggaaaacacgctccacgagtataaaacgcagcctgcatccaactcgggggtagatcgccaagaacctgagcctcacaaacacacctttggaacctcacgcggggacccccaatgagcacaacacagctaaacaccctaggcgttgtcctgtcccacccgagaacagccaagccagatacataactcgtaacgacaccacttcgggcaatgacacaaccgtcataaacaccgtcatataagtgcggcgacagcaacccacacagagctgacaacttcggcccaagaacagctgactta

SEQ ID NO: 716853 - DNA, 170 bp, Homo sapiens
ggtggagtggatgttgtctgttccaatgagaggtgcccacgaaaatcacacatcaccgggcgaacggtgctaacattaattagcaggtcccatcctctcctttgttgctggccaatctttccatccaaccgaatgtaggttcatgattgcagtggacacatttggcgatg

SEQ ID NO: 716854 - DNA, 140 bp, Homo sapiens
taggtgaggggcagaagcaggcagcaggtctttgcttcctgcttctgcccctcactaagaccctgcttcctgcttctgcctttcttccttttctgttgctgtttcttcgcttcctgcttctgccatgtcagaccgtctct

SEQ ID NO: 716855 - DNA, 275 bp, Homo sapiens
cacgcccggatcattttatattttagtagagacggggtaacaccatgtaggcaggcgggtctcgaactcctgacctcaagtgatcctcccacactcggactcccaaagtgtagggattacagagcgtgagccaccgaaaccagccaactttaatttaaacctaagttttcagtagctctttgtggctagtgttattgtaccaggagaagctgtggaggacggagaagcttgtaggcggacggagaaagctgtggcggccggagaagctgtgacgg

SEQ ID NO: 716856 - DNA, 391 bp, Homo sapiens
  misc_feature (2)..(2): n is a, c, g, or t
  misc_feature (5)..(5): n is a, c, g, or t
  misc_feature (13)..(13): n is a, c, g, or t
tngcnttccagtntccagaccatgtctcacttagtcgagccgccgccgcccttgcacaacaacaacaacaactgcgaggaaggggagcagcccctgccgccgcccgctggcctcaacagttcctgggtggagctacccatgaacagcagcaatggcaatgagaatggaaatgggaagaatggggggctggagcacgttccttcctcgtcttccatccacaatggagacatggagaagatcctcctggatgcacagcatgagtcgggacagagcagctcaagaggcagttcgcactgtgacagcccttcaccacaagaagatgggcagatcatgtttgatgttgagatgcataccagcagggaccacagctctcagtcagaagaagaagttg

SEQ ID NO: 716857 - DNA, 167 bp, Homo sapiens
aactcgttgttggaggcgctgggcaggaagttcatctctagaggctgcagcgcttgggtggggggatctcgagtagcgtcttctccagactgtttgcgcagacgccagcttggcggccgcctgtcgactatgctgaagactcggcagaggtgaccacagaggccaaa

SEQ ID NO: 716858 - DNA, 208 bp, Homo sapiens
ggtgtggtaggtgttgtagccgctatggtgaagttcgctttgtagcggccccggctagagagttggcctgttcctgcctttgtgacccggagagcttttggggtgcgtacagccctgccttaggagcaacctggtttgtggcctgtttgattcctgtacgaggtttgctgaccacgacacgactcgaaaatgcatctacggtcactta

SEQ ID NO: 716859 - DNA, 923 bp, Homo sapiens
  misc_feature (922)..(922): n is a, c, g, or t
ggtcccccaacgctacgtgtggcgtttctgcatggcctgcactcggcaccccgcttcttgacagccttcgcctatggaaccactacctcagctgtgcgtctccatgtccgggttaccgccttctctgccgcattaacttcagtctcaatgtggtggagaacctcgcgctgctcgtgctcacctacgtctcctcctccgaggacttcaccatccacgaaaatgctttcattgtgtttatcgcggcatccctcggttacatgctcctcacctgcattctctggcggctgaccaagaagcacacagatcgcaagtcctacagctggaaacagcggctcttcgtcatcaacttcatctccttcttctcggcgctggctgtctacttccggcacaacatgtatgtgaggctggagtgtataccatctttgccatcctggagtacactgttgtcctaaccaacatggcgttccacatgacagcctggtgggacttcgggaacaaagagctgctaataacctctcagcctgaggaaaagagattctaaccccgtctgtgatgctggaaaacaagaaaccactctggccttccctatctccacgttctctctgggcctggagagaagagcggaagggtatgacagggctgacccagaatgctgactctccccacattcatggggatctcaagaaggataccattcactggaaggtccaaaaaatgagctggcggaaagtcccccttggggctaaacaaaaaaggctggggcccaggggggtcaaaccgggggccgaaacgcgcttccgggcaccgaggggagctccggcgccggtgccgggggccacgccgggaagccccccaggccggcggagacaaacaggagacggaggcgaccgcaatgtctcgcgggcgaaaaccggcacggcant

SEQ ID NO: 716860 - DNA, 98 bp, Homo sapiens
  misc_feature (24)..(24): n is a, c, g, or t
  misc_feature (51)..(51): n is a, c, g, or t
ttgtggtagcggagtttcgagatntcgaagctatccgggccgatggaagtnccgagcgccatgatgagcgtgcggatttcctcgaagccgagcacttt

SEQ ID NO: 716861 - DNA, 161 bp, Homo sapiens
catgctgtggtcgatctagagttccccttatgaatcaacagtatacccccgattccgctacgaccaagctcatacacctcctatgatataaacttcctaccactcaccctagcattacttatattatatgtctccatacccattactatctccagcattcc

SEQ ID NO: 716862 - DNA, 300 bp, Homo sapiens
  misc_feature (89)..(89): n is a, c, g, or t
ctaagaggatccgtcagtgatctactgcgcaactgtggacttagacagcactgggagtgtacggaagttgtagaaatgcaaatctcagncaggaagcgtggtggtcgcgcagtaatcccagcactttgggagggcaaggcaggtggattgcttgagcccaggagtttgagactagcctgggcaacatggcggaaatcccgtctcttaaaaaaatgcaaaaaaatattagctgagtattgtggcaggcgcctgtagtcccaactacttgggaggctgagatgggaggatcacttgagccca

SEQ ID NO: 716863 - DNA, 438 bp, Homo sapiens
cgcagcatgtgctgatgcctgtcactaaaacaggccaaaaactgagtcctgctgtagcatagaaagcttcatgctgctaaaccaatgttaagtgaatcttggcaaacaacaagtctccaaattactgggatgtgcatgtcgaaacgtgggttacactgactgggcagcgaacgtcgactatttgccatgacataagaaataagtgtagtggctagtgtacaccctatgagtggaagggtccattttgaagtcagtggagtaagctttatgccagtttgatggtttcacaagttctatcgagtgctattcagaataggaacaaggttctaatagaaaaagatggcaatttgaagtagctataaaattagactaatctacatcgcttctctcctgcagagtctaataccttttatgcttcgataattagcagttcgccta

SEQ ID NO: 716864 - DNA, 306 bp, Homo sapiens
  misc_feature (13)..(13): n is a, c, g, or t
tgaacattcgtgntcaccacctcttgtcagctatataccgccatcttcagcgaaccctgatgaaggctacaaagtaagcgcaagtacccacgtaaagacgttaggtcaaggtgtagcccatgaggtggcaagaaatgggctacattttctaccccagaaacctacgatagcccttatgaaacttaagggtcgaaggtggatttagcagtaaactgagagtagagtgcttagttgaacagggccctgaagcgcgtacacaccgcccgtcaccctcctcaagtatacttcaaaggacacgaatgttca

SEQ ID NO: 716865 - DNA, 672 bp, Homo sapiens
gatatggggatttgatctgaagaagtaccaaacatatgatgagaaaaatcggctactgatgcaatcccaagagtgcgcgaggaaacctataataagtgtagatcaagattgggggagttggacttaaacgatgaatcaggtgatccagatgaggaaagtgatgcagtggctaatgtgtcttcattgattgcgccacctcaataatttgagagcttcaaattatatccatgtgataatggtgacctaatgtgtcatgatcacaaagaattgtgatactggacgattctcttatatgatgagagttcattgtgcgtttcaaagaatgggtgttatgataccttattttaaatttgacgatgtgctttccatttccattaagtggctaaggatagatagatgtgatctgcagaagtttgtgaggtcttcatctgaagtccaggctgggagggagcaattataactaaggacaaagaaatgttagtagccgtgtggtatccatggaatcacctaatttcaggtctcgtggacattggacagtaaaccgtgtttcctgaaaggattccgtgtgggatactgctttgagctgtgatcagacgcaaaatgtgtttgcggtaatatatcaccctaattgttctttttaaactttaaaacctattttcttttgtacagata

SEQ ID NO: 716866 - DNA, 115 bp, Homo sapiens
actagctttctgccacctgggccgcctgggtagtgtgagtgaagccaaggtccttttgcttgtgaggccctaaaacttacaacaaagctgcagataccacgccagtgtgccctgt

SEQ ID NO: 716867 - DNA, 217 bp, Homo sapiens
aaaaaaaaaaaggggccccatgggggtttggggtaccggggggtttgtttcccccctttcccccccggccggggcatttttggtgggggtttttaaagaaggggttaaaatttttttggggggggcccccaatttttttttaataaagggggttgggaaggggggggggggttagaacccaggggggggggacaggggaaaacccccggccggggga

SEQ ID NO: 716868 - DNA, 709 bp, Homo sapiens
ggacgcgtgggtcgaactggagcagaaaaaaaaaaaaaaaaaaaaaaaaaaaaaaaaaaaaaaaaaaaaaaaaaaaaaaaaaaaaaaaaaaaaaaaaaaaaaaaaaaaaaaaataataaaaaaaaagaaaataagaaatagaaatgatataaatagaaataataaaaataataaaagaaaaaagaagagaaatgataaataagaagaagatgaagaaatagaaggatgattgagagctggcatgtccatcaatgctactgcgccaggtattagtcgtcagcaagggcataaactgaactattagtcccttaattacgctgtccatcacatatttcttaagtcagttggttggaagtaacgcatctcttaaactgttatgtctacaaattggacacattcatacacatttacgataagctaacacacgcacctgagattaacctgcactacaacacactgctaatcagtaaaacacctttacagaaaagcgaaagcgacgcactgcaccagatagttaccatcttagcagctacatcccatcatattatctagccggatgctcaggcacgaatttacacacagataacgttaacgatatattttagaaaaaatcagagtaactatgattaagatggagaaaaccaaactttggaacacgaaaggcacataagagtccacaagaactactaagaagaacacaatttacaca

SEQ ID NO: 716869 - DNA, 161 bp, Homo sapiens
tcgagctcgctaccccatcgtcgccatcaacaaggacgaggatgcgccgatcttccaggtggccgacatcggcctggtcggtgatctgttcaaggtggtgccgaactgaccggcaagctgtaaccgaattggcttgagtaggaaagggcgtggagagtgat

SEQ ID NO: 716870 - DNA, 434 bp, Homo sapiens
actttggtttggcaaggggaagggaaatcgagttgaagcaatctcacagaagtaaaaacaggcaaaaaaagttaaaaagacaaatggttacaggaaaacagttccaggtgcaggggctttaaattcatcacaaggtgataggtgcgtgggctctgggtgctatctacaggacacaaatgcgggggcttaggatactatcacctgagcgaatttctgggaactgtggacagagcttgccacagtaccttatcagttaattgcactttttgatgtgctgggagtcagcttgcacaagttaagtccttgaggaagggggtgggtaaggagcccttgttgtcttgcaaatgaaggagccaaatggagtctgtccggctttctcagctaaggaagagtctattcatattaaaacaaggtaaggtatcacactgtctcaa

SEQ ID NO: 716871 - DNA, 1081 bp, Homo sapiens
tggcaagcactggagcgttatttggaaggaactatgcaatgtagttgggttcttgtgtgaaagaacagtcaatgagcaatagccatgggtagaacctccgtctggtgcgtgcccagaacactggccctgggctatgcgacttgcctcaggcccatttcccggaagaggctgccaatgaatgatggaaagccggcggaggtcttggtgctggacgtcgtgagggcttcgaggcaggacaccaaggactctcgctctggaggtagcagccacccagagaaggttagctgttcgtctgatgataagacttgtgtgacggttcccgtcgacccagtacacggatgcgcggtaacagctaggctgcgtgaaacctaatccgagtggagctacttgctgaactacgttctgggcgtgataagaaggagcccacaagggtgacggcgagccgctgtgctggcgttatgagactactgctccatgaaacagctgagagggccaagggaaatgcccaaggacacatgtcagaattcatccgggacaaggagtgatgatcgaagaagactatgcgaagaacttagctaagctctactcaggaactccgtggcttcacaggaggaaggctccttggggagaggcgtgggcccagtgtgaaagaagaagcctggccggtaccgaacgcagacagttcacgctcagggttctactggccaagcttgcgcagcgacggtggagacagcgcctgatgcaatttccgtgagaacgtcaagacaaggaccatggaaccaaggtgcgaccaagccagattaggccgagcttcggcaagcagcgcgccagccgatattgcctcggaggagaagggcccggaaaggcccacacagaccgggcagaagggaccgggagacatgacaaaagcagccagacggaacatcaaggctgagcacaaagaaccgagcacggacctaaagaacgggggcgcaaaggtcccccacaggcgtgaaaaaaccacatgcgcgatgggatcacaacacagcgccggacaaaggagtcgcaccgacgcgcccccgaagggcacaaggcgaggcgg

SEQ ID NO: 716872 - DNA, 401 bp, Homo sapiens
taacggtagcgggatgtgaacaacgactgctggtggaacggatggctcgagaaaacgtagagcctgggcacaaacggtttgccaggtcccttgggccggtactcggaatgcaccatgaagagcatgtgagggacaccagtgccgaagtaggcgccatccgtgtagatggtgtcttgatgagtggggtgtgtacacatccatgcgcttgtgggcagtagagcttcaccatggcttcacctgggatgtctgaaagtgccaatggtgaagcattgacttggttctcacagtacacacgaggacagtaaccaaatgtctccttgctgttacttttccaacatctgggcgatgccacggttggtaaggatgtagcggtcgaggatcaatccataatgcatctcggc

SEQ ID NO: 716873 - DNA, 288 bp, Homo sapiens
  misc_feature (223)..(223): n is a, c, g, or t
cgaggtgacttagaggatcccgatatgctagggtttcagtcccttttgttctggtatgctctgggagaatgactgttaactccataagcagttgaaaagggaggaagaaagcagaagcacgaattagctatttttgaaagtagtggggtgtggagcatcatggtagcacaaattctatgcacatcctctctggatccttccttcactcagcacttatgtacantgtagccatgaatttttttctttcttttctctctcttttttttttttttgggagacaccatatcg

SEQ ID NO: 716874 - DNA, 1650 bp, Homo sapiens
  misc_feature (394)..(394): n is a, c, g, or t
  misc_feature (1127)..(1127): n is a, c, g, or t
ggggaaagcaggactggggagagatccaggactgagccagcctcaggccaggcgggaaagcaggctgtccaggctgggcttggtggtcaggaacaggggcatgctcactggtggctctggagtacgtttcctctgtcagatgcttcaacggttttttttttttttattttttgtggctagaggcgcacgtatatttggcccacaagcgcccttggggatccaagattagagggccccaggggcatagactggcttttgcgcaaaaaacggggtgtgggttcagcacctgttgaagaaagaggctcctgtgagaaattatctagggtgtgcgtgggagttacctatattcagcaggagccattttaaaccttgtggggaagtgtgcaaggataanccctctataggggaagctcttttccccacagaaagtgtgcttttttatgtgtatgagtgctctgtgaacaatgtgacaggaagtctctataaacaggtggtggccaagtgtgagtgtggccaagagcctactcagaagatatataactgttgtaataacacacctctgtggacgctcatcgcgtgggagatattcaaacgagtgtttataagcaatagcgctgtgtgggcattttaacaacaaaaaagcccctgttgtgttgtggccccccaaaaggggccaccgaagcttatagaagacattgtagaaggatatctacctatcagacggcatagaacacaccaggtgggggggtctttcaaaaaccaacagattgtgttgtgtcgcccaccccaagcgagggctaataaaatatctcttctacgaagtttctcccctgtggcgacgcactctaaaaagcgacgagaaagtgagtagacgccagacaacttttgcggggacctcactcgaggcgaaagaagtgttgctaccagggacggattcaaccgagcatgtgtgtgagaaaacccacacgtgggttggttggccaatgtggcgaccacagtagtattagtgggatagaagtgtactgaggtcttaaaacagcacagcatattattctcgtcagcaagaatacaacggcatacaaatatcgtcgacagagaggcgttccccacagagaaggagagagaanaagagcagttacgtccgactagataggcactcactgataggtaggaaacgaccctagtctgtgtagaaccaacacacccgtgggacgaaaataagttgagtgtgcacactcaccaaagcagaggttttataacagtggtgcccgacagagggagggtagctcaatagaactctctctgcacaacaacaatagtttgattcacgacaggaaagtcccttcccacaactacttattattagttgtatcagagactacggccacaacatcactgttttcataatagaaaaagaactttatctctctcaacaggacctcactctccctggtggaagagatttacacccactataagatggaagcctaccctcaagttttataacactactaagtcacactctctcagtccatacacagagacaaagaacaacttactaacggctatcaatataaggtagaccagacacgatattatattcaaacgaacgacacaataagaacgaaaaaaagaaagcctatttcagtt

SEQ ID NO: 716875 - DNA, 144 bp, Homo sapiens
ctcgctgttccggatacgaatcaatgtgaccgatcatgactcgtcagcccccggacagacaacatgggggaaatgggccatggaacaacaacaacgaaaacctttgttttattttcatgccaggagaggatcaaggtgtagctc

SEQ ID NO: 716876 - DNA, 1351 bp, Homo sapiens
ggagctggacccctaatgctggaccgctggcaccgtgtctgtggtgtgtgcagcagagtgtcgctcgacatgggggatggccggggctggctgctgtgctgcctcgggagggcctggaggcaagccctggaggcagaggtggtgaatgctgctgcccttcctgtgcgccctgtgcgcgctgggcggacctgcagtgctgtgcgtgtgtgtgcgggcacgtgctggctgctgacttggctgctggaacccgtgcctgcgcgcttgtttggctgggggcaggctggctgcttgcatgcagggcgctgacttgggagcctgggcgcccggccctctgcccctggccctggtgacggccttcactgcggcctgctcggtgacactgtggcctgcctgaccccggggccttgcacgagaccatttgcttgggctggcctgacccctggtgcttgccatgcggctgcctgattgggggcctgcggcgtatgggaaccccggccagttggggcccccttggtggaccgagagcatgggccgggcacggcaccggctggcagtatggcgcaaagcccttcaaaggtaccgcagaagcctgggctggccctgattggtgccatggcgtggcatacaaattggcctggagactgcattgtggctggaccagctgggaggcccgggcagagaactactggggggcacttgggaacgaccggggacgtttgggtgttagctagcaaggctgagcatttggttggcacacgggcccccagaggagttaacaaagagtagagcactggcagactgaccccctgctttgaggcaacgttaaagcgccttaatccatggcacaggcttagtgtccatcacgaagagcctacagagccaaacaggctcccataggctgggacgcacgggtgagccgtttaccttaacattgggaacccccccgggaacaaaggtggttgtggccggttgggttccccaaaggcgcgagggttagtatgtgaccacccagttttagcgcgccaaaggtaaacccaccggggaagcattccccattctttgttacccgacacgtgtggaggtccggaggactatggggcttggtcggggggaacacgcccattgtgcagcgacgagtctgtggtgatgcggaatatcggaagagcctcagccaggaagcgagttgaaccgaacaggtggagaatgggcttatggggagagcccattgaaggtgttggaaaacagattacattcccccgcgtattgttagggtgcgtacgatatgcaccctcagttgtggttcattgtgggcccgtgtacgagaagctattactcccagagtgcaatagaa

SEQ ID NO: 716877 - DNA, 845 bp, Homo sapiens
gaaagaaaaaaagtggcccttcctgtactaagggactatgtaaccccttagagctagtaataaccaatccccctgatcctcactggaaaaaaggggagcgtgtgaccctaggaattgatggggccatactggatcctcaagtaaatatcttagttcgaggagaagtttacaaacgctctcctgaggcagtgcttcaaactttctatgatgaactaaatgtgccagtaccagaaattccaggaaaaacaagaaattgtttttgcaattagctgagcatgtagcccagtctctcaatgtcacttcatgttacgtatgtggaggaactgtaatgggaaatcaatggtcatgggaagcccaagaatgagtacctacagactcagttcctaatgaattcctggtcaaaagaatcaccctaataattctgggtcctaaaaagcctcaattattggccatattgcataggtagagaagaaaagaattcactcaaccataggatgactagttgtctaggacagaaactgttatgtaccccgaacgtcactgatgggtccatccctagaaggatccatttagtaaatccaaagtgggaactgtgtgaccacccggagtgcccccggatggcaggcccactgtgttctggatgtgggctagttttgccaatactgccggggagtgggtgacttttctttactaagggaccgggtcccgttgtccgaagagtcgtgaatggaggggggccggataatggggctggaaggtgggggcccttcagcgtggggtaacaagaggggggggagtaggcgggggggtgcgttcgcgtgtttgttttgtttcatctcgtcgcc

SEQ ID NO: 716878 - DNA, 246 bp, Homo sapiens
ccccgggctgcacggattcggcacgagcacgaatatcataatcagattggcacctttgcctctggttggagcagttctggaggttttatagccacatggtacgttcctgggacccttgacaggccaccagtgacttccatctcttcaaagaaggaattaaacccatgttgggaagggatggaatggctaaattaaaattgttggtcaagtgattatcgctgcgaggcttgctccgtgctggagact

SEQ ID NO: 716879 - DNA, 115 bp, Homo sapiens
cacgagacgagatgtgtgagggacgatatgaatattaaagtaatcccgagagaacgagcacctcctcgaagtcttcccacgttgatcaatcttgcgttatatgatagacaatcag

SEQ ID NO: 716880 - DNA, 455 bp, Homo sapiens
aggttttgcccgtctctcgagtgatccccctgctgaccaagcagaggcatcgtatgcatggataactagaggatggtatcagccctgatgatgtaactgttgcaagagcttggtcctcatttgagcatttctctatttttccatgttatccccgaaatatctatgtattatatttttaggggaagtgaggtgtgcccagttttgtaatctaagcaactacttttggggacttgcccacatctctgggattcgaatggggattgtatcccattttactgtcttttaggtttacatttaccacgtttctcttctctgctccccttgccccactggggactcctcttaggctccttgaagtttgctgcttagagttggaagtgcagcacgcaggtgatcatgctgcaagttctatctgaacctctggcaaagggagtggtcagtgaaggccatcgtta

SEQ ID NO: 716881 - DNA, 880 bp, Homo sapiens
  misc_feature (8)..(8): n is a, c, g, or t
  misc_feature (79)..(79): n is a, c, g, or t
  misc_feature (114)..(114): n is a, c, g, or t
  misc_feature (129)..(129): n is a, c, g, or t
  misc_feature (139)..(139): n is a, c, g, or t
  misc_feature (162)..(162): n is a, c, g, or t
  misc_feature (193)..(193): n is a, c, g, or t
  misc_feature (247)..(247): n is a, c, g, or t
  misc_feature (250)..(250): n is a, c, g, or t
  misc_feature (272)..(272): n is a, c, g, or t
  misc_feature (297)..(297): n is a, c, g, or t
  misc_feature (305)..(305): n is a, c, g, or t
  misc_feature (355)..(355): n is a, c, g, or t
  misc_feature (438)..(438): n is a, c, g, or t
  misc_feature (478)..(478): n is a, c, g, or t
  misc_feature (507)..(507): n is a, c, g, or t
  misc_feature (537)..(537): n is a, c, g, or t
  misc_feature (575)..(575): n is a, c, g, or t
  misc_feature (581)..(581): n is a, c, g, or t
  misc_feature (599)..(599): n is a, c, g, or t
  misc_feature (634)..(634): n is a, c, g, or t
  misc_feature (651)..(651): n is a, c, g, or t
  misc_feature (654)..(654): n is a, c, g, or t
  misc_feature (676)..(676): n is a, c, g, or t
  misc_feature (712)..(712): n is a, c, g, or t
  misc_feature (745)..(745): n is a, c, g, or t
  misc_feature (777)..(777): n is a, c, g, or t
  misc_feature (779)..(779): n is a, c, g, or t
  misc_feature (838)..(838): n is a, c, g, or t
cccctctnactgtggggcagaggcacatttcccttttaatgttaaaagcaaacagaggtgggaaacagcattctatccngaagccgttttaactgcccaaacccttagattacnataaacaagagaggnatggattgcnttagtcgccggttgaaagccgcnatgccattccctttcccataataacactgtntagctcagtcccttctggggctaatcccctatcacacccaccggaaacacaganatnaaccaaagcgtgtgagtctctnccctgagtccatttctgccaaagcntgtctganagaagaattggtccacggaagccaggggacccactggcttgtctaatgangcctgggccccctccaggagccacacaattccctccaatctcagccctccttatccctgccagagcccacaagcaggctaganatcaccccaggagccgagccccccccagtctgaggcagangtgggaagaaggccaacaagtcacaagtngatctctggctccaactctgcccagcaganatgccttcaatttgcccatcttcagtcctgcgagcgtnagagangaagccaaagtttcagangcctagaagctttactctctattcctccaggattnctgcggtcacaccttgnaancagtctcccactcaactgccancgtttccctaaatcgcattctctgaatctggaagtnccaggaaaccttaggccgagtccagtgacattnctcgatgcaacagcccaactgtttctccaganancctggttcttggtgacaatgtcccttcttggcatggttatttaaggagaggttgggccngaaaaagaggggctccatggctcaccggagttggacattaac

SEQ ID NO: 716882 - DNA, 299 bp, Homo sapiens
  misc_feature (252)..(252): n is a, c, g, or t
gtttagtctcttttctgccaattggctaatgtcgttaacgtctttaaaatgtcatcttgcgcatcgggatgtaagaagaaatcagcgaccaaaccatgaaccgactgtgtcaccaaccactcatttattgtttggtcatcagcatctggcttgagatggcgtagtcttttgcgctgttgatctggtagccgttgtgcaataattgccgcattaacggtatagtggtactttaaaaaatcatagtcctcacgngttctcacatgattcaaaaaagcaatcgtctgcgcaatttgttcccc

SEQ ID NO: 716883 - DNA, 730 bp, Homo sapiens
agcggaatacgttaatttagcttttgaagatgcaactgaaaatgaatgtcgtgaattttctgcaaataaaaagtttaaaaggtcagtttactttcagtcgatgaatgtgaagagctgggatcagatgaacggagaagtccatactccctttcaggcttctgtagattcttaattcaccttctgatgtattgatggcatttctcatgaacatcatggaaggacctgctattccagattctacacgagaaagtgaacgataatatattagaatgtcaacacaacatcacggcaatacgtgtatgtaaaaatgaaagcactgtcttggatcttagtagcattgacctcttcaagaaacaaataacacagagtgttacagccacagaaacaaacgaacacaatagacgtcctatccagtagaacgcagacagcttcttcgcagaagataaaaaagtaaccaatggcaacgccctgtggaacacatgacattcagcaacgcagcacattcttggatagtgcatgtacaatctcaagaaagacatgtcacttggatcttcatcaaagagaacccaattctgacataccaaagaacagctctacaaaatctctaaaactccttacggaagtcaagtactagcctcaggcaaggtccagtgaacagaagagccatactacaaatactgagacaagctcaatcttgcttatctagcaggtaatgtagagaactagacat

SEQ ID NO: 716884 - DNA, 936 bp, Homo sapiens
gggaaaaggtgctgtgggggcttatggatccgagcgcaccactacagtccatgcaagacttccctgtggttgactcagaggaagaagctgaagaggagtttcagaaggagctgagccagtgcaggattagcaagaagctcactgctccccagaaggaactttctcaagtcaaggtcatagacatgacaggccgggagcagaaggtctactacagctacagtcagatcagccacaagcacaacgaacccgatgatagggctgacgctacagtaccaacagctgccacagtctggcaaagaggacaaggacaccggctatagcgctgcccgagctggagcacaacctgcagctgctcatcgacctcacggagccaggagatcatccagaatgaccggcagcctacagtatgagcgggacatggtggtcaacctctaccatgacctggagaagatgaccgaagtacctggaacacgacgagcaggtcatctcgaacctcaaaccacagtcctgcagatggcggaggactgccgagcggcggactgccgaccgacctgccccacaccccacaaccaaaaaagaacaatataaaacaccaatacaatcacaacacacacccatacaaaacaagatctaataccaaaaacaatacacaacaaaccacaacaaacccaaacataaaaacacatcaaccacatccaccatccataaacacacataattttcaagaaaaatccaaaaacaacaattcaaccaaactgaaccatcatctaacaccacatacaaccaacccactaaaacagaaaaaaaagcacaaaccaaccaaagaaactaacaccaaacaataaatataatctcccaaaatcgaacaaaaaacaaaaatgatcacactattacataaaaccgtaccattacagcaaaagaataacagaagaactt

SEQ ID NO: 716885 - DNA, 234 bp, Homo sapiens
gtgtatcactggctaacttagaatagtttggtatagtctggcaagagcacataaagcttatgtcataaaaaaaaaaacaaaacttcggttggtctcatttggagatattttctttactccttccaggagctgatctggatagggagggccgttccactggaaagggaacgtcccttcctctatactcagtatgaggaaagactcggtccacatgacagggccaggggaaccgag

SEQ ID NO: 716886 - DNA, 257 bp, Homo sapiens
ctttttattatcttttgaggtgaattcctcttcattggtattctgttgggctctcactgcaaacagtttctctgtccgctttgatgccttaagcttccaaagacaattcttccagttctatcagtgatatcatcttcatcctggtcctgcttttttttctctttttgctttttcccttttgacttttgaggctcctgttctttggcagaaccagctccatctatttctgcatgccaaggacatcaagatcaatgtct

SEQ ID NO: 716887 - DNA, 625 bp, Homo sapiens
ccctcttcctccccccctcctgaggtggggcagagactgtgttccatcaaccaggtggcggaccaacccacgcagtttggtcggtccctgacccattgggaatccccccgcagatggtttgttaattccttggagggcaaaaccccccttttgccccaggggcagacaaccatgggtgaaaacctggccccagtttaggggaacttttccagcatttatgaacggattaaaaagctgggaaagtgggcccctttggggggtggagaacaggggttttccccccccctgtgaactttgttaacaggttacatagggtttccccttttctaaaattttaggatccccctccccttttaccctgggggcaagggttttttttgcatggggggtttaaccccccccccctatgaaaacaaagggggaggtagggggtgggtttccccaaaagggggtttcccccccggcctgggggataaggaggggggcccccccccaagcccactcatgtcccaaattgctttgcctggggggggggagggttgggttttgtcccccccccccggttttggggggggctgtaaaactggccccctgtttttgcccctttaaaggtgttggtttttga

SEQ ID NO: 716888 - DNA, 1476 bp, Homo sapiens
gtgtccaccagcagtattagggcggggatattgcttgctctctggagtccttgtagccgaccgcgcccgacgctttttgggcacccttggggggcaccacacctatgtagggccccttcttttggggcccaccaccgggggccagcaattgtgtcgctgtgtaccacccgccagcccggtttccgttcacagttctacgattctgacccgaggcggacggcctttggtatatacctttagggggcgccgccctcttctcgcgcagtgtgtgcaccctctacgcggcccactgtctattaggttgcgtgttgctgccccacttggggggcagcccccaactaggggtagtagtgtccacagaccccacgaagaatttcctgggggcaaggataagataaagataaggtgtcgcaaagtttttagtcctgggattgccgaccctttttaggagtgtttgtgtgggtaccttggtgtgaaccacccggggtgtgtctcccaccagcgaaaatttttcggtggtcccccttttttatagatgcccgcgggaatattttataggcgggaccccacaaacgccacacatggggaggaggccccccccccgattccccggcgcccgagagttttttgtggtgggcgttttccaaaaagtgtttgtgggtgggcacccacgatctcttaataattgggcgggaatatctcctccaggcggcttcctgtttctctctgttgggcgcggtgtcccccacccagagaccgcaagtcggtactccccccccacgaagagaggcggtccccaaaatattcttggagagagttgtgttttttgggctctctttgagagcactccgttcttcacacacgagagcgctctcccacgtgggttgagagagggagtctcggagagcgccactttgagaaaaccctctcacttatccccccggtatggacacacaaaaatttttttggcgctctctccctctatgtccaccaaccccacggcgccaccacgtgttgggagcacaccagtgggcgctcccagagtgttcccacagtggccacccacagtgccacttgtggcgttatcccttacggggatataccatttgggttgtttgaagatgtgtgtggtgtttatatcctcgggagtgaccatagccacccccgcgaatagggtcccactcttccctcggagagatagctcgtcctctctggatattttagactcgctgcctccccagccctctctggggcttggagaacacatttatcttaaagagccactcttcccttctcctgttaaacacccctgttaacatctctcccataaatttggtgattcttcttgctaggccctaagattttgagttaacacatcttctttgaagccccaacactccccccttcttgtgcctttttgccttgggataatggagtttttttttagaaaccgtgcccagaatgacccagatatta

SEQ ID NO: 716889 - DNA, 1710 bp, Homo sapiens
  misc_feature (1038)..(1038): n is a, c, g, or t
  misc_feature (1045)..(1045): n is a, c, g, or t
caatggtggggttatcacacacctccctcatcaagaagagcgctgtgttttatgataattggccgccgccccagacgaaagaaaataaggggggggggttaatataaccgacaccgcccccgcagtgtttggcatacgagcgctcttgctgaaaatgacgccccgtgggggtccacctattggttcctacaagagaggagaatatttgttgggaccatcaaggggtatatttttgcgtcccccgtgatgtttggttgccccgacgacgtgttaggatttctccgccgagtcaaatgtatgcgggcccacctcattggtgtggaccaccaccatacaggtatgggggggtgaaatggtttattccttttctcgcagccccctgcgtgccgtgttttaattaatttcctcagcaaccgaagagggagctgtttgttatatatgaatgaggttgttatactagtgatataaggatggtgaggaaaaagaagggttgttttttcttgtccgcacacgacagaacatcgggggtttagacaacccaaagaccacccccaccgacttttgtgtgttgagggggtgtgtgaaacacacaaacgaagtatctcgcgctccggcgttttagaaaccacaccgcggcgttggggtgttgtttgataagacaactggttgtcggcgctccacaataatgtggcccctcttctaagaatttttgttatgttctctcttctctcctcgtagaagaggagatgtgttggcgcctcctctcgcgtataatagctcttcggctggtaggtgaggcccacccccggcggctctccatcatttattagcaactcctctcttctcacctgctgttcagagcagcaccaccgctgcgaaggagaagtaataacatcttctcgtcgcagaggcccccaccccactgttgtgacccccactccgggggacgcccactattttcttgtggagtgtccactctccttctcacacttgtggtgaccggcgccccacacacaggggtggccacaacagagaggngtgttgngtttgtgtctctcctctgagatacgcgacacactctgctgtcttttagtgtgcggccgctttttttatatgaacacattggtgtgttgacagctggtgagaccaccctgctgctggggagtctccttctccacaatctgcgaagagtttcctctcttctttcatcagcgagagagacacacaccgcacacccagagaatatttgttgtgtctcactgtgtcccccacactttctcacacaccgcaagattctggaattatctctacacccacatagtgtgtaaatatactctcccaacaacactatctgtttactctgtgagagcgctttacttttctcacagagatagagatagatatagacttcgccggggatagaccccgcgacacacacccagaggaagagtgtagagatcttttctggaccaccaggaaaaagagagaaaatatataggagaattttcagggaaccagccccagagattggatccaggaaagactgtggacatccaccacaagatgttgaccccaaaatcctaagcttattccctccaggctcccgggcttacactgcgatctgggtttgctttgacgcatgggtatttatcctcccccattggtgttttttaatagtttttaggacccttatttaattagctgactccc

SEQ ID NO: 716890 - DNA, 858 bp, Homo sapiens
aattctgggatgcgccgcatccgtgttcatccctgtacggctgctcaacttgtgtcaggatcgtcgggtacaagtgtgaggcaatccgtggagactggctgccggccgagccacaccgaggtgtctcgccgctcgagttgccactgcgctttgaagtcaggcatactgcctcgttgctgctagatgcatgtttaggcagaggataaagacttactctgcaggaagctgatcgactgtggtgcggccctggagaacacatgtgcactgatactgtgaactccatctagcacgatgatgtgaaccaatgggggcctgtaggtctaaaacccccgaaatttcgaggcaggcttgggcactccagatcatgctgccgttaatgctctgcccgcatgtggtggtgtgtatcccataagaccgactctggaaggaaccatccagtaactggtcttggcaagaacctggaaaaaaatctccaccaagggttcactcacatgttttggggccccccccaaaaaaagaccggggtttggatacacgaaaggctattggcaaagaagttctcggcaagaaagcggggcctcgctggtgagcgtgggggaaccaatgcaaaacacccacttgaagaatggggtggaacccctatggaaaagataaaggccggggtgcgcggatgattttttcagccggtgggagagactagggggggaaatgcacggttggatggggagcaagtggcggaaagactaaaccggcgagggggagagaaggaaaacctctggcagaaggcagaaggcctgaaacccacaacgggccggtaagaactggcaggggaacaaaatagagaacccggggaccaaa

SEQ ID NO: 716891 - DNA, 243 bp, Homo sapiens
gatcgactgcccgtgacggtggccaatggggcatgtcttgcgctggctgggcacgacaccgagtacggcctgtatttcatgaactaccacagccgaaccccgaccgtcggcaccaccaccgccagtgccagtaccatcacggcgctgggcagtatcctgccgctgacaccggcaccgttccgtagcggcctggcgcaaagcatcatgctgggacgcggtcagtactatctcgagtcgacgcgg

SEQ ID NO: 716892 - DNA, 269 bp, Homo sapiens
ctgtaaaaaataataataagaggtactgaagagcaatgttaacagaatgctttatatccagaatgctatgtttttttcaagccacattttagttgaatgacgtcaaggtattccaacctttattttcaacattttgggacgtgtcacaatgtgattacctctttgatatgatgaacctataagtctattcatctctgttatttcatttctcaaatgtgagccttgttgaggtccattatcaaatctacactttggttgattatatgatg

SEQ ID NO: 716893 - DNA, 544 bp, Homo sapiens
  misc_feature (109)..(109): n is a, c, g, or t
  misc_feature (303)..(303): n is a, c, g, or t
  misc_feature (365)..(365): n is a, c, g, or t
cgcgcctccccccccgggggggtttctcttttttggaaatcccggtcgggggagtttttaaccatttttcaccaccggggttttggttcccccttggccgggcctcctnggaaaagtttgtcccccgtgtgggagggggggagccggtttggaaatggtcttcaggacccgcccgcagggtccccataactgttcagggtttttgcatttttgggtaaatggaaacttcgggttcctgtcggggggtcccccatgcctggaaaaggagttggtggttcccacccctggggccgggaaaagggnggggccttccccttccctcaagccgggggtcttcctcctgtggggggggttattgggccccngggcctttttaagggcgggcttggggcctgttaaaggcaaaaccccgcccctttattccgggggggggggggggccaaggatgttggggtttaatcaggcggggccggtttttcggggttttttttttcccaatggaattgaacccctgggccaaataaggttggatttttccccccca

SEQ ID NO: 716894 - DNA, 173 bp, Homo sapiens
cagtacttgtaaacacgagcatgtgaagtcacctaattaatacctttgtgactcataatacctagattcataagcgtcaatgttctcagttctgtcattttaggaaaatcagaaatactggaagttttgggttccctagacccaggagaattgaaaatctcagaattaaggcc

SEQ ID NO: 716895 - DNA, 792 bp, Homo sapiens
  misc_feature (2)..(2): n is a, c, g, or t
  misc_feature (64)..(64): n is a, c, g, or t
  misc_feature (75)..(75): n is a, c, g, or t
  misc_feature (78)..(78): n is a, c, g, or t
  misc_feature (89)..(89): n is a, c, g, or t
  misc_feature (112)..(112): n is a, c, g, or t
  misc_feature (133)..(133): n is a, c, g, or t
  misc_feature (135)..(135): n is a, c, g, or t
  misc_feature (137)..(137): n is a, c, g, or t
  misc_feature (157)..(157): n is a, c, g, or t
  misc_feature (161)..(161): n is a, c, g, or t
  misc_feature (163)..(163): n is a, c, g, or t
  misc_feature (173)..(173): n is a, c, g, or t
  misc_feature (175)..(175): n is a, c, g, or t
  misc_feature (177)..(177): n is a, c, g, or t
  misc_feature (181)..(181): n is a, c, g, or t
  misc_feature (197)..(197): n is a, c, g, or t
  misc_feature (212)..(212): n is a, c, g, or t
  misc_feature (226)..(226): n is a, c, g, or t
  misc_feature (230)..(230): n is a, c, g, or t
  misc_feature (248)..(248): n is a, c, g, or t
  misc_feature (266)..(266): n is a, c, g, or t
  misc_feature (280)..(280): n is a, c, g, or t
  misc_feature (299)..(299): n is a, c, g, or t
  misc_feature (305)..(305): n is a, c, g, or t
  misc_feature (332)..(333): n is a, c, g, or t
  misc_feature (340)..(340): n is a, c, g, or t
  misc_feature (351)..(351): n is a, c, g, or t
  misc_feature (358)..(358): n is a, c, g, or t
  misc_feature (390)..(390): n is a, c, g, or t
  misc_feature (488)..(488): n is a, c, g, or t
  misc_feature (606)..(606): n is a, c, g, or t
  misc_feature (615)..(615): n is a, c, g, or t
  misc_feature (629)..(629): n is a, c, g, or t
  misc_feature (631)..(631): n is a, c, g, or t
  misc_feature (634)..(634): n is a, c, g, or t
  misc_feature (636)..(636): n is a, c, g, or t
  misc_feature (782)..(782): n is a, c, g, or t
gntccaacattagtcgtacttcctccctcccgctatcaaaaaaagaagaaactccaatgggatnaagtagagccnggnggtgtccagcnttgtatgggcctcaaaaaaatantccatccagcatccagaattntnantccctctcatccctgaagtnctanantgtcaaagcncngnaaangcctcctttgtgctgncattggagacaaggntccgttcttcaggntgcngggagaattgggataganactgactctggacttganatgtagtgctcagngacaggccctcacgggcanctgtgnattctctactctgatgagggggaaagnncactgcnaggggggtggnatctggngtgttgtggcggtggcactgctggtgggttcnacggcgtggcgcatgctgggtgacggtgtcacgccacacactgctctggggcaggcgtgatcagtgagggtgggagacagacaatgtgaaaacgtaanactggccaatgattcccctgcttctttggtactttccaaaattctctgatcaaaaaagtataagggaagcacaccattaaaaaattacagttttacgtatttacaaaagcaatgatgntatattacncaacaatcaatacncngtntntgaacaaatcttcagtgaaagcacttgtgagctcccgtcccgctgtcatcccacagcacgcgacctctgcagggtcaggttgcctgttctgaagctcattaccttacagtatattagaaggcaaaacatcatttggaaaaaaatcnttttcaatct

SEQ ID NO: 716896 - DNA, 612 bp, Homo sapiens
  misc_feature (133)..(133): n is a, c, g, or t
  misc_feature (157)..(158): n is a, c, g, or t
gccttcggttttcccccccggttctttgcggttgggccctttttttttgggccccccccccccaaaggcccctcctcccgccgtgtggggtttttttttgtggtccccgcgggcgcccccttctcctcccccnggtcttttgagttttcccacccanncggtgggccagggtggtgggttttttggcccccccaccggggggttcggggcccccttttttgttttcaccccccaaattaaaacccctggggggccccggggtttcccccccggggggggttttctccccccccccccgggggtgttttttcctttttttggggctttttccccctcggggccccccggggccccgggggttttgggggtttttttccccccccgcccccccctttttgggggtttttttccccccccggggggggggggcggggccctttttttttttcccccccccccggggcccctttttttttttttttgggcggggggggtttttttcccccggggaccctttccctgggcccccccccccccggccccccccgtttcccggtttggggcccggggtttttcgggggtttccctttggggttttttggggccccgcca

SEQ ID NO: 716897 - DNA, 253 bp, Homo sapiens
tatctcactggttcatgcacactcacgaggtatgctgatcatgattgcggggtgaccaggctcagagaaggttgagaagtgctgaaatctgacgcgtgagagaatttgctatcttacagttttcagtcccaacatgagttcagcagagtaccatgcccaatcaagagtgctgggagtgggatcccactcagccagctagcaccagagagcaggaggtcctgggagccaatgggctctggatgaaacgtcagga

SEQ ID NO: 716898 - DNA, 144 bp, Homo sapiens
  misc_feature (14)..(14): n is a, c, g, or t
tactaagggcgtantctgtcttgctgggcaagggtgccgtataatcatccaggtgctttatggcatctcccaaggaagtcagcacttcttgccatgtgccttgactttggggttgccatgatggcagaggcagaggacaggttg
